United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 12

SEQ ID NO: 57502 - DNA, 399 bp, Glycine max
  Peptide Sequence Number=SeqID_149187
atgttcgataaggtgattctggcgattgccgccagccccagcaaaaaaccgatgtttaatttgaacgagcgcgtgcagctggctaccgacgccatttcgcacctgcccaatgttgaagtggtcgggtttagcgatctgatggcgaacttcgcccgcgctcagcaggcaaacattcttatccgcggtctgcgcgcggtggcagacttcgagtatgagatgcagctggcgcacatgaaccgccatttgatgccggagctggagagcgtattcctgatgccctccaaagagtggtcgtttatctcttccacgctggtaaaagaggtggcgcgtcatcacggcgatgtgacccatttcctgccggataacgtccaccaggcattgatggcaaagctaaagtag

SEQ ID NO: 57503 - DNA, 511 bp, Glycine max
  Peptide Sequence Number=SeqID_149188
atggcttcgagaaagctttccacaaagagatctaggagggacgccgcggctgaagggaccagtgtcgctcccgagtttgacagccaccgtttcaagagtgctgagcaccaacaatgtttcgaggccatcaaaggatggtcgttccaccgagacaaatgggtccagctcagggacgatgagtacacagattttcaggaagagatagctcacgccctcagccaattcttgggtgactcgcaagtgttagaggagggccaggaatgcgagtttagtcagagaaggaaccgggccgatggatttgacgaggaggccattgcccagctattatgcccgatgatgccattacgaatgcccctaatttctttatctttccttaacgggctttcctacgccttatggactgtttgtataatcttgaaactttgcgcaccgaaatctctcacaaggaaaggagagaggctctcttcaatcgatgctcccctcatagggtaccttaactgtcttatagcaa

SEQ ID NO: 57504 - DNA, 282 bp, Glycine max
  Peptide Sequence Number=SeqID_149189
atggttcacaacatccctttgttgcatgaccaagtcaaggtaggtgttgaggaggttgaagatgcaaaggctcccattcctatacccactaacgaggttattttagtggggcaggcacttaacaccttccttgcttgtccgacacatctcgtgaagcgtgtatcagaccaagatgctaccgtgttcggggtgtttaatcaagacttcccgttgcacatcaagcacgaagatctctctgaagttgcatacggtggtcaatgtctcagcatatttgttatatag

SEQ ID NO: 57505 - DNA, 255 bp, Glycine max
  Peptide Sequence Number=SeqID_149190
atgccgcgaatcctcttgaaagagaggggtgccttcgggaacgcggacacaggtggtgcatggctgtcgtcagctcgtgcctttggaaccctgttcttggctgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 57506 - DNA, 324 bp, Glycine max
  Peptide Sequence Number=SeqID_149191
atgcaaccgaggaagctatccgcaaagagatctaggaaggacgtcgcggctgaagggaccagtgccgctcctgagtttgacagccatcgttttaggagcactgagcaccagcagcgtttcgaggccatcaaaggatggtcattccaccgagagaggcgcgtccagctcagggacgatgagtacacaaattttcaagaagagatagttcgccgacgttgggcgtcgttggttactcccatggctaagtttgacccagatatagtcctagagttttacgctaatgcttggcccatggaggagggcgtgtggaacatgcggtcatgg

SEQ ID NO: 57507 - DNA, 434 bp, Glycine max
  Peptide Sequence Number=SeqID_149192
atggatgacattgctactgagcaacattctgcccagcgaccacaatgtcgatatccccctgcggaagtatcagttgggatcgcgcccacaagacacccagtggacccagagaagtccaatagggccctgcggtttccagctctggttatgggcctttgtcagtcctacagggtgcccgtcccccctagcaaggtcatgccatcacacccagtggacccggagaagtccaacagggtcctggggtttccagctctgattacgggcctctgtcagttctacggagtgcccgtcgcccccagcaaggtcatcaagcctcgtactaaccaagctttgatcaagaagtattacgcccccaagaaggcgcagggtgagacaccacagcagccagggcatggccggcagcggacaacagacgcactgccgccttctccaaa

SEQ ID NO: 57508 - DNA, 363 bp, Glycine max
  Peptide Sequence Number=SeqID_149193
ggacacgctttacggcacccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttgggaaggcaagcagttggtggtatacccctgcaaaacactttggagggccctcaatatcatccacaaccacaaccctcacgttccccagcg

SEQ ID NO: 57509 - DNA, 224 bp, Glycine max
  Peptide Sequence Number=SeqID_149194
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggacttaaagataccaggcgttccccctggcggctccctcgtgcgctctcctggtcctgcctttcg

SEQ ID NO: 57510 - DNA, 443 bp, Glycine max
  Peptide Sequence Number=SeqID_149195
atggccccgaggaagctcgtcacaaagagatctaggaaggataaagcggctgaaggaaccagttccactcccgagtatgacagtcaccgctttaggtgcgttgaacaccagcagcacttcgaggccatcaagggatggtcatttctccgggagcgacgcgtccagctcagggacgatgagtataccgatttccaggaagaaataggtcgccggcggtgggcatcactggttacccccatggccaagtttgatccagacatagtcctcgaattttatgccaatgcttggccaacagaggagggcatacgtgatatgaggtcctgggtgaggggtcagtggatcccgtttgatgcagatgctatcggccagctcctgggatatcctttagtgctggaagagggccaggagtgcgagtatggccagaggaggaatcggtctgatgg

SEQ ID NO: 57511 - DNA, 1275 bp, Glycine max
  Peptide Sequence Number=SeqID_149196
atggccaatcaaggagattgggtcccgtttatggatgtgttagctttgctaatttttggggtcgtcctctttccaaatgtggatggtttggtggacctagcagcaatcgatgctttccttgcctaccaccatagcaaggaaagtctggtggtagctgtcttgtcagatctatttggcacatttgaccgaaggtgcgaaaagagtagtgcacggatcatctgttgcttgcccgccctctgtgtttggttggtttcacacttgttccaacaagacacaagacatccatgtccgctcctgagccatcgctcgtgtactgaaaagaggagaatagattgggaccagcttttggccgggataggaggtagaacaatcagttggttcccccgatggaaggaaggaaaagaaggagtccttttctcatgtggaggatacccaaacattccgctggtagggacgaggggttgtattaactacaatcccgcgctcgctataagacaactagggtaccccatgaggggagcaccgatggaagaaagcatgtctcctttccttgtgagggatttcggcgcacaaaatcccaagtctatacaaagaaaccataaggcatgggaaaccccgttaaggaaagaccaagaacttagaggcattcgtaatggcatcattgattggctcgccaagttaaaagtcgtcagcgaagagagttttgaagcaccggaagaggacgaagaagtccaagctctcaaaagcgagttagggaaggtgaaacttgccaaggagaagttcaaattggccgctacacacattcggaaggagtgtgccgagttacgggaagagaatgcaattaccgcaagagcccttgaacaagagaccaagagggctcgcaaggaagagtatggccggaataaattttgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcccacgagcatagaatcacggacgagtatgctcaagtatacgcggaaaaagaggctagaggatgggtgatcgactctttacaccaagaggcaaccatgcggatggatcggtttgcttttaccttgaaagggagtcaagaacttccccgcttgttagcctag

SEQ ID NO: 57512 - DNA, 321 bp, Glycine max
  Peptide Sequence Number=SeqID_149197
atgaaccagaacgaaggaattgttactggggtctttaaaattttctgcctatgctctgttttgcttggctgtgatagcttgtatggttttgaatgtcgttttgtttggatgttgtggaagcttgggaggattgatggggacccggtgttgagagaaacgaggatatgggctacgtgggagtacgtgagctcagatggaggtgggcaacagggatggtgggtttatgcgcgctttgtggatgtggaaaacttgttgtgcaccatcgcccgaccgccacctagtaccacatgtgatgggtaccccataatcctacaagcttga

SEQ ID NO: 57513 - DNA, 382 bp, Glycine max
  Peptide Sequence Number=SeqID_149198
atgactagaggcaatccatctgacttacaaccctttgatcctgagatagataggacatttcacagattagttaggcatcaatttataccttttgatcattctgagcattccattactggtgaatctgtgcattctgttattggtgattttgaacatcctgatcttgagcattataattttgagcattctgattctgagcattctgattttgcacattctgagaacatggcacaacctccaccccgtgagaggactctaagggaaatggttgcacctgatttcacctacgaaagcttgtgcatccaataccctgatgaggatgtcccatatgttcttaaaactggactgattcatttgcttccaaagtttcatggccttgcag

SEQ ID NO: 57514 - DNA, 403 bp, Glycine max
  Peptide Sequence Number=SeqID_149199
gaggtttccagactatggaaagctaaatcctctgctggatcttcccttggaaacaggtctgattctaaagtccttggtagtacaggactaagttgttgtgctatcacgagggattcggtgcacttgtcggccgtgaacagttacatgccttcaagctttcccgatttagtgttcgtcgacgaaaggattgaagtgggtctgaggaaaggcaaatttgattgtcttgctttgacaaataaaaagcctagggcaaatgaagagaaggagaaggaggaaggaacccatgttgtggctgccattcctacatggccaaatttcccacctgttcaacaatgtcattactcagccgatatcagcccttctcattacccaccacccaatcatccacaaaggccatcactaa

SEQ ID NO: 57515 - DNA, 96 bp, Glycine max
  Peptide Sequence Number=SeqID_149200
aggattgcatggaaccgacaagcggagaagaaaaagaaatctccaagtgacgtgacaaggaacccgcagacctgtgagtgtgaatctcaggcatga

SEQ ID NO: 57516 - DNA, 927 bp, Glycine max
  Peptide Sequence Number=SeqID_149201
atgcagcgccaatgcgctgatgccgcgggcctccagggcctcaaacatcggctgacaatcgcgtttggtattgcagaacaccacgcaggacgcaggttgatgataacgaatggccgacaccagcagcgccgggcgctgatcgcgcgtggtctcatagaagcgttgttcgatggcggtctgcgcttcgtcatcgcccacttcgacgctcagcggctggcgctgaacgcgttcgctgatgcatgcgatacccgccggataggtggcggaaaacagcagcgtctgacgctgcggcggcgtgtagctgatcacatcgtcgatatcgtcggcgaagcccatgtccagcatgcggtcggcctcatccagcaccagcaccttcagttcgtccagcagcagcgttttcttgcgcagatgctcctgaatgcgccccggcgtccccaccacgatgtgcggcgcgtgcaccagcgaatcgagctgcggccccatcggttggccaccgcacagcgtcaggattttgatgttttgcgtgaaacgcgccaggcgacgcaactctttgctcacctgatcggccaattcgcgggtggggcagagcaccagcgcctgcgtggcgacctgagcgacgacgatattattcagcagaccaatgccgaacgccgccgttttgccgctgccggttttcgccttggcgcgcacgtcccgcccttgcagaatggcgggcaacgcggcggcctgcaccggcgtcattttggcgtaccccagttcgttgaggttggccaactgttcggctggcagcggcagggaagaaaaagaaactgtgctcacggcgataactcttatatgacgaatggaatggcggcgcgcccgcaggttggcgccgaatcagcggcaaatgataacagagatgggcggcgttacgggcagcgggcataa

SEQ ID NO: 57517 - DNA, 141 bp, Glycine max
  Peptide Sequence Number=SeqID_149202
ggtaaggattatggtgagtcaggattttggctcaaggataaaagggatgccccacattatttccatgacacaaaatgcaaaaatgatgatttggaaactttatgcaaaactggtcgtgcatgcacctatgcggacactcaa

SEQ ID NO: 57518 - DNA, 255 bp, Glycine max
  Peptide Sequence Number=SeqID_149203
atgaagaataagaaggttgttatggctggtgtctcgctaagcgaggcttgtgcacttagcgagaatcatccgcttagtgaggcactcaacctgcttagcgagtcgggagaatctggaggagaatctgtcaagcatctgcgtgctcagtgcgtcatcaactcgctcagcgagtcatttgtcttctctcgcgctaagcgtgcccagctcactcagcggaaaatcactaacttgcgcttagcacgaaaatggcgctaa

SEQ ID NO: 57519 - DNA, 423 bp, Glycine max
  Peptide Sequence Number=SeqID_149204
gaaggcaaggaaggagttcttttctcgtgtggggactaccctaatgttccattgatagggactaggggttgtattaattataatcccgcactcgccataagacagctagggtaccccatgaagggagcgccaaccgaagaaagtctctcgcctttccttgtgagggatctaggcgcgcaaagtctcaaggagaacttcgaaacttcggaggaagctgaagaagtccaagctctcaaattagagctagggaaggcgagactcgccaaggagaagttcaaatcagccgctacacacatccggaaagagtgcaccgagttacaagaggaaaacgtggccactgcaagagcccttgaacaagaaactaaaagggcccgcaaggaggaatatggcccaagagaaattccgaggagcattgtggggtag

SEQ ID NO: 57520 - DNA, 288 bp, Glycine max
  Peptide Sequence Number=SeqID_149205
atggtgaaagttggaacctcttacgtgtcgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 57521 - DNA, 792 bp, Glycine max
  Peptide Sequence Number=SeqID_149206
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcagcagctttattcttgtacactacactatcctcatccttcacctccacaaaccttttactcattgtcatcacagctttgcattcctccttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcaaaatatgtgatacaggatatattccgcttcctcgctcactgactcgctacgctcggtcgttcgactgcggcgagcggaaatggcttacgaacgggggcggagatttcctggaagatgccacgaagatacttaacagggaa

SEQ ID NO: 57522 - DNA, 498 bp, Glycine max
  Peptide Sequence Number=SeqID_149207
atgggccgcatgaagaagacaggggagatgacgactgaggccacaaaggaaatcgttgaggccacacagggatcgttcgttccccatggatgtcaggatgttctggccgctgctattggacgtccagagcaccctggacgtgcccgtgctgctggagccggtatcagggaccagctagaggagtccatcatagagaaagtgacgaggcaggtcatggcatccttcagccagcttcagtcgcagatgcaatctcagggacttgcagtgcctcttgagcctctggttggtcctggtccctctggtcctcgagtgagcacaaaggggagttgtgttgatccctcaggaaacgatcctgagatgggtgactctgacaggtgcggcttgtacatagaaggatccactcttgttcataacactcctttgttgcctggccaagtaaaggtgagtgtggaggaggttatagatgcagatgctccagttcctgtacccactgatgag

SEQ ID NO: 57523 - DNA, 345 bp, Glycine max
  Peptide Sequence Number=SeqID_149208
atgaaactggccaaatacaggctaaaggcccaagtggagaaggacgaaggcccaagtggagaaggacaaagcccccgagtggagaaggatgaaggcccagaggcagagacactatcaagactattaattacttatcaaggtaatccttgtggtgtctatctagacttatcttccttcactggaagtggcgtctacccagacttatcttccttcaccggaagtggcgtctaccctgacttatcttccttcaccggaagtggcgtctaccctgacttatcttccttcaccggaagtggcgtcatccaaaccttcgtagcctgtatcaaacgatccgctcctacttag

SEQ ID NO: 57524 - DNA, 123 bp, Glycine max
  Peptide Sequence Number=SeqID_149209
atgacttgtgagatatatcgcatcccattagtcaaaaacatcgtttccttgaaaaccagcatgcaacagggatatgcatacatccccatagttaggttccctaactcccaactatggtattaa

SEQ ID NO: 57525 - DNA, 114 bp, Glycine max
  Peptide Sequence Number=SeqID_149210
atggtggagataagacggtggccaaggttttgcaatccggattcttttggcccacactctttaaagatgctcaccagcatgtgctacattgtgatcaatgtcaaaggatgggag

SEQ ID NO: 57526 - DNA, 635 bp, Glycine max
  Peptide Sequence Number=SeqID_149211
cggtggagagacctggcagcacaagtggccctcccatggtcgaaagggagatgattaccatgatggtagacaccttgccagtgttttactatgagaagttggtaggctacatgccttccagcttcgtggacttgggatttgccgggaaaagaatcgaagtagggttgaaacgagggaagttcgattatgtttcctccacaggtgccaatgctgggagaatcggagcaactggggcaaagaagaaggagggagatacccatgccgtcacttcggcgcccgcatgggtcaagctcccgcaggcctctcatggtacacatcagtacgcgcaacatcatgctagcttctcagctcacgccgggaatttctccaatgcagcacccgcgcagcctagagcgcccgcccccatccagaggggggcccccctaagctccggctccaaccacgactcgcccggccggcagtgcccactttggttccagttccaacacgatgagaacctttcccccgaagccaattccagaattcaccccactcccaatgacgtacgaagacctcttgccgtccctcatcgccaaccaaatggctgtgataactcccgggaagatctaccaatcccctttcccaaagtggtatga

SEQ ID NO: 57527 - DNA, 213 bp, Glycine max
  Peptide Sequence Number=SeqID_149212
aagtcgcaacttgcagcattcttagcaagctcaaaatctaaagagagtcttgcccagaatctcaaagaagttctccaactacttcaacaggaagcgaaagaagaacctcccaagaaggaagccgaatcaccggagactaacgatgaccaagaagatgatccattctaccagaatgaagatgactgttttggtatatcgttagacgacgattaa

SEQ ID NO: 57528 - DNA, 486 bp, Glycine max
  Peptide Sequence Number=SeqID_149213
atgcttgaaagttttcaacaagaagatcaaatgtcaattttggaattgtacatagaaaaggatgtggtcgatggttctatgtttcattcggcaaattctcttacaacatgtgaaaataatttatctaataatgaggcgcaaccgccaagaaatgtgagcaatttacatggtgatgaagatgatgatgatgatcttgtgtctaactcatacgtggaagagtctttagacgaagatgatagtattgacggtatatctgatacagacgatgaagtcactgacatgattcaaccagtgtacaaggaattcaaaatccattttggaatgatgctttgtattataataatatcaactgaagtcatcctgatgaggaggacatttgtggtttggagatgccatcgagttttaatgttggccaagaattatatgttggcatggattttgatagtaaagatgcggtcaagaatgcagtcaaacaatatgttatga

SEQ ID NO: 57529 - DNA, 348 bp, Glycine max
  Peptide Sequence Number=SeqID_149214
atgacgagacaattacagcggatgggaatccttggaggaaaccaagaaagaacaaaaactgcaacaaaggctggagcaaaaacactgcagcggttccctcaatgtgccccagcttcaagcgtaatatcgcttaacgacatcggagttcagagcgagggtagttcctcaccatccatgttggtgcagtaccagaagttcccccccagaaaaagcccttttcacaatgaaaggggaaacataaccatggtcccccctgaacttgcacggttagcgtaccttctactcgaacgcttctttatcttagttagatacaggcccatggctcatggcgtcatgcttaccttttaa

SEQ ID NO: 57530 - DNA, 764 bp, Glycine max
  Peptide Sequence Number=SeqID_149215
ccttcagagggctacacgccctcgccatcagaggagtgcatgtcctcaccttcagacggccacacgccctcgccatcagagaaccacacgtcctccccttcgtagggctacacgccctcacctttagaaggaccacacgttctcacctcagagggctacacgccctcgcctttaggaggaccacacgtcctccaccttcagagggctacacgccctcgccatcagagggactgcaggtcctcaccttcagagggctacacgccctcgccatcagaggactgcaggtcctcaccttcagagggctacacgccctcgccatcagaggactgcatgtcctcaccttcagagggccacaggccctcgccatcagaggaccacacgtcctcaccttcgttgggcaacacgccctcacctttagaggaccacacgtcctcaccttcagagggctacacgccctcgccatcagaggaccacacgtcctcaccttcagagggctacacgccctcgccatcagaggactgcatgtcctcaccttcagggggctacacgccctcgccatcagaggactgcatgtcctcaccttcagcgggctacacgccctcgccatcagaggactgcatgtcctcaccttcgtagggctacacgccctcacctttagaggaccacacgtcctcaccttcagagggctacacgccctcgccatcagaggaccacacgttctcaccttcgtagggctacacgccctcaccttcagaggactacat

SEQ ID NO: 57531 - DNA, 243 bp, Glycine max
  Peptide Sequence Number=SeqID_149216
atggtgcgaagggtatttctcttagctctgacatgttttggaattcccaacgttgagaatgctaggaattgggttgcaaatgtggtgctcaaatttaacgacgatccaatggagaatgagttcgagattgtagtttttctgagacaggtttggtgggctgcggggaaaagaaagggatttgggaaaagaagagagaaaaacgaaaatgacgggaagaggaggcatcgtcaatctgaaaactga

SEQ ID NO: 57532 - DNA, 258 bp, Glycine max
  Peptide Sequence Number=SeqID_149217
aggatccccgccgcaggcgcgccaccaccacctcatcaggctggcccagctgggtcgtttgatacggagcagtatttgcggcatttggttcgccagcaggcggccaaccaccgggcgcatgtcgcatggcctgggaattggcccgaggcccaggcaggagaggcacccccagaggctcccgacgatggagaggaggcccacgaggacgaggagatgaccgatttgcttgacttcttgggagggagtggagctacatga

SEQ ID NO: 57533 - DNA, 593 bp, Glycine max
  Peptide Sequence Number=SeqID_149218
atgagtcttcattcttcatctagtgttaatggtgagggttctacttctaaggacacgttgtataagatattagatgagttgagatcccttaagttgtggaaagaaaaacaagagagaaaagaaaaaggaaaaaaaagagtggaagaaataagtcatgatgaaagagaggaagaaagaagaaaaataatgaaagaaatgaaaagagaagaacatgtctcctatagtagtcataactcttgcaagagcctaagtgaagaacttcgtgactattatgaaggaaggcataggtcacatcttagacctcactcccataggagagaaaatgaaagaaagcctcaagaggctaacattaacctcccatacttccatgggaaggacaatgtagaggcttacttagattgggaaataagggtagagcaaaaacttaaaagaaactctactttaaaatcttatggctctcattcttatccaaataaagaccatggtctaggcatcttatgggcagcatcatctaagccaaaaaatgataaggggaagacaatagaaaagaaaccccctaaggctagtaggcaagaaaagactagctctataaa

SEQ ID NO: 57534 - DNA, 518 bp, Glycine max
  Peptide Sequence Number=SeqID_149219
atggataatgaagagggcatgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcaacccgccttgaatccgggcctagacagaaacacggccgtgttcggtcgaaggtatagtccgcaagcttatccttatggcctgcctccggacttcaccccccgtgccaccccagaagatttaagccaagccccgacctttgaggggcaactcccaccttatgaagactatcccgggcaagacgatggggaaggagatacccatcttggccccctgctccacctcaaagatccgtccccgcatgaactaccccagccaaacatagtctgccagatcccagcctcacccacacccgtaaaagaatctgttcccttcgcgggagataagggaaagattgaggcgcttgaagagag

SEQ ID NO: 57535 - DNA, 984 bp, Glycine max
  Peptide Sequence Number=SeqID_149220
atgggtcaacttcaacggcaagccttccgtaaagcctatggtaagatttgggacctagctagggtagaagtctccatggaaccgattgcatccctttcccagtattatgaccagcccctaaggtgcttcacatttgaggacttccagctagtgccgactatgaaagagtttgaagaaatcctgggatgcccactgggaggaaggaagccatatcttttctctgggttctatccctccacgacaagagttgccaagtaccaaggaagtgtttggaggaaagggaaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaagaaagcccggtcgtcgccattttggccatgtatgacacgttcgaccggggatgcccgtctatctgctacaaggtcaccgctcgtgcgtcgaaaaaggaaaggattctatcttcatgcgaaggatgtccaaatgttcccttgatgggaacaaggggttgtattaattataatcccgtcctcgccataagacagcttggctaccccatgagaggagtgccatcagacgaaagcatcatgcctttcattgcacggggtttcagtgaccacaacgcgagggacagagagcttaggggaagcagtaatgggatcatcggcggctatcataagtggctgagagtccggacacaaggattggattggctcccaaatctaaagactgtgagagacaatgaggttaaagcttcggaagaaagtgatcaggtacaagccctaaaggcaaagcttgaaagagcccgggtagtcaaagagaagttcaagtccatagccatcaaaggcagcaatagtgagctcaaactccgaagaggtgaaaggaatcatcacgggtcaaaggcatga

SEQ ID NO: 57536 - DNA, 810 bp, Glycine max
  Peptide Sequence Number=SeqID_149221
gccatcagaggactacacgtcctcgccttcagacgtctgcacaccctcgccttcagaggactacacatcctgcccttcagaacactacgtgtcctcggcttcagaggactacatgtccttgcctttagagggcaacacgccctcggcttcagaggactacacgtcctccccttcaaaggactacatgtcctcaccttcagaggactatacgtcctcggcttcagaagactacatgtcctcacctttagaggactacgtgtcctcaccttccaaggactacacatcctcgccttcagaggactacacatcctcggcttcagaggacaacacatcctaaccttcaaaggactacacgtcctcgccttcagagggctacacaccctcgccttcagaggggtacacgcccttgccatcagaggactacacgccctcaacttcagaggactgcacgtcctcaccttcagaggactgcacgtcctcaccatcagaaggctgcacgccctcaccttcagaggactacacgtcctcgccatcggagggctgcatgccctcaccttaagaggactacatgtcctcaccatcagagggctgcacgccctcgccatcagaggacttcacgtcctcgccatcagagcactacacgtcctcgccttcagacggctacacgccctcgccttcagaggtctgcacgtcctcgccttcagaggactacacatcctcggcttcagaggtctacacgtcctcgccttcaaaggactacccgtcctcctcttcagaggactacgtgtcctcggcttcagaggactacac

SEQ ID NO: 57537 - DNA, 417 bp, Glycine max
  Peptide Sequence Number=SeqID_149222
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57538 - DNA, 372 bp, Glycine max
  Peptide Sequence Number=SeqID_149223
atgagaaaaactttactttttactacggtttccatttttttattgatcagtatttcagtgaaagcacaaaagggtgcttcttctgaggacaggataaaaaaggttttatacttcaatcccgaggtagagcctgatattgatgaaataaaagaacctaccaatcatgcatttttcagtgctgtttcagataatttaagcggctataaaaagaataaaatgctgcgtaccgaaatccagattccctttgacagcgtggatgcacagacgattgctgattactgcatcaacaatgatgctgattttgccgttgttccgaaagttaaatactttaaagtgggaattggaaagtatgtgttctccaaccaggttgtt

SEQ ID NO: 57539 - DNA, 421 bp, Glycine max
  Peptide Sequence Number=SeqID_149224
ggaccaaccacgagtagacagtttgatcttgaaggatgagttgaaggtttgcctaaggtccaagagaagcttgtctcagtgtttatgcgagacaaagaccaacatgttagccatcgtcagcaagtaccaagaagaattaaatctagccacggcccacgagcacatagtgacggacgagtatgcccaagtgtatgcggaaaaggaggctagaggaagggtgatcgacttgttacatcaagaggcaacaatgtggatggaccgatttgctcttactttgaatgggagtcaagaacttccccgattactagccaaggccaaagcaatggcggacacctactccgcccccgaggagatccacggaattctcagctattgtcagcatatgatagacttaatggcccatataattagaaaccgctag

SEQ ID NO: 57540 - DNA, 249 bp, Glycine max
  Peptide Sequence Number=SeqID_149225
atgactaccattcctatacggccaaacttcccaccagcccaacaatgtcattactcagccaataacaacccttctccttacccaccacccagttatccacaaaggccatccctaaatcaacaacaaaacccacctaccacacaaccaatgctagcaccacctttagcaaaaaccaaaacaccaaccaaggaaggaattttgcagcaaaaaacctatagaattcaccccaatttcagtgtcctatgctaa

SEQ ID NO: 57541 - DNA, 252 bp, Glycine max
  Peptide Sequence Number=SeqID_149226
atgtggaggctaaaaatagcaaatggaggaaaggatccgtacatatttagcacaaacaactttctgggttgggaaatatgggagtttgatcctgaggcatgcattgaagaggagaaagctgaggttgaagcagctcgtgaaaatttctatgacaacctcttcaactttagagcttgtggtgatcgactttggtggtttcagtggaagaaatttcaactagcatcctctcattccccttatcccttcaactaa

SEQ ID NO: 57542 - DNA, 382 bp, Glycine max
  Peptide Sequence Number=SeqID_149227
atggtggtctcgaatgagagcctgagctactctttcggtctatccaacggtttcgcgaagaagcccatgctctcaatgacggtggtggagtcgagagacttcctcatcccgctctctgaatccatcgcgttccacagactccctttcttcgagaccatcgcggtcatcaccaaggccaagggagctaacctcttttgctggaaccaccgccgtggattcctctgcttagccaggcagaagcacatttgcatctttcgacacgacgatgaagacgatgtcggaaatgcttcaatgatggagacgatcctctatctcgtcggtgccaatggcgaaatgcctacttcacatgttttgccagtgccaatggcgaaacatgctccag

SEQ ID NO: 57543 - DNA, 660 bp, Glycine max
  Peptide Sequence Number=SeqID_149228
atgcgccttgctggggcaaggcaaacgaagggtgatgaagttaatgatgatgacatacctagtacttcgggaaggcagtttacggaaggtgtagatggtgacttgctgccttcagatgttccaaagcatattggtcaatctccccttcctgcttatgagcctgcatttgattgggaaaatgagaggacattgatatttggacaaaggataccggaaactcctctatcgcagtatggcattcgtgagattggaatgaagatctctgtaaaagttcagtctttacaatttcaagcaggattggctggtgagtgttatgtggttgatattggtgggataatgtgggagagaagagaaaagttatcagaagacttttactttcatgtcttgccaactgaaacgcagaatgccaaaattacatgtgaacctcgtgcagtcttttacttagatgcgccatctgcttcagtttgtttgttaatccagttagagaagcatgctactgaagaaggcggggttactgcttctgtttattcacgtaaagatccaatcaggaagcgcctagtagaaacagaaaaagacaaggttgaacttgaagatgatgcagattggaacaagaagacacaagtcggaatggaggaagaaatagggcttggattcttttaa

SEQ ID NO: 57544 - DNA, 717 bp, Glycine max
  Peptide Sequence Number=SeqID_149229
atggcagcttatgcttttgtcgttttatacaggctgcggtcagaaataaatcttccaattatgagagaattggttcctcattatctccaggatgcaggacgggagagattggattatttggaagatgggaaaagtgtcttcagattgcgtttgcgactgtgttcgtctttataccctatcaatgaacgtattagagatttctttcttgaatatgaccggcatactcttcgaacaagtccaccatggggttctgaacttctggaggctattaatagtttgaagaatgttgattccactgctttacttcagtttcttcacccaattcttaacatgctacttcatcttattggcaatggtggagaaacacttcaggaatcagttgatgatgctgaaaggaatcatttcctagtcaactatgttgattgtgcctttgatgattttggtggtcgtcaaccgcctgtatatcctggactgtccactgtttggggaagcttggcacgaagtaagtatgggatgcttggtgcagtgcttaagtggcttggttctctccccttgacaactaactttttaagggagcggcttggttctctcccattggttcctgggtgcatatcattggtattagagcttgttgcctgtgtcttggagagaactacctgtggaggggctgacctgaaaggcagacttaagcgttgtagagtacagccaccgggatga

SEQ ID NO: 57545 - DNA, 727 bp, Glycine max
  Peptide Sequence Number=SeqID_149230
gatgttctaaggagtgagggtgatacaggatgtgaggctaaggtattgaagtgtgtattgaaccatatgagaggtagaaagggtgcggagaagactaagacaagtctcagtaaatggcttgttatgaggatgaaaatggatggccttgatgcttctgtatgccacacctcttgggccacctctttgggttgtcctgctggtgagtacgagtatattgaagtgataatagaggatgaccagaattgtggtaaacctacgaggctgatagtagatatagactttaggtcccaatttgaagttgcgaggccaacacaaaactacaaggaattgacagactcggtcccagtgattttggttgggactgagaacaaactgtgcaagataatttccctgctatgttctgctgccaaacagtgcctaagagagaagggtctccacgtgccaccatggagaaccgcttcatacatgcaagccaagtggctctctgtgagtcgtaaagagcctagccatgatgtcattggttatgatgatcatgaacatgctgatgctgatattattggtaactgggtacctccatcactgaagccaaagaaaagggatttggatggtggtggatctgttcgatcaaactccaatgtgactaagtcatggagaatgagtgagtgggtagattcaaaagatattctgaaactcaagtcaataagaattttaccaaagatactagcag

SEQ ID NO: 57546 - DNA, 3975 bp, Glycine max
  Peptide Sequence Number=SeqID_149231
atggacgcggatctgaagtcggcgaaggcggcgtaccggaacgccaaggcggagggaaaccaccgagaggaggcgcggtgggccaacgtcatcggcgacatactcaaaaaccgaggagagtacgtccaagccctcaaatggctccgaatcgattacgaaatttcgctcaaacacttaccggaaaagcatttgctcccaacttgtcaatcccttggcgaaatgtatctccgcctcgaacacttctccgatgccctaatttatcagaaaaagcatttagatcttgcgagggacgctggcgacgtcgttgagcaacagcgggcgagcacgcaactcggtcgcacttaccacgagctcttctcgcgatcggagcacgaccacaactcaattcgcaacgcgaagaagtacttcaagtccgcgatggatctcgcggtgaagctccaggagaatcctccaaacagcaagtcctcttttctcaaggagtacatcgacgcgcacaacaacataggcatgctggagatggatctcgacaacttgcatgaggcgcggaagattttaactagaggattggagatttgtaatgacgaggaggtcgctgaattcgatgatggccgcagtagactccaccacaaccttgggaatgtgtatatggaacttagggattgggataaagctaggaaacacattagaacggatattgtgatttgtaacagaattggacatgttcaaggggaagccaaggggtatattaatcttggtgaagtgaattacaggactcagaagtatgaagatgcaagtgcttattacgagaaggcgcttggtttggcaaagagcttggaggatgaggatgctttggtaaggcaaatcgagcagaatattgaaactgtgagagaagctgttaaggtaatggctgatataaagaaagaggagcagagccttaagaagctcaaaagagatatagccactgccagagggacaccaaatgagcgcaaattcttgctgcagcagaatgcagttcttgagcgtttggttgagaaagcaaggatgatctctgcgtgggagaagagactttttcaagctatgcattgtgaatttgcaaaggagaagaagaaaatagcaagtgaactctgtgataggcagagactggctgattcatatctggatgttgcagaatcataccataaactcagaaaattcaacaaagcaatcaagtggtacaaaaagagttgggaaatgtacaaaaatattggtaacttagaggggcaagcaatggtgaaaattaatattggtaatgtttatgattctactgaaagttggagaaaagcattggatgcatttcaagagagctacagtatcgctgttgaagcagacctccctgatgtgcaactcgctgccttggaaaatatgcattatagcaacatgataagatttgatgatgaggatgagacaaggaggttgaatcttctaattgataagctgaagaaattagaagaaaaagaggcagaagctaaaagtatgccagaggatttttgctctgaaactgatactgaagcagatgagtgtctgtcaaacagtgggtctgatgatttttgctttccaaagacaatttctcgatcaaaaactctgactactggagaagaattgaaagaggacgcacctcttatgtcactctatcagtccttaaaaggctcatccaaaaagaaagcaggccacaaagaaagtcttgccaactctaccaagcaagatgagcattcacccagtagtctgaaaaatcaaaccagtgatcatcagacagttgttggtcgtaaacgtgtccgtgtaattctttctgatgatgatgatgatgaagtcgagtgttcaagcagaaaggatcataattgcccggtagaggacttgcccacttatgatgccattaagagtaaagccagtccttgtaaatttcaggttatctcagaaaatggatccaagactgcaattaatgttgaagaaagtagtagttctttcaaatgttggagtccacatagagccacaaaatctggcagacattccaggtcttttagcaatgatatagttgctgaacctgattttcctggtggttctaaatgtgacactgatgtctctggcaaacaaaatgatattacccagcctatgttgcatcattcccaaaatgacctccagcaatatgttacatgccggattgggaatgacctaatacgtgtagaagcatccttgtgtaccactggtgaccagttgaacattgactctttgaaggctgtagttgcttgcttatattatctacaatttccaactgaaaagagatcagagggtttgttgcccattattgagcatataaaatgtgctggaagagatctagaatccctggaaactgttgaacatcttaaggaagttttgggaaatgacatggttgaagcttccgttgatggatggattcacaagggcctgataaaaatgtatgtagaccactgcaaggagttgtcagaggtaccgaacatcaaggtattgaagaagctttacaatttagaggtttcagatgacgaaattgttgtgtctgactgcgaccttcaagacttgtctattacaccattgataaatgcactgcattctcaaaagtcatttgcaatgcttgacctctctcacaatttgttaggaaatggaacaatcgagaaactgcaaaaggtgttcacagcatcaggacaatcttatggtggcttaactctggatttgcattgcaatcgatttggcccaacatcattgtttcagatttgtgaatgttcactgctatttgatcgactagaagtgcttaacatttctggaaaccgtcttactgatgcatgtggatcttatctttcaacaatattaaaaaactgtacagctctttgtagcttgaatatagagaactgttgtgtcacatccagaactattcaaaaagttgcggatgcattggactctacatctgttcttgcccatctatgtataggatacaacagccctgtatctggaaatgctatagttaatcttgtgtccaagctttctactctgaaaaggttttctgagttgaatatgagtggtctaaaactaggcaaaccagttgtcgataccctttgcaagcttgcagggaccttaaatttgtcaggactaatacttggaggcacgggtgttggaactgaaggggcaattaaattagcagaatcattgctccaagggactgaagagcttgtgaaacttgacctatcatattgtggtctaacatttaactttgttttaaacaccagtgttaattttttttgttccatcctagagctgaacctggaaggaaatcctatcatgcctgagggcagcaatactttattttctcttcttgtaaacccacagtgctgtctcaaagttttggtccttaaaaagtgtcaacttgggcttgcaggaattcttcacataatcgaggctctggcagagaacagctgccttgaggaacttaatgttgctaataattctattccgaaggaagtttctgctctacaatatgatttatcggtaaaaagctgctcacaaaaccaggagcagaaacttgatactatgaaagttgatgataatcaagaggtccttggctctctaaacagtgccgaccatctactggaagttgctgatagtgaagatgttccagtagaaacagctgcttctggatttgacgacagctgtgccagttcatgtcaaagaaattcatctcccgagtgccatttcacgcaacagttttcaattgctattggtaaggcaaagaacttgcaattactagaccttagcaataacggtttttctgcacaagctgcggaagcattctatggttcgtgggcgactttacggcccctttcaagtcaaaaccacattactgagcagataattcacttctcaacgagggaaaataagtgctgtagagtgaaaccttgctgcaagaaagtttga

SEQ ID NO: 57547 - DNA, 2103 bp, Glycine max
  Peptide Sequence Number=SeqID_149232
atggcatcgtctcatggtaatgcccactcggatgctgcaaagatggaacaaataatcaccgagttcttcgccaagagcctgcacataatactcgaatcaagggcactctatgtgtcctcacgcaattcctatggtgatcaagctgtttcgtctccgtgttcgtcgtcttcatcttcgtcgagtgtgcggccgagggataagtggttcaatttggctctccgggagtgcccggcggcgctggagaacattgacctctggcgccagaacaatcttgagtgcatagtgatagatgtgattttggtgcagaggcctctggattgggatcctgtgactgtgagtttttctccaaagagggttcttcctaggagttcttcactgaaggaaagatgcccttttggctggaacactgatcaggaagaattgggggttgtgggaaggagtgaaaagattgtggagaggtggcttgtgcagtatgagagtaggaagacaagggattctaattctggcagtaggagatcaagcaatgtttctttacataacttgtataagaaatcaactttgcttctgaggtctttgtatgccactgttagacttttacctgcctataaacttttccgagagcttaattcgtctggacagattagggactttacccttggtcaccgtgtgtcttcttttgttgagcccttcacccggaaacaagaggctgaaatgatgaaattcgggttcacccctgtggatacttcttctggtaggctgtgtctcagtgtgatgtattgcccctcagcatcagatgtgagttctgaaccttccactccgatgtccccacaagttataactgattatgttgggagtccattggctgatccattaaggaggtttccttctcttcctgtggcaggtttgccatcttcaaggcagcgtagttggagtttcgatcattatagagcctcacctccttcttatttaccttcgcctactcattcagaatcactctcgtcagggtataatgcatgtttgcggcgtttcccccctgcaagtttgcctcctcatccatctgagatgtctttgattcagaagaagaatacaaattttgatgattattatccctctgcatcaccttcaacctctaattctgggccgttaccatgcaaaccccttttacgatctgaaagtgctccagtcagcatacctactgctgaagttgataattcccctggatactccaataggcataatttgcctccatctcctcccctaagaatttcgaggggcattggtaagattgataaaaacccaatgcaaacaggagcaacagctgagaagttgttttctcttggaaaagacgagtctcgaaaatattctggagtgaagatatcagctaacagctcgccccagatttcaatttccagaagctcaagtaggtcttatcaggatgattttgatgatactgattttacttgtccatttgatgtggatgatgatgatatgacagatccaggaagcaggttgaacaggtacaggaacaagagtacttccatcccactgggatttcctgtttctggtctgggaaagtccagccagaaggagaataccaaagagaggtcagtaggtcaccaacacaacatggtccctgacctgttaagaggtggagagaaatccttgaagataggagcattctgcactggattggaggccatgcttttgaggatcatcctcatgtcatccatggaagtagaatctgaatctctggatcacggtcatatagctgagacgcttgaagctggaggattctttcccattagaaagtctcaagatgctgctgttggtgcgcttgtacatatgctgaagaaagcgccacctctgcatcaagatttctccacctcacaacacctctcacaaggtgcataccctgaaacctggaaaaataacactcaagggaccaatcagatcctagaggcatcatcaaggccagtgagcataatgtcttctgggatcatagctactaggaaaacaacagctgatgcattggaagagttccatggttacaaagagatgaaaaacttgttgcttaggcgaggtagtagtaagcaccagaaataa

SEQ ID NO: 57548 - DNA, 630 bp, Glycine max
  Peptide Sequence Number=SeqID_149233
atggcctcatacgtactggtaaatggtgtcaaattcaatgagtattcatctgttgtagtctctgctggctatgatcaatcattgcgtgcttgggactgcagatcccacagcacagagccaattcagattattgacacatttgcggatagtgtgatgtctgtttgtttaacaaaaactgaaattattggaggaagtgttgatggaactgttcgaacatttgacattcgtattggcagagaaacatctgataatttagggcaacctgtcaactgtgtatcaatgtcaaatgatggtaactgcattctagccggttgcttagactctacattgcgtcttttggacaggtcgacaggtgaactgttacaagaatataaaggacacactaataagctttgtttaaagatacaggaccagtcttacaaattggattgctgccttaccaatacggatgctcatgtaactggtgtctctgaggatggcttcatttatttctgggatcttgtagatgcatctgttgtttcaagattcaaggctcatacctcagtggtaacaagtgttagttatcatccaaaggaaaactgcatggtaacttcttctgtggatggcaccattagagtatggaagacataa

SEQ ID NO: 57549 - DNA, 1779 bp, Glycine max
  Peptide Sequence Number=SeqID_149234
atgacaacaggtagatcactagacaggaaagttgtgaaggcttctggaaagtgcaatccaaagacaggattcattggagtgagaaattcgcccaaaagaacaaataaattggatcaaaaagcaagaggatgcggtcaggagttgactgataaagagaatcagtattttccatttaaggaacatatgagaaagtgcccagaacttcccaacaagtgtacttttcttacagaaaagagagaggctattgaacttcatcctggacaaatgctcacttccgcaaaaatcaagttacaactttttccaattaatgaaggaactcggataggacttgaaaaggatgggcataatccttatttagaactcacacttagaggtcgaaagaaaatatgttcaatactaaaacaccttggaaagaagtggggaagttcaagtatagccaaaggggagcttatgctttttccatataatataatggaaaatctatctggctgcagaaggtggacaattaatgatagtgacacaacagcctctgctgtttatactgctgttggaagccctgcactcttccggttgaagtatggctggttctacatgcttgaacccgggtcttttggtataccttccacaccaactcccgataagcctgatgtagctggaagcggcaatgctaatttagaggagactttatgtggtgagcgggacaaggttaggataagcaaagaatacaaagcaactgaagtgggcaatgcagcaagtgaaactgtgtctcagaaagtagaaaacgcaactgttgatcctatggataatgagccaagaataagtagtagccttcaacagccatcatctccatggattgatagtctaagcaatataagcattgggggcctcctgtctgaagcgtcattatttggcgggcttgatccaaaatcatttgctggcatacagccatgtgatataacttctgattcattggatgcttttattgctgctgctcaaattaataatcgcccagttccaagactgcctgctgatgacttgcgcacatctattttagatgctgaagaaacatgccatgcatttcctcttcgaaagttatcttccccaacagatgtgcaggcagcttgtggcaaggattattctgcagtgcgcagtcaggatgtttcttcaaacttattaaagttttcaaatgcagacaagggattctatgaattgaacgtagtatttgtagtttcaaatgaacctaaggcttcacaaaaatgtctttctaataaaataacttcaagtgttgcactgggacagaaagtcaatgatcaagatggagcttcacaaaatcctccatccgggaagactcagacagacttgttactttcttcacgcccatatgatgatgatagaagtcttgggttaacaggcatcaattggaatgattctatgggaccttttgatcttggcatgccggctcagaagcttaatggtggagacagtcttagtattggtggatttagatatttgcagtttcgagtcgccacatgggatgcgttaacaccaaatacactcctcctcggaaccgcaagtcttgagaggttgaaacgaaacaaggagcagcatgcacccaaaccaatcactacacattcatctaacaagcacgtttatgacgtgttggaagagaaagaagaaattggagataatatcagtagcaaggacaaggtagatctagaggatgttgctgctataaacgatgacaagagtcatgagaagaagaagaacattgcacgctga

SEQ ID NO: 57550 - DNA, 165 bp, Glycine max
  Peptide Sequence Number=SeqID_149235
atgaagacgcgtaagagagaaggagatacaacacaagagcaagaagagagagggggggacaaagagatcgagagaaaaatgattgggggtcagatcaggattcactggcacttgttagattgggaagagaaagaaagtgtgaggaaagagaaagaaaagggttga

SEQ ID NO: 57551 - DNA, 1080 bp, Glycine max
  Peptide Sequence Number=SeqID_149236
atggctattgctctctctggccaacttcttcttggacaacctgtaatggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagcttcgggagatttttgagccatttggtccggttgagattgtgcaactgcctcttgacttggaaacaggacactgcaagggttttgggtttgttcaatttactcatctagaacatgccaaggctgctcagagtttaaatggaaaattagagattgctggcagaactatcaaggtttcatgtgtcacagatcatgttgcaagccaagatacaaccgcaaaatctgcagacttggatgacgatgaaggtggattgactttaaatgctcactcaagagcattgcttatgcagaggctggctggtgctgaccctgcaagcctaggtttgcctgttgtgaatggctcagttcctgctcagcagactattagcttgcctattggcgcaccagttctaccaacgcaagttatgcctaatccagcagtagaacctgtaggaaaccccagcgactgtttacttttaaagaatatgttcgacccgagcactgagacggaacctgattttgatatagacattaaagaggatgtagaggaagagtgttctaaatatggccgggtgaagcatatttttgttgacaaaaaaagttcaggttttgtgtatttgcggtttgatacagtggaagcggcaagtggtgctcaacgtgcaatgcacatgagatggtttgcacgcaggtgtcctattatttcaatatcaccctacccgttatccttgtgcattaatatgttacagttcagacccctgggctacgtgaggcttagtatcagcagcaaccagagttgtatgaagccaagtttaaaggggaagtttgaggaagttcatacatggctcgaggctcctgaagatacaatatgcataattttttgtggtcttagttttcatacattaagttctagtttatag

SEQ ID NO: 57552 - DNA, 1404 bp, Glycine max
  Peptide Sequence Number=SeqID_149237
atgaggctcgccggtgacgtggcgggtaccagaaaagcagccaccgatattttgcagctctgcttcgatgcacgagcctggaaaacactcaatgaccagattgtcgttttgtcaaaacgacgtggccagctcaagcaggctgtaacagctatggtgcaacaggctatgcaatatattgacgagacaccagatatcgaaactcgcatagaactcatcaaaacgttgaacagtgtgtctgcagggaagatatacgtggaaattgagagagctcgattgatcaaaaaacttgcaaagattaaggaagaacaagggcttatagctgaagctgctgatttgatgcaagaaattgcggtggaaacattcggtgccatggccaagactgagaaaattgcgttcattcttgaacaagattatgttcgtgcacaaatactctcaagaaagattagcccaagagtatttgatgctgatttatctaaggaaaagaaaaagcctaaagaaggtgataatgttgtagaagaggcccctgcagatataccatctttgctggagttgaagcaaatctattacgaactaatgattcgtgcccttagtgcccttagggcactggttaagggaggggcactggttaagggagtaaaatgggaaatgtttgtactgagatgcggaaaaatgcactcccctgcaatatatgagattccatctgtcaaagaagaccctgccaagtggattccaatcctaaggaaaatatgttggtacttggttctagcgccctatgatccaatgcaatcaagctttctcaattccaccttggcggataagaatctatctgagattccaaacttcaagctactcttgaaacagctggttaccatggaggttatccaatggacaactctatgggatacatataagagtgattttgagaatgagaaggcctctgggaaatctttgggagaaaaagcagcagaagatctaaggcaaagaataattgaacatagcttttgtgcctcagtgtacaggtttgtgattgattctggttgtggttgtctgcttttaagtctctataagtgttacagagggtctttttatgctggtgtgctgctggagttcacttaccacttcaagtggtttattttgtttattgttgagctgcatgatgctgagaagcatctctcagatatggttgtgtctaaggcgctggtggcaaagattgatagaccattgggaatagtctgtttccaaacagcaaaggatagcaatgacattcttaactcatgggcagcaaacttggagaaattacttgatcttgtggagaaaagttgtcatcagatacacaaggaaaccatggtccacaaagctgctttgaagggagttggggacacggaagggaagtctggtttatga

SEQ ID NO: 57553 - DNA, 619 bp, Glycine max
  Peptide Sequence Number=SeqID_149238
gagtttgggaattccggtgaagctgctccacgaggcttcggggcacgtggtgacggtggagctcaagagcggagaactctacagaggaagcatgatcgagtgcgaggacaactggaactgtcaactcgagagcatcacctacactgccaaggacttgaagttcggaaatgcaactttgaattgggttttaaggccaggaattagagataaggactatgcacaaatggaggttggggcatggatgtttggaatgaataacaatagatataaggatttagggcttagaccatttgtgtatgcaagatccattggaccttgggaggcaacatcttgtactatgtctgttccttggtctctgttacggactttacttggatttagggatggcaaaacatcgcaacttgagcatgtgtttattcgaggcagcaaagtcaggtttatggtcatccctgacatgctgaagaatgctcctatgtttaagcgtttggatgcaagaatcaagggtaagggtgcatcacttggtgttggtaggggcagagcagttgcaatgcgagcaaaggctcaagctgctgggcgtggagctgcgcctggaaggggtgtaccaccagtgcggaggtga

SEQ ID NO: 57554 - DNA, 9420 bp, Glycine max
  Peptide Sequence Number=SeqID_149239
atggatttttccttgggtagtgaggatccacctatacttaagctgcacaaatgggacctgtctgaggcccaaattgggctttcggactttcgcgaagcttttctttctcctacgagagagatactgcttttgcattcttatgagagggaagctcttttgcttcctctgagtaaaggagagttgcattctggtggtgctgaaggtggctatgattatgatgataatcacaatccaggttctgcaaatgtttcctcggaggcatccactaggcctagtgaatcagttttggtgaatgattcaccttgcacttcaggttcagatgttgatattgatactgatcttgtgggaattaaatgttcaaaatccaatagtctcccatacattagtgatgtgaactcattggcctgggctcgctgtgaggacggctatgatcagcacaaagatgctttatttagagaggttctatttgtttctgggagatgtggggtaacagtccatgcttttctcaaactaacaaaaaccaagggaatggttcaacccatgttggagggtaactttaggcaaggcaggtgggttgaatgggggcccgttgctgcattatcttccgacttcagtcatggagtctctggagaccagaatgtaaatttgactggagatggtggagttgaatcattaagaggttctgctactaagagatacttagaatcatttttcacaaaagttgaaactactgtatctgatggtattcttttgaccaaattccctgagaataatgaatttccttgcttgacagaagtggtttcttttagcatatttgatggcagtctatctttggaccatctcctcaaagaaaaaacagtccaaagtaaggagaattggcaggaaccagttgattcagcaagagatgcttctgaccgctctagcttgagcttttgtggagcagatactaagcttgattgtttttccagtgtttttggtgttgtgattaatgggttctacgaatgtcgcagagtgttctcgggtgcttcgaattgcctggtaggattttttttgacattaatgcatcacgtgtctgtcaatattagtgatgaagatcaaagaggcagaagcagagatttacttcttgttgccaagttagataattggggtattcggtgggtttcaatggtgaagcttgatgaaagaataaacacagttcagtcagttgagtggatggatttccaattttctgataatcttcttgtctgtcttaattcttctggcctgattgttctctactctgcaatgtctggtgaatatgtgacacatttaaatgttttacaggcttgtggccttaaccctcattttaatttgcaagggttagaaaagttatattcacatgataatatatatgctaaacaagagtgtagcataaatgataacatgtctgatcagcagagtgattcttttaggggatcattcaagaggttagttgttgcttcacactcctccctgttagctgtggttgatgaatgtggtgtgatctatgtgatctctttgggggaatacatacctgacaaaatttactcatctgagaagttacttccgtattgtcagcaatttgtgcagggaatgctggttggctgggaagttggtggttctgatatagatcgccaagcagtatactccaatttatctggacactttcgatcaaatgatttaaacataaaacatggaaatgttgctttgtcagacaaagctgtggcagtgaagttagaagtccatgatgacaacttcttagacagtgtatatgatgtataccactttgatggaaaagatgttattggagaagcaattggttgcacattccaaggttgtttttatattgtgagagatggtggtctatcggtatatattccctccatttcaattttatcaaattttcttcctgttgagtacattggttatcgccaatcaagtaaggatatggagatttcagttctacttaaagacaatctagaaataaaagaaccgatcaaaaggttttctccttggaaagttgaaattttggacagagttcttctgtatgaaggcactgaaatggcagatcaattgtttttgaaaaatggatgggacatcaaagtttctcgtattcgtcaattacaaatcgcattggactacttgaaattttatgaaatagaaaggggcaatatcaatgttattaaacctggaccagttatcaacttagttgacgatgtgggatctttggaaatgctcgtggatgttgatctagcagaagagggaattttgagattgctttttgctgctgtgtatcttatatttaataaaggtggcaatgatagtgaaactcctgctgcttcaaggcttcttgccctggccgcttgctttgcaacaaagatgctccataaatatgggttgctacaacataaaaaagatacatgcatagcagagggctttaacaagatgggattactttctcttccaccaattgaaccagttaaactacaaactgaggtggattttgctcagaaactttgtgagatagctcatttcttggagatcatccgaaatctgcaatgtagacataggtcaatatttcaaagggccagtcaaggattggctgacagaggagaagagtcatctttaataagtacagacatgttgcaggaagaatcccaactttcaattcttccatcagatttagagtcattggatgtgttgaaccaacatgagctttcttttcctcgaccaggcagcaacaataatgaaaatcttgcgctggtgcctgttgattctgagtctcatttggtctcagatgaatttggctacatatctcatttaaccccattaggaggaatcttaggaaagaaagttttgcctgtggaaaatccaagagagatgatggcacgttggaaggtagataatctggaccttaagactgtggttagagatgctttgctctctggccgtcttcctttggcagttctacatcttcatcaaatgaatgattttgttgctgataaagagcctcatgatacttttactgaagttcgtgacattggcagagctgttgcttatgaattatttttgaagggtgaaactgaacttgctgttgctacacttcaaagacttggagagaacgttgaatcttatcttaaacaacttctgtttggcactgtaaggagatccttgcgaatccagattgctgaggaaatgaaaagatatggttatctaggaccatatgagtggaaaatattggatgatatgtcactgattgagagtctctatcctagcagtagcttctggaaatcatataatcaccgactgaaagaaatcagcattgcaccggactctgttttaccagtggaaaataaattaaggctcttgcataaccattcatttgatagtcatgtcattgaatgtggtgagattgatggaattgtctttgacgcatggattgatattagtgaaagttcctctgctctggaagttgatgaagatgatgctcatgttggatattgggctgctgctgctgtctggtttgatgcctgggaccaaagaactgttgatcgtatgatattgaatcaatctgttcattcggacaattctatattgtgggagtcacaacttgaatatcatgtttgtcgtaaccactggaaggaagtctttagactgctgaacttgatgcctgcatatgtcctatcggctggaagccttcaactcaatttggatcttgtagagcctgcctcatctttaggatgcaacatgaatatgaagtcttctaattatggaaatttcttgtgctcttttgaagaattggattctgtatgcatggaagttcccaatgtccaaatgtataggttttcacctgatatatgttctgggtggatgaggatgctcgtggaggaaaagcttgcaaaaagatttatattttttaaggaatactgggaagggacattggagatgatagctctcttagctcgttcaggtttcatatctggcagagataaggtctgcttggaggatgatcttactaagacgtcatctgtcagagatggagctgtacaagctttgcataaaatatttgtgcatcactgtgcacaaaataacttgccaaatcttttggacctttaccttgatcatcatagtttggtccttgacaatgattcactttatgcattacaggaaactgctgttgattgtgaatgggcaagatggctactcttatcgagagttaaggggtgtgaatatgaggcctcacttgccaatgctcgatcgataatgtcacgtaatttagttcctagaagtgacctcagtgttctggagttagatgaaataattcgaactgtcgatgacattgctgaaggagggggagaaatggcagccttggcaacactgatgcatgctgctgttccaattcaaagctgcttaaatagtggtggtgtaaataggcatagtaattcctctgcccagtgcacattggaaaaccttcggccaactttgcaaaagttccccacattgtggcgcacgctcattggagcatgtctaggacaagacacaatggccttgctggtccctaaagcaaaaactgactatcttaattggcgtgatgacatcttcttctctaccagtcatgatacttcacttctacaaatgcttccatgctggtttcctaagcctatacgcagattgatacagctttatgtccagggtcctcttggatgccaatcattttcagggttccctacaggggaaactttgctacacagagacattgatttattcataaatgctgatgtacatgctgagataaatgcaatctcctgggaggcaactgtccaaagacacattgaagaagaactatatggtcctttacttgaggaaaatggatttgggcttgagcatcttttgcatcgaggacgagcattggctgcttttaaccaaattcttggtcatagagttcaaaatctgaagtcagaagaggaatctagtacttcagctcatggacaaactaacattcaatcagatgttcagacacttctttcagcagtagaacaaagtgaagagactctactttcatctgttttgccagttgccattatgcattttgaggattccatgcttgttgcttcatgtgcttttcttttggagctttgtggtttatcagccaacaagatgcgcattgatattgctgtgctaaaacggatatctttgttctacaaatcgagtgaaaataatgaaaatctctggcaattatcacctaagggatctgtgtttcatgcaatatcccatgaaggtgatgtaacagaatctcttgctcgagctttagctgatgaatatttgcacaaggattctcctgcaactgctactgagactgtaagtaaacaagcttcacgagctcttatacttgtgttgcaccatttggaaaaggctagccttccacagttggttgatggaaaaacttatgggtcatggctattaagtggaaatggtgatggaaatgagttaagatctcaacgaaaggctgctagccagcactggactttggtaacaaatttttgtagattgcaccagcttccgttaagtaccaagtaccttgctgcattagctagagacaatgactggattgaatttttgtctgaagctcagattggaggatattcatttgatacagtagtccaagtggcatcaaaggagtttagtgatccgcgtctccgacttcatatgttaacagttttgagaggaatgcagtcaaagaaaaaggcaagcactgcattgttcttggatacactggagaaaggcagtgaaacaacctttcctgatgaaaacatgtgtgttccagttgaactcttccaaatattagctgagtgtgaaaagcaaaaatgtcctggagaggctctcttgaggaaagcaaaagagttgtcctggtcaatattggcaatggttgcttcatgtttccttgatgtctctccattgtcatgcctgacagtttggttggaaattactgcagcaagagaaacttcatccattaaggtgaatgatattgcctcccagattgcagacaatgttggagcagctgtaaatgctactaatgccctacctgtaggtgacagagtacttacatttcattacaataggcagagtcctaaacgtcgacggctaataactcttgtttcactagactcctctgcttctgcaatatctgacatctgtagctcttctataagtgaagaaatatttgattccaaaggtaaaactatggagaatgatagaaaaatagaacattttggatgcattaatgttccaagtgattcccatgaagggcctgcttctctctcaaagatggttgcagtgctttgtgaacaacaattgttcttgcccttgctaagggcatttgagatgttccttccatcatgccccttgctaccattcatccgtgctcttcaagcattttcgcaaatgcgcctctcagaagcttctgcacatttgggctccttttctgcacgaattaaggaagaacctttctacttacaggcaaatgtaggaagagaggcgcagattggggcatcatggattagttctactgcttcaacagctgctgatgctgtgctttcaacctgtgcatctccttatgaaaaaagatgcttactgcaacttcttgctgctactgactttggtgatggtggacatactgctgcacactatcgaagggtttattggaaaattaatctggcagagcctttacttcgtaaagataatgagttgcatttaggtgatgaaatttcagatgatgcttccctcttgtctgcactagagaataataggcactgggagcaagcaaggaactgggccaagcagttggagcccaatggtgcaccctggaaatctgctatgcatcatgttactgaatctcaggctgaatctatggtagctgaatggaaggagtttctttgggatgtgccagaagagagggttgctttatggagccactgccacacactattcatcagatattccttcccttctcttcaagctgggttattttttcttaaacatgctgaagctgttgagaaagatcttcctgcaagggagcttcatgaacttttattgctttctctgcaatggctgagtgggatgataagtctttccaaccttgtctgtccattgcaacttctacgtgaaattgaaaccaaagtatggctcctagccgttgagtctgagactcaggtgaagagtgaaggagatttcaattttaccttttctaccagggagagtggtatcaagaacgaccccagtattattgaccgaactgctagtataatagcaaagatggacaaccatataaatacaatgaggagtagaattgtagaaaaatacgagtccagggaaaataaccaaatcccccacaagaatcaagtgatggatgctggtctttcaactacttttggtgggaatacaaagacaaaaagaagggccaaaggatacatggcaccaagacgcccacctcttgaatcagcagataaaagtgctgatactgatgatggctctagtaccaatagtttaaaaaatgagtttcagttgcaagaggaaaacgtaaaagtggaaatgtctttttctaggtgggaagaaagggtcggagcagcagagctagaaagggctgtactttctttattggaatttggacaaattgctgccgccaagcaactacaatataaattctctcctggacaaataccatctgagtttagacttgttgatgcagccttgaagcttgctgctatttcaacacctcctagcaatgtatcagtgccaatgcttgatgaggaagtgcgttcagttatgcactcatatggtataatgaatgataagcactatgttgacccgctgcaggttttggagagtttggtgaccatttttattgaaggcaatgggcgtgggctatgtaagagaataatagcagttataaaagctgcaaacaccttgggcctctcattttctgaggcgttcaacaagcaaccaactgaactactacagctgctttcgcttaaagcacaagattcctttgaggaggccaactttctggttcggactcatccaatgccagcggcaagtattgctcaaatacttgcagaatcttttctaaagggtgtgttggctgcacatcgtggaggatatatggattcacagaaggaggaagggcctgctccattgctgtggagattttcagacttcttgaagtgggcagagctttgtccctctgaaccagaaattggacatgctttaatgcgtttggtgattactggacaagaaataccacatgcatgtgaggttgagcttcttattctgtcacaccacttctacaaatcatcttcttgccttgatggagttgatgttcttgtggcccttgctacaactagggttgatgcttatgtcttggagggtgattttccatgtttggctcgcctgataactggagttggaaatttttatgctctcaatttcatttttggcattcttatagaaaacggtcaattggatcttcttcttcagaagtattctgctgctgcagacacaaacactggcactgctgaggctgtcagaggatttcgaatggctgttcttacatccttgaagcatttcaaccctaatgaccttgatgcatttgccatggtctacaatcattttgatatgaaacatgagacggcagcccttttagagtcacgtgcagagcagtcatgtgagcagtggtttcgctgctacaacaaggaccagaatgaagacctgttggattccatgcgctacttcattgaagctgctgaagttcactcttcgatcgatgctggcaacaaaacacgtaaggattgtgctcaggcttcccttctgtctcttcaaatacgaatgccagacttccaatggctttatagatcagaaaccaatgctagacgagcgttagttgagcagtctcgatttcaagaagctctgattgtagctgaagcttataacctgaaccagccaagtgagtgggctttagtactctggaaccagatgcttaaacctgaagtaatggaggagtttgtggctgaatttgtggcagttttacctcttcagccttcaatgctgtttgatttagctagattctatagagctgaagttgctgccagaggggaccaatcccatttttctgtctggctcacagggggaggattgccagctgaatgggctaaatatttagggagatcattcaggtgcttactgaagcgaacaagggatttgaagttgcggacgcagttggctacagtggcaactggatttggggatgtcattgatgcatgtacagaagaaatggataaggtccctgacaatgcagcgccactagttctgaggaagggtcatgggggagcttacctccctttaatgtga

SEQ ID NO: 57555 - DNA, 2904 bp, Glycine max
  Peptide Sequence Number=SeqID_149240
atggcgtcagaacaaggcataggtccatgttcatcatcgttggcgacaagtctcgagaccagtctctactgtgtgcagattgtaaatcttcattacatgcttagcaaggcacagattaagtccaggccaactgtgttatggtgttacaaggacaagcttgaactaagcagtcacaagaaaaagcgtagcaagcagattaaaaaattggtgcagaggggtctctacgatccagagaaaggtgattcgtttgacttgtttctggcaggtgggggattcacttactgtttatacaaggaatcagaaaaagttcttggcaatacctttggcatgtgtgtgcttcaggattttgaggcattgacacctaatctcctagcaagaacaatagagacagtggagggaggagggctgattgttttgctgcttcggtctctatcctcgctgaccagtctgtgcaccatggtgatggatgtccatgatagatttcgaactgaatcccacaatgaggctgctgggcgctttaatgaacggttcttattatcacttgcttcttgcaaggcatgtgtggtaatggatgatgaactgaatatattaccaatttcatctcacataaggtctattaccccagttcctgttaaagaggactctgacgaactctcagaagcagaacaggacctgaagaaccttaaagaacaactaaatgaagatttccctgtagggccattgattaagaagtgttgcacattggaccagggaaaagctgttgtgacatttctggatgtaattttggacaagacacttcgtagtactgttgctttattggctgctcgtggtcgtgggaaatcagctgctcttggtttatcagttgctggagccatagctgttgggtattcaaatatctttgtgactgcacccagccctgagaatttgaaaaccttgtttgactttatatgcaagggttttgatgctcttaactacaaggaacatattgattatgatgtggtgaaaagtgcgaatcccgagttcaagaaaggtactgtaaggatcaatatttacaagcaccacagacagacaattcagtatatactgccacatgagcatgaaaagctttcacaagttgaactgttggttgttgatgaagcagctgctattccactgccagtggtgaagtctttgctgggtccatatctggtcttcctgtcttctactgttaatggttatgaaggtactggacgctctttatcactaaaacttgtgcagcagttggaagagcaaagccatgtgtctactaagagcacaaaggacactggtcgcctgtttaagaaaatagaattgagtgaatccatcagatatgcttctggggatcccattgaaagctggcttaactctctactttgcttagatgcttcaaacaccatccctaatattagcaggttacctccacctagcgagtgcgatttatactatgttaatcgggatacgctcttctcctatcacagagatagtgaattatttttgcagcgaatgatggccttatatgttgcatctcattacaagaattctccaaatgatttgcaactgatggcggatgctccagcacaccacttatttgtactacttggacctgttgatgaatcaaagaatcaacttcctgatattttgtgtgtcatccaggtttcccttgaggggcagatttctcgtaagtcagcaatccaaagtttgaccgatggtcatcaaccttttggagatcaaattccatggaaattctgcgagcaattccgagatacagttttcccctcgctttcaggtgctcgtattgtacgcatagcgacacacccaagtgccatgaggcttggatatggttcacaagcagttgaacttttaatacgctactatgaaggacaacttattcctatttccgagattgatgttgaagataaagtgcaggctccacgagttagagtcacagaagctgcaaagcaaaatgctgtgactggtgagcatacatgcatgatcctgaaacccctaaacaatgatgaaattgaagctgatggatcaaatcaactgggcttttttagtccattttaccaagattttagacaaagatttgctaaacttcttgcttccacttttcgtgtcatggaatacaagcttgctttgagcataatagatcccaaaatcaatttcaagaaccaagaccctacggaggccacatctgataaatgtctgcagtcagtcaaagattatttatcaccacatgatatgaagcgattagaggcgtatgttgacaacctggctgactttcatctgttaggagagagaggagtattaatgacaaagattttagatttggttccaacccttacacatctgtacttccaagaaaagctcccagttacgttgtcgtatgctcaagcttctgtgttactctgcattggtctgcagaatcagaacatttcatacattgagggacaaacgaatttggaaaggcaaacgatattgtctctatttataaaggttatgaagaagttctacaaatatctagatggccttgcatccaaggagattgaatcaaccttgccaagactgaaagaaattgtcatggaacctcatagtgtctctttggacgaagatctcaataatgcagctaaacaagttgaggatgacatgaaatcaaaagcagaagcaacctttactcccgaattgctccagcagtttgccattgaaggagaatctggctttgagactgttttacaaaataatggtggaaaaatacccataggtggtcttattagcgtgaaatccagcaaagtgaagcatgaaaaggagaagggaagtcataagagtgacaaaaagcggagtaaagataaccacaaccataaatcaagcaaaaggaaaagatcttga

SEQ ID NO: 57556 - DNA, 153 bp, Glycine max
  Peptide Sequence Number=SeqID_149241
atgggtgtgaagcaaaaccatgtgacaccactgttgcagtggctcccaggggcacgtgatgggaccctgcacatgtggaacttcgttttggaagggatggaaaaagagaaaaaagaagacaaagggagaaaggagaggaagggaatattgtag

SEQ ID NO: 57557 - DNA, 607 bp, Glycine max
  Peptide Sequence Number=SeqID_149242
atggtaacccattattgtggtgtgactccatgcatcaaccgtttctcaacccttttcacgtggaactccaacttcagacaccttgtcaatcagggccatgcccaaaacgcccttattctcttccgccagatgaagcaaagtggcatcacacccaacaactcaacctttcccttcgtcttaaaagcatgtgccaaactttcccatctcaggaactctcaaatcatccatgcccacgtcctcaaatcatgctttcagtccaacattttcgtgcaaaccgcaacggttgatatgtatgtcaagtgtggtcggttggaggatgcacacaacgtgtttgttgaaatgcccgtcagggacattgcttcttggaatgcaatgctgttgggatttgctcagtctggcttccttgataggctgtcttgtcttctacgtcacatgaggctttctggaattcgtcccgacgcagtcactgtcttgctactcattgattcgattttgcgtgtgaaaagtctgacatctttgggtgcagtttattcctttgggattcggattggtgtacatatggatgtttctgtggctaacactttgattgctgcatattccaagtgtg

SEQ ID NO: 57558 - DNA, 276 bp, Glycine max
  Peptide Sequence Number=SeqID_149243
atgacgagtacaataattgcaatgtatgggtcagacacaggtatgaagaggaaggtggaggaatcagacttgggcaagttggagtatttggagatggttgtaaaggaaagcatgaggctccatccaggggcacacttgctaataccacaccagtccgcggaagattgcatggttggagattttttcatacctaaaaagtcaaggctcatagtgaatgcatgggcagtaatgagagacccaagtgcatggagtgaggcagacaagttctggccatag

SEQ ID NO: 57559 - DNA, 267 bp, Glycine max
  Peptide Sequence Number=SeqID_149244
atggatgaagtcatgaaggaaaagaaaggacagaagggaccaataaggatgtctgacattgctatgctggtggctgaggagtacgagaggagggtcaagagtttaagaaagtccggtggtggaactggagccggggaatttgacatggtttcttgtgtttcggtgatagtgtcgaggctcaaggaaaagaaacaacttctgcaatgggttttggagcccaagactcaagtcgctatggctgcttccaacagcttcttctctgcttaa

SEQ ID NO: 57560 - DNA, 2253 bp, Glycine max
  Peptide Sequence Number=SeqID_149245
atgggtgctacgaactcaagagcggaaaagaatgaagctctaagtttgtgcaaggaaagaaagaggttcgtcaaggtggctattgactcaagatatgctttagcagctgcacatgtttcctacattcaatctcttcgaaacgttggcattgctctccggaggtatgctgagtctgaggtagaggtagagtcatctctgtctatatctgacaaaactccttctcaaactagttacccttctccatcatcaccttctcatgttgctgaggttgaggttttggagtcacctttgcacaatgagagtcctctttcgccacctgtggccaccactcttagttacatgaggtcaggtggtagtgctgctgtcactgttaggatcaatgcctttggtaacaactatttggatgatgagtccactgtggttccaatgcctccacctcctcctgagtcaggtgcatcttgggatttctttgaccctggggaggacagtgagagctttaggtttgcagtgcattgtagtgagtccagagacttcagggatgaagaaaagggtgatcaatggttacatgttggttctgatgggcattgcatggtgcaaccactcctggatgacaagtttggtggaaacttgagcaatgctggaatgggaaatgagtgtggcaactcttatgcacactgcaatgatcattctactgtttcaagaggagttgaaggtggaaatggaattgttgatggagaattgcgagagctggagttgccaagtgctgcaggtggtttgagccgggctgtcgcagacaaagatgctggtggaaggtccagtgcaaagagggagaagaatatgccaggaaaaaatgtgtgcacagaaagagaggatccttcagagttcataacacacagagctaaagattttctctccagcataaaggatatagagcataggttcgttcgagcttctgagtctggtagggaggtcttgaggttgttagaggcaaacaaaataaaggttggatattcggaggcaaaagggaagtcatctaccacggcgttgttgtctgccgtccagcctgtttgttgcggtagaaaggcttcacctgttttccaggagcctgcccaaaaaattattagttggaaaaggacagcatcttctcgatcatcctcatccaggaatgctttggctacaaaaacaaaggaagatattgatgatagtggaagtgactttgttgaagaattctgtatgattgctggaagccattcatccactcttgacagactatatgcctgggagcgaaaactatatgatgaagtaaaggctagtgaatccataaggaaggactatgaccgaaaatgtcaccagcttaggcatcaatttgctaaagatcaaggcactcatgtgattgacaagacccggtcagttgtgaaggatctgcattcacgcttaacagtggctatatattctgttgattcaatatcgaaacgaattgagagaatgagggatgaagagttgttgccacaacttttggagttaacagaagggcaattgagtgttaaagctttaactactaattacttaggaaactactggttgtgcagattgatcaggatgtggaaggctatgcttgaatgtcatcatgcacaatacatcaccatctctttggcatatcattcaaggagcacaccaggaaccttgcaaggatatgcacgcagagacataatgactcagctgctagaagaagttgagttctttggtctgagttttgctaactggattaacagcctcacctcatatgtggaagctgtcaatgcgtggctgcaaaactgtatactgcaaccaagggagcgtaccaagagcagaagaccgttctctcctcgccgagttctggccccacctatttttgttctttgccgtgactggtctgctgggatcaaggttttaccctctgaggaactaagtcagacaatcagaaactttttgtctgatcttcacttgcggacagagcagcataatgaccaacttctcaagaaacagaattctgtcaatgcaagtactactgaaaccgagagcaaacctaacgaagagaatgaagacgagtccacgaatttgagctgcatacatgcaagattaacaaaggttcttgatcggctgaccaaattttctgaggcatcattgaagatgtatgaagatatccggcaaaaaagtgaatcagctcgaaatgcataccataattgcagaactatcagggccgaaaaattttaa

SEQ ID NO: 57561 - DNA, 1185 bp, Glycine max
  Peptide Sequence Number=SeqID_149246
atgaaagttggtggtgaaattgagaggaaaacgcaagggagtatggtatgtggcggggacctgaaggatatcggggtaggggtgtgggaccaagcgtgggtcccagcagggtttataacaatgaaaatgacgcagaatgcaatagtgtccaagacaaaatccgggatcaagggggacatagccgtggcacagaagccactggcggcgcctccgccgccggggtacattcccattccgaggaggagggttttgaagaacctcgaaatcaatggaggacaaagaattaatgcatgggttgattccatgagagcctcttctccaaccaattccaaatccacctcttctctcgcagaagaacacagctcttggattcttcgccacccttcagcattagacatgtttgagcaaattatggatgcgtccaggggaaagcaaattgtcatgttcctcgactatgatggtactttgtcgcctattgttgatgacccagaccatgctttcatgtcggattcgatgaggagaacggtgaggaaacttgcaaggtgttttcctactgctatagttaccggcagatgcaaagacaaggtttacagttttgttcgcttggctgagctatattatgctggaagccatggcatggatattcaagggccaacaagagactgcaaatacagcaaagacaaaggagagccagttctttttcaacctgccagtgaatttcttcccatgattgatgaggtgcaccatcaattagttgagaaaatgaaatcaattcctggagccaaggtggagaacaataagttctgctgttctgttcattttcgctgcgttgatgaaaagaaatggagtgaactggcacaagaagtgagatcagtattaaaagagtacccgaagcttcgtcttaaccaaggaaggaaggtattggagattcgtccatctattaaatgggacaaaggaaaggcgctggaatttttgttagagtcactcggatttgccaactgtaacgatgtctttcctgtttacattggagatgataaaaccgatgaagatgcattcaagaaattaagagacagaggacaaggttctgggattcttgtctcgaaatttccaaaggacactagtgcatcatactctttacaagaaccaaacgaggcaagtgatggatttccttcaacgtttggttga

SEQ ID NO: 57562 - DNA, 717 bp, Glycine max
  Peptide Sequence Number=SeqID_149247
atgggtgcgacggaggccaacacgacacttcaagctcgtcccgaaacgacgtcggagaatatcgaagcattgcttgatgctgcaagatacgatgacatggatgatgttaagagcttagaagccagtggtgttcctcttgattccaaggatgaacaagggaggacagctcttcatatggctgcagctaatggacatattgatattgtggagtatttaatcagtagaggggtggatcttaattcaccaaatgaggaaaagaatacacctcttcattgggcatgtctcaatgggcatgtggaggctgtgaagaaattaatcatggctggagctaatgttagtgtcttaaacagtcacgagaggactccaatggatgaagcagtgagtgggggaaagccagaagtgatggatgcgattaatgaagcagtggcactagttgaacttcgtggtgctatgttcgaacaagatcatgagtgttttggtatcctcctccctcccaagtttccattatggaattcctcttcggaaaatggaattgaaggagttggaatgaaagaaggtgcattagaagatgtcaggtcacttcctacgtttaggtttagtcagtcaaattcactggtgatggttgatgacaacaagaagcaacttgttaaaggaagaatagattcaggcaatggaagtcatatgattgaacttctctccaaccagatgattctatga

SEQ ID NO: 57563 - DNA, 459 bp, Glycine max
  Peptide Sequence Number=SeqID_149248
atgtgtgatagtgatgataataataatgttgatgatttcaacaacaataatagaaatattagtggtggtaatgtagatgtcattggtagtggtggcaatgacaatgtggtggtgatagtggtgttgatggtagctataatattcctaatttttgaattctcgatgactctcacattacaacacttcctgcgatcgtacttcactttacgtgatagtatttcactcaatattcctgttgccaatggtgatgacattggtggtggcggtggtgacaacgacatcgatggtagtgacaaacgtgatattagtggtggtggtggtgctagcaatgttggtggtgttggtggtagtattgatgagaatgagggtggtggaagtagtgttggtagtggtggttacggcgatgctaattgtggttgtggtggcgatgatggagatagtattgttggtagtggttga

SEQ ID NO: 57564 - DNA, 1647 bp, Glycine max
  Peptide Sequence Number=SeqID_149249
atgggaaacaacttcccacagggaaaatgtggctgtggtggcttaatattctggcgtcctcctcccaacaacaacaataacaacagcaatgccaacaaatttgagaatttatcaaacgcctctgacacaaaaaaaggtcaaggtggctgtgaagatataactttctcaggaacagcttcatctaataaacccacaaattcttcaactcgttctggcaccaagccaaaccatgttgttaaccaaaactaccaaaggaaccatcccaaagtgtcacctaccgagggctatgtcagcaatggaagaagggtccctaaagaagcaattggcatttctggtgaactggaaagcatgatcaccgatcgccaaaaggggagcagcaaccttgttcgtgcttcttctagcaacgttatgatgtttaataatttaggtaacctcaggcaaggagggaatacaaatacgtattctcagaaccctgttgccaatggaagatacacaaaccaaacggtggagaatgtaagtaaaggaaacaaggaacaaccgggttctctatgcagggtcgtgtctactagaatgaaccccgaacaattaaagataatgggcaatgaggattataagaatggaagatttcaagaagcattggctctttatgatgctgcaattgcaattgaccctaataaagcttcctataggagcaacaaaagtgcagcattaacggctcttgggaggcttctggaggctgtgtttgagtgcagagaagccattcaaattgagcctcgttatcaaagagctcattaccgattgggaaacttgaacatgagattaggagaaatggataaggctctttatcattataaacaagcaggaccagagattgacccagacgagaatgctaaagtcaaaaaaattcaggtccatttgaacaaatgcaccgaggcacgtaggctaggagattggaacaagttgattaaggagaccaataatgctatttcatctggtgcagattctgctccacagatatttgcgttgcaagccgaggcatttttgaagctccgtaggcaccaacatgcagaagaagcaatgtcaaaggggtctaattttgatgttgatcattgcaccaagttctttggacctatttgccatgcaaatacattggtgactcagtcccgggttcatttggctgctggcagatttgaagatgccctagttgcaattcagagagcatctaggcttgatccaaataataatgagatgaagaaggtgatgaggaaggctagagctgcggctgcagctcgatcaaacggaaacgagcttttcatggcatcaaaattctctgaagcatctgttgcctatggagaagggttagagcatgatccatataactcggttttgctatgcaaccgagctgcatgtagatccaaattaggccaatttgagaaggctgtggaagattgcaatgcttctcttagcttgcgtccatcttacagcaaggctaggctgagaagagcagattgtaatgccaagttgaaaagatgggaagcttcaatacaagactatgaaatattgcttaaagagacaccggaggatgaagaattaacaagggctttgttggaggccaaagagcatcttatacaacagcgaggtgaatga

SEQ ID NO: 57565 - DNA, 753 bp, Glycine max
  Peptide Sequence Number=SeqID_149250
atggaggggcacgccgaccacaactccgccgtgttgccgccacctcctggccgccacgccccagccgcaggcacgtacatcgtgcagttcccgaaggaccaagtgtaccgcgttccaccacgcgagaacgcgttgatcgtggaacagtaccgcaacccggccaccgcgaaaaaaagacgcggcggttgttgttgctgttgcaaccgtcgtgtcttgataaccttcgctctcgtggttaccacaatcgttgccgtggttggcatcacgttggccacgttgtactttattttcagccccgcgggtcccaagtttactgtctcccatgtggcggtgaataggaacaacaagaactcgcagggggcggcggcgcagtatgaggtttcgttgagagcgaggaatccgaacgagaagttggcgattcagtaccaggaaggggacgtgtcgctgttgttgttcgatgagagtaaggttgccgaggggaagtttccaacgttggagcaagggggaggtgaggcgagtgaggttaagcttgagctgaccggatccagtggagcgtttcccaggggaatgcatggtggggacgcagccgtggatttgaaattggagatcaaacttgcgataaggattaggaccgcgggtctcgaaacgtggggtatgagctccaatgtggcgtgtcagtttaaggatcatgggatgggattgggatatgtgtcttattgttgtagcatggcaaacactgcacttaaaccatga

SEQ ID NO: 57566 - DNA, 891 bp, Glycine max
  Peptide Sequence Number=SeqID_149251
atggctctgtgctatttcagggtgcttcttcaaataagttcccagaagaaaaaaactggtgtcattgctcccaaacgatttgtacagaggttgaaaaaacagaatgaactcttccgtagctatatgcaccaggatgcccacgagttcttgaactttttgctgaatgaacttgttgacattctggagaaagaggctcaggctgcaaaaactgatcaggagacatctccaccttctgaaaaggctgttaacgggcccaagaatggtcaagctaatggtgttcacaaagagcctttagttacttggggaatactcaccaatgagacaaggtgcttgcaatgtgagacagtgacagctagagatgaaacatttttggacttgagtcttgatattgagcaaaacagttcaattacaagctgtttgaaaaatttcagttccactgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatatcgagtattctctatttgcagtagttgttcatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttattctatgagagcattggctctggtaacaggagttag

SEQ ID NO: 57567 - DNA, 780 bp, Glycine max
  Peptide Sequence Number=SeqID_149252
atggggaattcatcctcagctgttactaagatccagtatcacgggcaaggttgcatcatccagccacaaaatggtagtagaaaagaaactggggaatgctttcagtcctatctgtctttgagtattgctagatttagagggagaggaagaaagagaaaggtaagttttatggctgcaacaagttcaagctttttttctcaagattccacactactcaatgtgggtgcaccccaaacttttaatcatcgcaagggatcaaggttaattgttagagcaaatgctgattattattctgtccttggggtttcaagaaatgctagtaaatctgaaattaagagtgcaatatcaaagctctttacttttgatatttcagcatatcggaagcttgcccggaattatcatccagatgtcaacaaagaacctggtgctgaacaaaaatttaaggaaattagcaatgcctatgaggtgttatcagatgatgagaaacgatccatatatgacaggtttggagaggctgggcttaaaggttctgcaatggggatgggggatttcagcaatccatttgatctgtttgaatcactgtttgagggcatgaatcgtggcgcaggttccagaggttcttggaatggagcaattgatggggctaaaccagggactacaccatccagatgtagcacttgtggaggtcaaggccgggttgtctcatcaatgagaactccattagccatcttccagcggtcaatgacatgctctgcatgcaatgggactggagaaatttga

SEQ ID NO: 57568 - DNA, 2649 bp, Glycine max
  Peptide Sequence Number=SeqID_149253
atgcgttattgtgccacatttgatactcatcgagcttctcttccttatgtggctcgttttcatgcaaagagggtattgaaatttcaagatgcactgttgacaagctatcatcgaaatgagatcaagtttgctgagcttacattggacatctatagaatgatacaatgtttagaatgggagcctagtgaaacattctaccaaaagcatacagttaaacctaaggagaatggtgacataattgatcattcaggagcttctgggataatagacatgaatcttactgcagatatgactgatccaactatacctcctaatcctagaaaggctaccctgtaccgtccatctgtgacacatgtgatagcagtgagttttcaagcctattggaaagttttggctacaatttgtgaggagctgccaccagactgtgttgtgctagtatatctttcagcctcagggaaggctggtcttaataatgtctctcaggtggaaaattctggcggttcatccaaatattcaagacacaaagtcctttctcagacttccctaggacagaattctggaccttctgaaactcaaagtaatggcaagagagaactgagctattatgacaattatctgtggtttggtcccaagggaaatagtggtttaaataatctctaccctggcgatcttatcccctttactaggaaacctcttttcttaattattgacagtgataacagccatgcattcaaggcagcattttgccaaatgattggtctcacccccaatgaggctgatacagatgtctacaatgaagcagagaacattatcgctaatgctttcacggagtgggaaataattctttgctcatcaactaccatggatttagtatgggcgcaggttataagtgatccatttctaaggcggcttattctaagtgtaacttgcacacactccatgctcactagcctagtcccaaccttttggcgccaacgccactccttcttcgtgctcgcgacccttttctcctccactcgggatgtgtaccacgcgaacctcgacatcgtcgccctctcacgcgccgggaaagtcgacgccgcacgcaaactgttcgacgaaatggcaacaaaagacgtcgtcacgtggaactccatgctctccgcctactggcaaaacggccttctccaacgctccaaagcactcttccactccatgccgcttcgcaacgtcgtttcctggaactccatcatcgccgcctgcgtccaaaacgacaacctccaggacgcgttccgctacctcgccgcagcgccagagaagaacgccgcgtcgtacaacgccatcatctcagggctcgcgaggtgcggccgcatgaaggacgcgcagaggctcttcgaagcgatgccgtgtccgaacgtcgtgtcatacaccgcgatggtggatgggtacgcgagggtggagggagggattgggcgcgcgagggcgctgttcgaagctatgcctcgaaggaactcggtgtcatgggttgtgatgataaatggtttggtggagaatgggttgtgcgaggaagcgtgggaagtgtttgtgagaatgccgcagaagaatgatgttgcgaggaccgctatgattactgggttttgtaaagaagggaggatggaagatgcgagggatttgtttcaagagattcggtgcagagatctcgtttcttggaatataattatgacgggttatgcacaaaatgggagaggggaagaggcactgaatttgttttcacaaatgatcaggactggtatgcaaccagatgacttgacttttgtttcagttttcattgcctgtgcaagtcttgcatcactcgaagaaggaagcaaggcgcatgctcttttaattaagcatggctttgattcagatttgtcagtatgtaatgccctgattactgtgcacagcaaatgtggtggaattgttgattctgagttagtttttggacaaatttcccatccggaccttgtttcatggaacactatcattgctgcatttgcacagcatggtctgtatgacaaagcacgctcctactttgaccagatggtgacagtcagtgttcaacctgatggcataacttttctgagtttactatctgcgtgttgtcgtgctgggaaggttaatgagagcatgaatctatttagtttgatggttgataattatggtattccaccaaggtctgagcactatgcttgcttagttgacgtgatgagtcgagcaggtcagttgcagagagcttgcaaaataatcaatgagatgccattcaaggcagattccagcatctggggtgctgtgcttgcagcctgtagtgttcatttaaacgtggaattaggggaactggcagctagaagaattttgaatttggatccttttaattctggtgcctatgttatgctgtctaatatatatgctgctgctggcaaatggaaggatgtccatagaatcagggttctgatgaaagagcaaggagttaagaaacaaacagcttatagttggttgcagattggaaacaaaacccattatttcgttggaggggatccatcacatcctaatattaatgatattcatgttgctttaaggagaataacattacatatgaaggtaaaaggtaactatgaagaaattttcttttaa

SEQ ID NO: 57569 - DNA, 2097 bp, Glycine max
  Peptide Sequence Number=SeqID_149254
atgtctccagagcaattcttggagtttgcttggggtttggccaatagcaagaaaccctttctgtggatcattaggcctgaccttgtctttggtggctctgagattttgtcatctgagtttgtgaatgaaacttcaaatagaggcctaatagcaagagactttagcagaaaagtgagtgatcggcactgggaggatccatcgagagagatgtgggtgttttacctgatctctttgcccctcacagtgggtatggtactattcacgctcagatactacgctgccccacacgtccctcgctacgtgcttctcaccgttggatacacctggctctcttccctctccatcatcatcctcgtccccgccgacatttggacggatttggaatttgagtttgatgctctgttacatctagtgaattactatactgtatgctacaacggggttgggtctagcaaaacgggctggtcccccgatctccagcgagcagtggaatttgcaaacctgcacaaacactccgatgcacaagtcagtaattgtaggagggctgttgtgccccttattcagggttttgaagatgctggggacttcactgtttcagaaagattgaagactagtttacatgttaacttgatcttttatctaattgtgggatccattggcctttttggattcattcttctcattatgatgcataagcgctggagtggaagtcttttgggattagccatggcctgctcaaatacttttggacttgttactggtgcatttcttcttggctttggtttaagcgaaattcccaaaagcatttggagaaatgctgactggacaacccgccagaaagttctttcccacaaaattgctaaaatggctgttaggcttgatgatgctcaccaagaactttcaaatgctattgtggttgctcaagacacatctaaccagatgtccaggcgtgatcctctgagatgttacatggatgtaattgatgatatgctaactcaaatgtttagggaagatccatccttcaaaccacaaggtggccgactaggagaaagcgacattgattatgatactgacgagaagtcaatggcaacactaagacgtcatcttcgaggagctactgaggagtactacagaaagcaagttcagaaaggcttggctgttatacttggtgtcatgtctgttacaattcttttagctgaggcaactcttctacctagtgttgatctatcacttttctcgattcttataaaatctgttggaacacaggaggtgcttgtgcagcgaatggggaacattgataatgctgtccctttctttggagataagtttaacagaatctatccacttattatggttatatacacccttttggttgcaagcaatttctttgatagggtatttgattctcttgggagctggaagagatatgttttcgaaactgaaactgaagatatggatggttttgatccatcagggttaattatcttgcagaaagaaagatattggcttgagcaaggaggcaatgtaggcgagcaagttgttccactagtgaggaattttaatggaattgatgttgaatctagtgacaatattatgttcaaacagttcactcactttatagctgatatggttcaggtgaagaatggtgttgaaatgaagggaaattctgctttagttaataaagaaacagatggaaatctgcctaaaactttgaaggaagagacaaggagatatagctcaagcagggaagccatcagcagcaagtatgctgctgtcagacagcagagtgaattaacatctgcgaaggtttccttgcttgatcacggcaatgctcattctagtaatgctgctggaacttcaggcttggcttcgacatggcaaacaatgacaacaggttttcggagttttggggctaacttagggggaaaaggatttttgcccatacggcaaacacaggaagctaagatgtctcgtgtgtcctcatctgagtcccttgatgatatatttcaaagactgaaacggcctgcattggaccaaaatattgacaatgacaaggataatttgaagaggggcaatatttctggtccttctagatga

SEQ ID NO: 57570 - DNA, 369 bp, Glycine max
  Peptide Sequence Number=SeqID_149255
atggcggtggggtgcatcagcttcactgccatgctcggcgacggcaccatcatgcactgctcctcgcaatacggcagtggaacaacttcctctcgcccctcatgcgccacttcaacgtccagattgcgctcatatgtaggttcatatgtgaatgattatggattaggggaggaaggcatgaattcagtggtgacttttgggggtgctctggataagggcatgaattcaatggtgaattttgggggtgttctggatgaagacatgaatttagtggtggattttgggggtactctggatgatggcatgaatggaatggtgcactggagtggtgagaaccaccactcgaagcagcaggagcaagacaagtga

SEQ ID NO: 57571 - DNA, 252 bp, Glycine max
  Peptide Sequence Number=SeqID_149256
atggttttctcaattgctatgaggatacagccattttcgaaagaggataataagactggactgggtctcagcctaagggacgaagttggagtttttgtggcagcggagacagcttggattacacctgttttgcagcctagagaaggggaagcactagctcagttgtgtgcaaagataactacaacgacaaccgttatagttctaaagacgaagatagatagtcaggatcacaatgataatgataataattga

SEQ ID NO: 57572 - DNA, 1605 bp, Glycine max
  Peptide Sequence Number=SeqID_149257
atggccagtggcgtgactacagtggactgcgagaaacaggtgagatcatggaggctgctacgttctctcatgcaactactaatccccacatgcaactgcgccaccattatagaagacgaccaagatctaacaacaacaacaaacgagaccctccgaaacacaagaagcaaatattataattattatacaccatcgtcatcatcactgatgagctccaccaccaatatcacaggcacgatcttcggataccgcagaggaaaggtgagcttctgcattcaggcaaacgccaactccaacaacccaattctcctcctggagttggcagttccaacagccatcttggccaaggaaatgagaggagcaaccctcagaatcgccctagagagcggtcgtggtgatggtgacgacgacggcaaagcagacacacttttgtcgacgcctttgtggaccatgtactgcaatgggaggaaagtgcggtatgccgttaagcggaggccctccaacactgatttcgaggcgctgaggttgatgggttcggtagttgtcggaaccggggttatgaagtgcaaggagttggtgagttggaagaaattagaagaagatgatcaactaatgtaccttagagcgagctttaagagggttcgtggctcagacaactctgtatggtcaaccagaccagagctagaatacaacatccctcctagttgtgtaggacatggacaaagcatcgcagagcaaggcggcgctactctccaaacgcaccacgctcttccttctacgcgccacgagccacgattcctccacgccccccacgcgcaagcacctagccacgctcctctcctctggcgacggctcacgcgctaccgcctcggccgctgtggaggtcctgatggaccgccttcaggggaccaacaacgccgccgtggccctgaagtgcctgatcgccgtccaccacatcatccaccacggcagcttcatcctccaggaccagctctccgtgtacccctccgcaggcggcagaaactacctcaacctctccaacttccgacacaacgccgaccccacatcatgggaactctcgtcctgggtccgatggttcgcgaagcacatcgagcagctcctgtgcacttccaggatcctgggattcttcctcggaaccccgaccgacagagaagacagggtgtcgggtctgggatttgcaagaggcccgagcccaacaacgtctacgggaacaacgggttagtggaggagattgtgaagctggcgcgtgaggattggggtgtcgtggaagttgaggtgcgcgtgagggtgagtgagtttaaggagaggttgggagggtttaagttcggggaagtggtggagttggtttgttgtttgaagaggttggagcagtgccaagagatgatggatggagcaagagaacttggattgtgggattttgttggagaggttaaggataaagcagggattcaggtttatagacaagagggtaagttgcgaaaggaaagtagaaaattaaggtttagtgaatcggatcggttttctgctccggttctcaattctcgtgattttctccactttccctccgggaggttcttgttgtaa

SEQ ID NO: 57573 - DNA, 858 bp, Glycine max
  Peptide Sequence Number=SeqID_149258
atggggtttgctggtaatgttgagccgtgttttattgctccgacagttgttgctgttaatgagtcgtttctgaatcaatcgaggggctcttctaaaggcagttgggtggcccagcacaatgctggggttatggcagatcttgatttcttcatcggggatgaggcactttccaagtctcggtctagcagcacttacaatctcagctacccgattcggcatggccaggttgagaattgggatgccatggagcgcttctggcagcagtgcattttcaattatttgaggtgtgatccggaggatcactatttcctcttgaccgagagcccattgaccgcgcccgagagtcgcgagtatactggggagatcatgtttgagacttttaatgtgcctggactttacattgctgtcaattccgtgcttgctcttgcagctggatacacgacgtccaagatgacaggagttgtagtggatgttggagatggagctactcacgttgtgcctgttgcagacggctatgttattgggagtagcatcaaatcgattcctattgccggaaaagatattactctttttgttcagcagcttatgcgggaaagaggagaaaatgtaccaccggaagactcttttgaagtggctcggaaagtgaaggaaatgtattgctacacctgctctgacattgtgaaggttgtctttatttcaatactcagtactttgacagcattatttgaggagtttgtggaatttaataagcatgacaaagaaccaggcaagtacatcaagcattggagaggtattaaaccaaagacgggggcaccatattcatgtgatattggctatgagcgatttcttggccctgag

SEQ ID NO: 57574 - DNA, 1965 bp, Glycine max
  Peptide Sequence Number=SeqID_149259
atgttaggagaagagagtaacaacaacaacgaccgcgccggcggtcaccggagaacaacacattcccggtcagtttcctggaccgaccggtctccggttacccggaaaccgccgcgtccgcttcagcctctcgccatccacaaacgcagcgttttggagtggcccagcgccggctgcgacgatctcggtgattggtctcttccaccgacccctagagggtccaccaaaacaccagattcgggttcgggtcaagttttccagttcaagaaagactattacgcgttctacgacaaggaatgttcgagaatcgcggagcacgtgtacctggggagtgacacggtggcgaagagcgtcgagcttctgcggcggcacgggatcacgcacgtgctcaattgcgtcgggttcgtgtgccccgagtatttcaaaaccgacttcgtctacaagaccctctggctgcgtgactcaccctcggaggacatcaccagcattctctacgacgtcttcgattacttcgaggatgtccggaaccagggtgggcgcgtgttcgtccactgctgccagggcgtgtcgcgctctacctcgctcgtcatcgcgtatctcatgtggagggaaggccagagcttcgaggacgcctttcactatgtcaagatcgcgcgtggcgtaacgaaccccaacatgggcttcgcgtgccagctgttgcagtgtcagaagcgcgtgcacgccatgcccgcgagtcctagttctgttctcaggatgtataggatggctcctcattctccttatgaccctcttcatcttgtgcctaagttgattgatcatccttcctcacgcgctcttgactcgcgtggcgcatttgttgtgcatgtgcctaatgctatatacgtgtggattgggaaggagtgtgggtcggtgatgtgttgcaatgcaagatcagcggctgctcaggttgttcggtatgagagggcaacggagaagattgttagtgtgtttgaggatgaagagcctaaggagttttggattgctctttctaccaaggaagtggtggtggtggagaatggagaggtgaagaatgtggtggagagaattgagattgatgtggggattcgtcccaggagagttgaggagtatgatttggattttgggatttttcataaggcgcttgctggtggggttgttccacctttttctttgtctaatgctggatcggaaaattgccttcctgccagggaaaatgggtgggggagattgacaaggaagcttgctagtggtatcatgaaagggttgttcacatcctctaagtgctgtgagtctagtgtgaacatcattgaagagggaaatcaacataagaatgttgatcctcctttgccaccatcttctaacaatgtgggtggttcgtggagttcctttgagtgttttgtagataatggcttagagaggggaaaggatagtgttcaacaagtcagggatcagtttgttgttcctagcgttgggtcatcaatgccgccaccatcgcctcatagtcgagcagcatcggattcttttgcttgttttctaagtaacagctccaaattcagttccaaatctccaccactttcacccgccagttcggattatgcaagttcctttacattttcgccttcatcgactgatttgtcaatcgtgtcttctcggcagtcatcgccttccggtctggaatcagctgaacccaatcatgtgaaagatgcatcttcctcagagagtcgctctttagttcagaaagaaggtgaggcatttctggctaatcacaccttggtaggggcaaagtccagtttgccgcgcaaaggatcttccctctccattgcagagcgcagagggagtaacccgccacctcgcatgatgctacccttggccagtgaatcatcccgtgtcagcaaggtccgggtaagatccaggtctttctcattgcctgccttggatgatacttag

SEQ ID NO: 57575 - DNA, 2415 bp, Glycine max
  Peptide Sequence Number=SeqID_149260
atggcaatggtaggcgtgagcccaggggattattggagtgatggtaggaaacttcgtttgcaagggatgacgagtggcgacatggagacagacagagactcggagtcgatcatgggaggtaagagttcaaaagggtctgaaagaaggcatgtttcatcatatggatctgctggttcttcatcttcatgggatgactacgaataccctcaatcaccaaatgcatacccacaacaaaatccttatcatacgcctcttcaccaccgtgcaccggctccattccacgactattcacagccaaaaaggaaattggataggagatattcaagaatagctgatgattaccattccctggatgaggttaccactgctctttcacatgctggcctggaatcttccaatctcattgttggaattgattttacaaagagcaacgagtggacagggaagaggtcattcaaccgaaaaagtttacatcatataggaagtggtcagaatccttatgaacaagcaatctcgatcattgggaaaacattaagtgtttttgacgaggataacttgattccttgttttggatttggagatgcatcaacacatgatcaagatgtctttagtttccattcagatgagaggttctgcaatggatttgaggaagttttgtcaagatatagagatattgttcctcgcctgcgtctagcaggacccacttcatttgcccctattattgagatggccatgactatagttgagcaaagtggtggccaatatcatgtcctgctaataattgctgatggacaggtgaccagaagtgttgacacacaacatggccagctaagtccacaggaagagaagacaattggtgcaattgtaaaagccagcgggtatccactttcaatagttttggtaggggttggagatggaccgtgggatatgatgagggaatttgatgataacatcccagctcgagcatttgacaattttcagtttgtgaattttacggaaataatgtcaaagggtatagactcaagcagaaaagagacagagtttgcgctatcagctttgatggagataccttctcaatataaggcaaccatagatcttggcatattgggtagtgcacggagaggacattcaccagacagggttcctctacctccacctcattatgagagggcttctagcagcagcacaacatcttttcgatcaaacagttttcagcatagcacaccaacatatgataatgtaaacgcagaatcgtcttcaagaagctcatatgataataaggtttgcccgatttgtcttactaatgggaaggatatggcatttggttgcgggcatcaggcagtggtgaaaagtcttggggacaacgatgtgatggtgatattggacaaccacataacccagccagggtggtgctgtagtaactccgacggcaatggattcttcggtgacaaatttttcaacccagaccagtggatattgggcctcaccaagatggccacccttttcaatggtgtcactaatgtggtgggcatgaacttgaggaatgagctccgagggcccaaacagaatgtcaacgattggtacaagtacatggtgaaaggagcagaagcgattcatgcagcaaatccagatgttcttgtcattctatctggcctaaattatgacaaagacttgtctttcattcaaaaacggccagtgagcctcacatttaaggggaaattagtatatgaggcacactggtatgccttcactgatggtcaagcttgggttaatggtaatccaaaccaggtatgtggacaagtggcaggaaatatgatgagaacctcaggcttcttggtgaaccaaggatggccattgtttattagtgagtttggtggagacttgagaggtaccaacgtgaaccacaatcgctaccttaattgcttcttagcactggcagctgagcttgacttagattgggcactgtggacactcgttggtagctactactttagacaaggagttataggaatggaagagttttatgggattcttagttgggactggatccaagttagaaatactactttcttaaacagaatctctgccctccaacttccatttcgagcggggagtgaagggatgcctgcgacacttgggataatgtgctcagatcctaactctagatgggaaatgatctcagattcgaagttgcacctttcatcaaaactcagcgatgattctaatgtatgcctagatgtggatgacaacaataacatcgtgaccaatgcttgcaaatgcttaagcaaagatcgtacatgtgaccctagtagccaatggttcaaacctattgacagcggaagcaggtcaatgttgacaacctcaacgtcatccatgctatataaattcatcggaccttttatggaagccgtttag

SEQ ID NO: 57576 - DNA, 2559 bp, Glycine max
  Peptide Sequence Number=SeqID_149261
atggataataaagatgctcgtcatgttaaaacatatgaggttgcactgaaggataaagattttgttgaaggtccatggtcccagaacaatctcgataatggggctgatttattgataccagttcccccacctctttgtggtgtgcttattattggggaagaaaccatagtgtactgcagtgctaatgctttcaaggctatcccaatcagaccttcaattacaaaagcctatggaagagttgatcctgacggttctcgatatttacttggtgaccatacagggttggttagcctacttgtaataatccatgagaaagaaaaggttacgggactcaaaattgagccccttggggagacttccattgcatctacaatatcataccttgataatgcattcgtctacgttggttcaagttatggagattcacagctaataaaactaaatctacagcctgatgcaaaaggttcttatgtggaagtattggaaaggtatgtcaatttggggcctattgttgacttctgtgtggtagacctcgaaaggcagggccaaggtcaggttgtaacttgctctggagcttacaaggatggttctcttcgtgtcgttcgtaatggaatagggattaatgaacaggcatcggtagaacttcaaggtatcaaaggaatgtggtcactgagatcctcaacagatgatccttttgatacttttctggttgtgagttttataagtgaaacaagaatcttagcaatgaatcttgaggatgagctggaagaaactgagattgagggattctgttctcaagtgcagactttattttgccatgatgcagttcataatcaacttgttcaacttctttttcacctgccattagctaataaaccagcattacaggttacttcaagctctgtcagactggtcagctccacaactagagatcttcggaatgaatggcatgcaccatcaggctattcagtaaatgtagctacggcaaacgctacccaggttttgttggccacaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatgctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactga

SEQ ID NO: 57577 - DNA, 246 bp, Glycine max
  Peptide Sequence Number=SeqID_149262
atggaaggcttccaatccctgtccatagacccaatgggacaaacaatgctggaacattaccttctacatcaacataaggatgtattggcagttttctgttctgattatatcatcttatttcattacctgcagtcaatgccccaatctcaaagtcaaacggtagtggtagaaaatccaatgtctgttgattcaagtgggaaattggtgagcaatgttgttgttggcgttacaacggataagaaataa

SEQ ID NO: 57578 - DNA, 3162 bp, Glycine max
  Peptide Sequence Number=SeqID_149263
atgtggatggtttttatatgttatatgacttcttttgttttctggggtttggaaagattggaaatttctcaccctggtggtggactggataatcctcttaggcataagccagaaatggaaaacacacttgagtctcctggcagttcacggcatagaaagatatcagccagatgggatccagttgacgcatgccggcctatagtcgatgaagcacctgtgttttatccaactattgaggagtttgaagacacacttggttacatagctaagattcgcccccaagctgaactttatggcatatgtaggattgtccctccagcttgctgggtaccaccttgccctcttaaggagaaagatttatgggaaaatgcaaaatttcccactcgtattcagcaaattgacttgcttcagaacagggagcccatgagaaagaaaattaggggaaggaaacgaaaacatagaaaacagtcaaagatgggcatgggtaggagaactgccaaatcaggttctgaagctaatgttgcttctgagcctgaggagaagtttggattccaatcagggtcagacttcacacttaaagactttcagcaatatgctagtgtttttaaagattgctactttggattgaatgatgccaatgaacatgaaaaagttagtgataatagtcaccagcagagatggaagccctctgtggaggaaattgaaggcgaatactggcgaataatagagcaaccaactgatgaggttgaggtgtattatggagctgacttggaaactggatcacttggaagtggttttcctaagatatcatccttaactaagaacgagtcagatagatataccttgtctggttggaatctgaataacttcccgcgactgtcaggttctgcattatgttttgaaggaagtgatatctcaggagttgtagttccatggctgtatgttggaatgtgcttttcctcattttgctggcatgttgaggaccatcacctctattcacttaattatctgcactggggtgacccaaaagtatggtatggaattcctggaagccatgctccaggtctggaagatgcaatgagaaagcacttgcctgatttatttgaagaacaaccaaatctactcaatgaattggtgactcagttatctccttcagttcttaaatccgagggggtgcctgtacatcgcactgtccagcattcaggggaatttgttgttacctttccaagggcataccactgtggcttcaattgtggcttcaactgtgcagaggctgtgaatgtggctcctgttgactggcttctgcatggccagaatgctgccgagctttacagttcgcagtgccgtaagacttcattgtctcatgacaagttattatttggatgtgctcaggaagccgtgcatgcccttgcagatttaactcttcatggaaaagaagatctaaaatatataaaatggagaagcgcttgtgggaaagatggagttcttaccaaagcagttaagataaggataactatggaaaaggagaggcttgactgtattccaactcatttaaagatgctgaagatggacagttgcaagtgctctcctgactgttattcttgtctcaaacattcaaatttgttttgctcatgtgaaatgaacaacagatttattctgtttcgttatactatggatgaactaagtacattggttgaagcattagaaggagaatcgcatgctattgaagtgtgggcaaatagaaacactgtaatggtttctgctgatgctgaggatgcttgcatttataaacaagatgtggagagtgccatttgccaaacccagagttacaaagaagggaaaaactcaacttattgtgcaggaactaatgataagtcaaattcaactatacctagcagttcttacagccaaatttcagcagaattggttcactcagagtttcaccatgaaactcttagtgcaccatctgacactaaagattgtcataaagatagtttgaatgaaaaagatttggccatggacaataaaattatggtgggcacaggaggttctgtggatttgaatattgatgttatgtctggtgaacctgaaaattattttctgcatgctgctgattaccatcataataagggtgttccatatgtggaaaaagtctgctttgcagagaccagaaaagaacaagacaacatggaacctggggctgattgtattgcttccttggagaaagaattttcatcttgttcaagggatgttcaaaattcttgtacacttgatggctataaattgtttggggtggatttgcagatgcattctgattcaggagagcaactcaacagtgtatctaaaatgggcgttgtcgaaacctccaatacaagtatatctttgacaaaccaaagctccttaatgaataactttggtatttctgttgagcctgtaaatttgggctctgttatgtgcggaaaactgtggtgcagtaagcatgcaatatatccaaaaggattcaagagtcgtgttaagttatttagcattcttgatccaccaagaatttgtaattatgtttctgaagtctatggtgctggatttcttgggcctattttcaaggttaccatggaagaacgtccaaatgaggctttcacaaacacctcagcagataagtgctgggaaacagttcttgacagactaaatcatgaaatcaagaggcgaaggagtcgaggtgaaatagaacttccacccttggaacttctgcaaagcattaacggtcacaaaatgtttggattcctttcaccatccattattcaggccgttgaagctgcagatcccaaacatcaatgcgtcgagtactggaatcacaaagaagttgtctctgagtcttcaggcagtgccattgatgactgtaagttcagtcatggttcaagcaactccctaggtgatgtcaagaccaaactttttggtgccggtttgataaagcaggagcaagatagcatcataggaaattgtgattcttttgaagagatgaaattggtgctacaaggattcttgaaaaaggcaagtcccaatgaattaagtgccatgcataagttattcagctctgatgcactgttcactcagtggagaacagcatttgtatcactgatagaggaaatccagaaagcttgtgcataa

SEQ ID NO: 57579 - DNA, 414 bp, Glycine max
  Peptide Sequence Number=SeqID_149264
atgggtccaagggctgtcggagaagctcgcggagaagaagcttgtcggggaagagagaagagaagaagctttttgcggaagagacacacaatattgctgggtgcacctagcatatccctttactggggtggtgcagacattgtgttgaagtctttaagcactttcattagggtcacgaaatcgggtgatgacactttgatggaagataagtcaggggtagactccacaaaagggttcaaccttgataagtccgaaattagttcgacaagaaactcagagagaagctctcatgaatacacaatttttgggattcacatcaataaaaaatctatagatgcaatgcaacaattgcacaaacgaatcaatgaatacaatatcgtgatattcatagataatagcaggctttattcttga

SEQ ID NO: 57580 - DNA, 312 bp, Glycine max
  Peptide Sequence Number=SeqID_149265
atgtcatcttcgagatggaaccttttattgcgaaagagatggagatggtgcagttcttcattgatgctcatggcggcgacgtcgtcgttccgctccaccgaggagttgatggaactgctccttgctgcaaaccagctcaacctcaacacaagaaacttcctcctgatggataccatcacagacatgatcaagaacacgagtgtcgagttcgtcgtcagcaatttcttcactatcaccggcggttccacgccggccgccggagaaagaggcacaggtccgccaagtaaatgcccgggcattggaagaggttga

SEQ ID NO: 57581 - DNA, 489 bp, Glycine max
  Peptide Sequence Number=SeqID_149266
tcatacctacttcattcgagaccccattcagtgattggaactccagcctatattgcaccagaggttctttccgggaaagattacgatggaaagttggcagatgtatggtcctgtggagtgatactttatacaatgttggtaggagcattgccatttgaggacataaaggataccgaaaatttccagaaaaccataaaacgagttatggctgttcaatacaagttccctgaaagagtttgcatatctcaagacagtaaaaatctgatatctcgcatttttgtggcaaatccagcaatgagaatcaccatgaaggaaatcaagtcacatccttggtttttaaagaacttgcctaaggaattgagagacggggctcaagatgtctactacaatgaagaaaatacaaaatatcctcttcaaagtatagaagagatcatgaacattgtcaacgaggccaaaactacaactgcaacttccagtccatatctatag

SEQ ID NO: 57582 - DNA, 4071 bp, Glycine max
  Peptide Sequence Number=SeqID_149267
atggggtgcctttggagatctcgatgtcgagttctcattgtgtttatgttgttgaatattggttcagcctttgctgacactcctcagagacccaagaatgttcaaacttcactccgtgctaagtggtctggaacccccctgcttttggaagctggtgaattattatctaacgagaaaaaggaccttttctgggacttcattgagatttggctaaatactgagaaggatgctgttagctctcgaacagctaaagattgcctgaagaaaattttggaatgtgggcgccctcttctaagggaaccattaaaatcattatttgaattgtctcttatgctgagatcagcatcccctaggctggtgctctaccagcaattagcggaggaatctctcacatcttttcccctaggtgatgaaaattattcagataatgagactgaggaaaagttgcaaacagaaaagaagattgaaaggagaaaagtagatcccctgcatggtgtaatcctgaaaagccatggaggaaaatgttgttgggtagatactggtgaacacttgtttctggatttttatgaattactggcgtggcttcaggactctgctgagcaggtaggtgattcgtttcagagacctgaaatatttgattttgatcacgtctattatgagttaagcgttggaagtccagttgctatcctttacggtgcaattggaaccaattgttttaaggagtttcatgttgctttagttaaagctgccaaagaggggaaagttaagtatgttgtacggccagtgttgcctgctggatgtgaattaaatatcaatcattgtggttctgttggtgctggtgaatcagtgaacttgggtggttatggtgtggaacttgcactgaagaatatggaatataaggccatggatgacagtacggtgcgtaaacccgagttagcatctgaggtcatggcttttcgggattatctattgtcatcaactgtatcagacacacttgatgtttgggaattaaaggatctaggacatcaaactgtacagagaattgtccgtgcttctgatcctctgcagtcaatgcaggaaataaatcaaaatttccctagcgtagtttcttccttgtctcgcatgaagcttgaggattctgttcgagatgaaataatggcaaaccagcggatggtcccacctggaaagtctttaatggctctaaatggtgctttagtcaatgttgaagatattcctcaaggcactttgaagaaattgctctcaacttcacctccttcagagtccagtatacctcgagttgattttcgttctagccatgttcattatctcaacaacttggaagaagatgctaaatataaacagtggaggaacaatttggatgagtccattgatatgatcatatcattgtatgaaaatgattttcctgtgagatttgggattgtgttgtattcttcgaagtttgtcacacagttagaaaatcatgctacaaaagagcacagcgatgaagatatttctactatgatcatatgtctcttcagttatatcaatgagaattatggtgctgagatggcttaccagtttttgagaaatgaagctcttatagatgccttgagtgatgagactcaaagaatacaggaacaagtatattatggacaaatgatgtctgacactgatgtattagctaagtttctatcagaagctggtatacaacgttataatcctaagattatttctgacagcaaacctaggttcatacctctgtcaatgtttactcttggggaggaatctgtactaaatgacattgtctacttgcattctcctggaacaattgatgatacaaaggctgtgacgcatcttcttgctgttgatatcacttcaaggaatgggatgaaattacttcaacaaggcatacattatctgacaaacgtattggacttcttggatcagctatgctcactatatgagaagaattacatcctttcacctgctatggaagctgagagcactgaagcatttgttgatatggtttgcgagcttagtaaagctaatgggttaccgtctaagggctataggtttgccctcccagaatttcctgctggtgaagtgagaaaacattttactaagaattctttgtatagggtgcttgggcttgaatctggtgtcaatgctgtcttcactaatggaaggcgtatggatagcttatcagatgaaggttgggagtgggatctcaaatggagacgcgaactttttgacagtgagctggatatggcggtgaggtttctggaagatttacaaggtatcagcattcatccggaaagacgagataagtggatttggaaggaggatgtctcggagctgtggaaggtcaaggtccctagtaaagttgccctctttgtgtggagactcatcagggacagattacccactaaaaccaatttgcgcaagaggaatcaaaatcatgccactttggtgggaatcattatcgtggaccaatacctcagccccgtttccagcgaaccccccataggaataagattgtttttgaagaggaaaggtttaatgacagtaagatcttggaggatgccatattcctctgctagacctgctcatctattcttacatttttctgctactaccgatttattgagttcttgggaagttttgaagaatgttggcaaattcattagtgatattgtcatggccttatcatcttcaatggccaagcgggatcggaattctgaaagtgctcgttttgagattctgaatgatcagcatagtgccattattctaaataatgaaaattcaagtattcatattgatgcggttcttgatcctttaagtccaaccagccagaggttgtctggaattcttcgagttttgtggaaatacattcagcccagcatgaggattgtactgaatccagtgagttctcttgctgatcttcctctgaagagctactacagatatgtagtaccaacaatggatgattttagcaacactgactctgcaataaatggtccaaaagcattctttgcaaacatgccgttgtctaagactctcaccatgaatcttgatgttcctgagtcttggcttgttgagcctgttattgcattccatgacctggataacattcttcttgagaaccttggcaacacaaggacattgcaagcagtttttgagcttgaagctcttgtcctcactgatcatgaccctcctcggggacttcagctgatccttgggacgaaaactacaccccatttagttgatacccttgtgatggacaacctgggatattggcaaatgaaagtctcacctggagtttggtacttgcagcttgctcctggaagaagttccgagctttacattttaaaggaagatagtgaaggaaattatgataaaaaatcatcaaaactcattactattaatgattttcggggtaaagtatttcatatggaagtagtgaaaaaaaagggcaaggagcatgagaaattactccttcttgatgacaatgcacaagataataagaaaggaagtggcttgaattccaacttcttaaaatgggcttctggtttcattggcagcaacaaatcatccaaaaaggctgaaaaaagtccacaacctggtggattttacttgtcatcaggaatgcaatcttcactttgtgcttcttgtcaatttgccagatatgaacgctttatgaagattatgattctaagtgttctaaagaatactcatcgtcctgttaaattctggttcataaagaactacctctctcctccttttaaggtcatttttgtggatgctgatcaagttgttagggcagacatgggagtactctatgacatggatataagaggaaaacccctggcatataccccattttgtgataataataaggagatggatggatatagtgctttatatgttgttgatctgaagaagttccgagagactgcagctggagataatcttagagttatatatgaaacactaagcaaggatccaaatagtctagccaacttggatcaggagaattttaggaggtatttgtctttcactcagacaaaatga

SEQ ID NO: 57583 - DNA, 1131 bp, Glycine max
  Peptide Sequence Number=SeqID_149268
atggcaaattcaaagggctcatcgagtttcagaaattttatgtatcctggaaagcatcctctacttcctcctaaaagtccgtttcctagtgtttcccaagcatatgctgattatgtcccaaatcccgctgttggtttaaaggctggtaacagaccgagagatggaaacacacaccaccaacgtacttcatctgagagcctagttatagaggagcagccttcatggcttgatgatctccttaatgagccagagacacctgtccgaagaggtggacatcgacgttcatcaagtgattcttttgcgtacatagacactgttaatgcatctaacctcaattatgctagtcaggacgaatataaatataagaatatgatgtctattccaccttggtcacctcaagattttgactgcagcaaagatgctcgtcatgtgcctgtttatgcagaaatgaactccacaaaacagaaaaataggtcatgggactctttttcaaatgccatgacaaatccagttggtgttccctcaggcaaagacagtgctgcttttcagagttcaggattgcaatgtacaccacatgaagcagatgctcttccaccagctgcaagtgaaaagcatgattcagtagaattgggtttacaggatgcaaaatcctttcctgaaaaaaaggacatttcacatgcaaagtcatctgcctctgaaactgatacaaaacgtgctaaacagcaatttgctcaacgttcacgggtccggaaacttcaatacatagcggagctggaaaggaatgtacaagctttacaggcagaagggtctgaagtctcagccgagcttgagtttcttaaccagcagaatcttatcctgagtatggagaataaagcactcaagcaacgtctagaaaatatagcacaagagcagcttatcaaatatttggagcaggaagtactggaaagagagattggaagattacgtgcattgtatcaacagcagcaacaaccaccacagacacagccacaacagcaaccatctggtagtcacagacgctcgaacagtagagaactcgaatctcagtttgcaaacctttctctaaaacacaaggacaccaattcagggcaagaccctgctctcagaatttag

SEQ ID NO: 57584 - DNA, 558 bp, Glycine max
  Peptide Sequence Number=SeqID_149269
actagtggaattcgatcacacactttatccatgcttgtgaacgatgctcctggagttctaaacattgttacaggagtttttgctagaagaggctataacattcagagtttagctgtaggacatgcagaagttgaaggactttctcgacttacgactgtggttcctgggacagatgagtcaattagcaagttggtgcagcaactctataagctagtagagctacatgaggttcgtgatatcacccacttgccatttgctgagcgagaattgatgctaataaagattgctgtaaatgctgctgcacggcgtgatgtccttgatattgctagcattttccgggctaaagccgttgatgtatctggtcacacaataactctggagcctgtgctggatcaacagtttagtgctgatccggccagttatcaccagttcaaggcttctgcagttctaaacatgttatcggacaactggctggtggcacgaactgggcgaattgctctagtccgtgagtcaggtgtggactccaagtacttgcgtggatactcttatcctttgtaa

SEQ ID NO: 57585 - DNA, 2370 bp, Glycine max
  Peptide Sequence Number=SeqID_149270
atggcatcgcgagcaattttgagaaggaggagaagtttaatccatcaatacttgaataactgttttgcttcttcttcgccgtctcccagtaatcgctctctggaattcgctatagctacgacgtcacctttgtttccttgtaagcatggaacgacgccgtacagagacggtttgttccatcgtttcggattgggacaacttgttcctagattcggaagcgccgttccgctggacggtttttcgggattgaacgcgccgataggtgttcggtggttgtcgcagtcggcggcggcagcggcgaaacgtcatgaaccggacgagaacgatgagacggtggcgaagaagcggaaagaagcgtcgcctgaggagtgcgatcaagccgtcgaaggcttgaccactgcgaaggccaaagccatggcgaaacgggcgcaagaggagtcgcagaaagacgtgcagagcgtgttgcggagagtgtggactgcgtttttgggaattggtcctgcgttgagagctgtcgcgtctatgagtagaaattgtggtgttgtggctgcaattgctatttgctgttgcagattgaaatatgaaacagtgaaatgtttgttcgttggtgatttggcatttagggaggactgggcgaaaaaactggttcactggaaaggggaatttgtgtcgacgttgcagcattattggttgggttctaagctgctgtgggctgatgtgaggatcagttccaggttgttgttgaagcttgcgggtgggaggagtctctccagaagggagaggcagcaactgacgcggactactgccgatatctttaggctagttccttttgctgttttcattattgttccctttatggagttactcctgcccgtgtttctaaagttattccctaacatgttgccgtcaacatttcaagataagatgaaagaacaggaagcattgaaaaggagactaaaggcaagaatagagtatgcaaggttccttcaggatacagtcaaagaaatggcaaaagaagttcagaactcccgcagtggagaactaaagaaaacagccgaagatcttgatgaatttttaaacacaattagaagaggtgcaactgtctctaatgaggaaattttgggctttgctaagttgtttaacgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcaggaagattgcagagagcgaggcatgcttggaatgctttctgttgaagaaatgcgccaacaggatattgaaacctcagttttcttgaatatcaaatgttactttggtgtttctattctaaaatttgtgaacctgcctgttcagcttcgagattggttggacttatctctgaatcactctgttccatcatctcttttgatactttcaaggtcatttactgtgtctgggagattgaaaccagaagaagctgtgcaggctacactttcttctctccctgatgaggttgtagatactatacaggttacatctttaccctctgaggattctgtctcagagaggaggaggaaattggagttccttgaaatgcaagaagaacttattaaggaggaggaagagagagaggaggtggtgcaaaggatggagagtagttctagtcaagatgataaggccctgaaagagatgaatgtttcaacggcaaaagaagctcaccaacttgccagagacagagcatttgaaaacaaagaacaactgtgtgaacttagtcgtgcattagctgttttagcttctgcatcgtctgtaagtacagagcgtgaagattttcttagactggttaacaaagagatagaactctataacagcatggtagaggaagagggcccaaatggtaaaaaagatgcctttaaggcatataaagctgcccgagaggaacatgaacacactaatgagttggatgaaggggataaggtgtcatcagcactcattgggagagttgatgctatgcttcaaaatcttgagaaggaaatagatgacgtcgatgcaaaaattggtgaccgttggaggctgctggacagagattatgatgggaaagtaactcctgaggaggtagcctctgctgcaatgtacttaaaggatacattgggcaaagagggtatccaagaacttgtcagcagtctttccaaagatagagacattgttaagttgggcagttggagggaagatggtaatgctcatgaagatgatgagaccagggagaggctatga

SEQ ID NO: 57586 - DNA, 6444 bp, Glycine max
  Peptide Sequence Number=SeqID_149271
atggccaaatatcttgcaaggtcctcaacttcatttgctctgtggtttcctgaatctttctgcatgggtagttgttatttctccaattctggtacttatcatttggggctcttggttgattgtaatattgggtcgagacctgattggtttggctgtaataatggctggcactgcccttctattggcattttattcaattatgctctggtggagaactcagtggcaaagctcaagctttactggattcagtgcaaacctggggctgttgcaatcctgcttcttttggctgttgctcttctttgtgcatatgaactctgtgcagtatatgttacaactggatcacgagcatctgaccgctattctccttctggtttcttttttggagtctctgcaattgctttagcaatcaacatgctatttatttgcagaatggtgtttaatgggaatggcttggatgtggatgaatacgtgcgaagggcatacaaatttgcttattctgattgtattgaagtaggtccagtagcatgtttaccagaacccccagaccctaatgagttgtatcctcgacaatctagaagggcttcccatcttgtactgctctatcttggctcactatgtgttctgttagtatactccatcttgtatggtctaacagcaaaggaggagaattggcttggagcaattacatcagttgctgttattattcttgactggaatttgggagcttgcctgtatggttttcaacttcttgatagtcgtgttgcagcactgtttattgctggaacatctcgtgtttttcttatctgttttggagtgcactactggtatttagggcactgtatcagctatgctgttatggcatctgtactgctaggagcggctgtttctcgccattggtcagccacaaacccattggctgcgaggagagatgccttacaaagcactgtagttcgtctgagagaaggattccgtagaaaggagcacaacagttcatctagcttttctgaaggttgtggctcaagtatgaaacgaagtagtagtgttgaagccggtaatcttggtaatgtcattgaagctggcagggctatggctgcaggtgatgggagcaattggaataatgtcctgtctcaaactactagtttgccggatggaatcaatagtgataaaagcatagatagtggaaggtcaagtttagcattacatagcagctcctgtcgctcagttgttcatgagccagaagttggaacatcatctgatgatagaaatttggatcacaataattctttggtggtttgttctagtagtggtcttgatagtcaagggaatgactctagtgcatcaaactctgcaaatcaacaaacactggatttgaatttggctcttgcgttccaggaaagtttgaatgaccctaggattgcaactatgctgaaaagtaggacaagacaaggtgatcgagaattgagtagtttattacaggacaaaggattggatccaaattttgctatgatgttaaaagagaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacatgggcttgaaaagtggcttcagttgtgcagacttgtattgcatcacattacgggtactccagagcgagcatgggttctgtttagttttattttcatacttgaaaccatcattgttgccatattccgtccaaaaacgatcaaaattattaatgcaacacaccagcagtttgagtttggtttggcggtgctcctgttatctcctgtgatatgttcaattatggctttccttcgatcacttacagcagaagaaatgtcaatgacatcaaaaccaaggaagtatggatttattgcttggctactcagcacttgtgttggattgttgctctcctttttaagcaaatcatctgttctccttggtatatccttgactgtgccactattggtggcatgcctttctgttgccattcccatatggatttgtaatggttaccaattttgggttcctcgtgtgaattgtactgggagtgctggaaatgatcgaattcctcgaacaaaggagggtattgttcttcttatcagtatgtcagtatttgttggatctgtactggctttgggtgcaatagtttctgcgaagcctttagacgatttacgatacaagggatggaatggtgatccaaaaattttgggttccccttacacatcatctgtttttcttggctgggcaatggcatctgcaattggtttagttgttacgagcgtgcttccaataatttcatggtttgcaacatatcggttctccctttcctctgctatctttattggactttttgcagttattcttgtggcattttgcggggtgtcctatttagaagttatcaaaactagggacgaccaagttccaacaaacggtgatttcttagctgctttacttcctttagtctgcattccagcagtgctgtcgctttgctgtggattgcttaagtggaaggatgatgattggaaactttctcgtggtgtatatatttttgttataattggtcttttgcttctgcttggtgctatttcagctttgatagttgttgtcaagccttggactataggagtagcatttcttttggttcttctccttatggtattagcaattggtgccattcaccactgggcatcaaacaatttttatttgagccggacacagatggtctttgtttgcttccttgcttttctgttggctttggcagcatttcttgttggatggtttgaaggtaaaccatttgttggagcatcggttggttatttttcatttctttttcttcttgccggacgggcattgacagttctgctttcaaatcccattgttgtatattctcctcgagttttgccagtgtatgtgtatgatgctcatgcagattgtggaaagaatgtcagtgtggcctttctcatgctatatgggattgccctggcaaccgaaggctggggggttgttgcaagtttaaagatctatccaccctttgctggtgcagctgtatcagcaattaccctagttgtttcatttgggtttgctgtatctcgtccttgcctaactcttaagatgatggaagatgctgtgcatttcctgggtaaggaaactgttattcaagcaattgctagatcagcaacaaagaccagaaatgcattatctggaacctactcagcaccacagaggtcagctagttctgctgcacttttgattggagaccctaccattatgcgtgatagggcaggaaattttgtgcttccgagagctgatgtgatgaaattaagagaccgcttgagaaatgaagaattagttgcaggttcattctttagtagattaagatatcataggacatttcgccatgagccaaccagcgatgtagatcatagaagagtaatgtgtgctcatgctcgaattctggcactagaagaggccattgatactgagtgggtgtacatgtgggacaagtttggtggttatttgcttttgttgcttggtttgacatcaaaggcagaacgagcacaggatgaggttcgtttgagactctttcttgatagcattggattttctgatttaagtgctaagaaaataaagaagtggatgccagaagatcgcaggcaatttgaaatcattcaggagagttacataagagaaaaggagatggaagaggaagtcttcatgcagaggcgtgaagaggagggcagagggaaagaaaggaggaaggccctacttgaaaaagaggaacgtaaatggaaggagatagaagcttctctgctctcctccattcctaatgctagcagcagagaggctgctgccatggcagcagctgtacgtgcagttggaggtgattctgttctagatgattcctttgctcgagagagggtttcaagcattgcacgtaggattcgtgcttcacagttatctcggcgtgcacttcagacaggagtggcaggtgccatatgtgttcttgatgatgagccaacagccagtggcaggcattgtggtcccattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagacggaaggtggcatattgtaacaatgtcaattgatgctgatttaggtgaagcaacatgttatttggatggtggatttgatggctatcagaatggattaccattgtgtgtgggtagcagcatttgggagcaggggacagaagtgtgggttggtgttagaccaccaacagatattgatgcatttggtcggtcagatagtgaaggggttgaatctaagatgcatattatggatgcttttctttggggaaggtgcttaactgatgatgaggtttcttctctctatacctcaatggcttcggcagacttcggtgcacttgatttccctgaagataattggcagtgggctgattcaccttcgagggttgatggttgggacagtgatcctgctgatgtagatttatacgacagagatgatgtagattgggatggacagtattctagtgggaggaaaagaaggtcagaacgtgatggcatggtggtggatattgattccttttcaaggaagtatagaaaacctagaatagaaactcaagaagagattaatcaacggatgttatctgtagaattagccatcaaagaagctctctacgccagaggagagacacgctttactgatcaggaatttcctcccaatgatcactcattgtttgtggatcctgcaaacccccctgcaaagttacaggttgtttctgagtggttgaggccaggtgagattggcagacagaaccatcttgactgtcgtccgtgcttattttcaggagctccaaacccttcagatgtttgtcagggccgtttaggtgattgttggttcttgagtgctgttgctgttctagcagaggtttcacgtatatcagaggtaatcatcactccagattacaacgaggagggaatttatacagttcgcttttgtgttcagggcgagtggatccctgttgttgttgatgattggattccttgtgaattaccgggcaaacctgcatttgctactagtaagaaggcctatgaactctgggtctctatattggagaaggcatatgccaagttgcatggctcttatgaagcactagaaggtgggcttgttcaggatgctctggtggatcttacggggggtgctggggaggaaattgacatgaggagtggtgaagcccaaattgaccttgcaagtggtagattgtggtctcaactgttacgcttcaagcaagaaggttttctcctaggtgcaggaagtccttcaggttctgatgtgcacatctcttctagtggcattgtgcaaggacatgcatactcaatactgcaggtaagagatgtggatggtcataaacttgttcagatccgaaatccatgggccaatgaagtggagtggaatggtccatggtctgactcatcgcctgagtggacagataggataaagcacaagctgaagcatgttccgcagtccaaagatggcatattctggatgtcctggcaagattttcagattcattttcgatcaatatatatttgccgtatctacccatcagagatgcgtcattctgttcatggtcaatggcgtggttacagtgccggggggtgtcaggattatgatacatggaatcaaaatccacagttcagactgactgcaactgggcaagatgcatcatttcctattcatgtattcattaccttgactcagggtgtgggattttcaagaacaacagctggttttagaaattatcaatccagccatgattcacagatgttctacattggaatgaggatactcaaaactcgtggcagacgtgctgctttcaatatctacctacatgaatcagttggtgggacagactatgttaattctcgagaaatatcctgtgaaatggttttggaacctgagccaaagggatatactatagttcctactactatacaccccgggatagcttacatgtatcttgtcctcttgataagtttctctgcttgggttctcggtggatcatgtacttgcactgctggagccctgcttagaacaattggcattgagatactattcctgggagaaatgatggcatctgttcgagagatggatgaggtatag

SEQ ID NO: 57587 - DNA, 2196 bp, Glycine max
  Peptide Sequence Number=SeqID_149272
atgttttcgtgttcctttactcctgtttgcacagaagcaactgatttgctgcagaagctatcgttggaaactcagcccaagcccttggagattcctgagccaaccaagaaggccactgggaatcagtatggatcagttgattcaggaaatgctgcgaatggccagatcccatcgtatgatcggtctgtaaccccagtgttgcaggattttattgatcctactatgtgttacctcccaaatggttacccatccactgcctattattatggtggttatgatggaactggtaacgagtgggatgattattctagatatgtgaattcggaaggagttgagatgacttcggcaagtatttttaccttcctgctttccaaaattcttggagtttatggggataatgggtctctactttatcaccatggatatggatatgcaccctatggcccctattcgccagcagggtctccagttccaaccatggggaatgatggtcagttgtatgggcctcaacactatcagtaccctccatattttcaaccgctaacaccaaccagtgcaccattcacacctactcctgctgtccttcctcagggtgaggtttccacctctgttgctgctgatcaaaagcctcttcctgttgaagcagccaatggaaattctaatggtgtctcaaatggtggcaatgcaaaaggtaataacgctgctgctcctattaaacaggccaatcagaattcatcttttagttccaaagcatcaaatgaaagggttgctatgccaggtcgtggtccaacctcaggttatcaggatccaagatttggttatgatggagttcgctcacctatcccctggctagatgccccactattttcagatgggcaaccaaggcctgtaagtagcacaaccatcacttcttcgatatcaggtggcaacaacactgcctcaaggagccagactttccgccctaattctcagttcatgggcttgcaccacccaagaccaatgcctgccatgggagccacccatagcttcataaataggatgtaccccaacaaattatatggtcaatatgggaacactgtcagatctggaatgggttatggtacacatgggtatgattctcgggctaatgggcgggcttggttggctgttgacagcaaatacaaaactaggggaagaagtggtggctattttggctatggaaatgagaatgtagatggcttgaatgaactgaacagaggccctagggccaagggtggcaaaaaccaaaaaggttttgcaccaactattttggcagtcaaagggcagaacttgcctgcaagtttaggcaccgatgaagagaaagacaagactagtaccgttccggaccgtgatcagtataacaaagctgattttccagaagaatatactgatgctaaattttttgtcatcaagtcttacagtgaggatgatatccataagagtattaagtataacgtgtgggccagtacccaaaatggcaacaagaagcttgatgctgcatatcatgaggcacagcagaaacctggtggctgccctgtttttctctttttctcagttaataccagtgggcaatttgtggggcttgctgaaatgattggtcctgttgattttaacaagagtgttgagtattggcagcaagacaagtggaatggctgctttcctcttaagtggcacgttgttaaggatgttcctaacaatttgttgaggcacattaccctggataacaatgagaacaaacctgtcactaacagtagggatacacaagaggtatgggaagggaaacctgctgatgagaagattgagataaatggggaagtcaatactcaaaaatctgaagttagctcggaagtgctcaaggagtcccttgctgagaaggatagtgatgaccacaaagttcccgagaatggatgtgctacaaaaactggagatgccccaaagggtgctaaaccagttgttcctgagagcaagattgtagccaatgggtctgaagatagagattggttgcctagtgaagataaagatctgtatattgagattggctgggcggagttacttcatagaatgctagcaccaatcccttctcattgggttttgtttacagtgagcagctttactttgttactttcaacaggggtagaagcaaggtgggaaatactgaaaaatatagttggattttaa

SEQ ID NO: 57588 - DNA, 2625 bp, Glycine max
  Peptide Sequence Number=SeqID_149273
atgaaggagtgtggaggctctcttgggggagagggcaaggaagaagaggactactcaaaacaaagagattcagcatcaaacaagcaacagctcatggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattgggatgaagcctggtccggattctattggaatcgttgctgtttcccgcaactgtagtggtgtagcggcaagagcctgtggccttgtgagccttgagcccacaaaggttgctgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattgttcacattgttgatcatgttgatttagatgtaaggaagatcaagctattcaaatcattttgtttggagtgtcctgaagtacttagacccctctatgaatcaccaaaattcttggctcagaaattgactactgctgccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtctga

SEQ ID NO: 57589 - DNA, 2717 bp, Glycine max
  Peptide Sequence Number=SeqID_149274
tggagaatggttttgagcccattgagaagggtgaggaggagtctgttgatgggggtgatgagtctgccgttggccctgtacatgacggtcaatcgggtactgaaggtgttggtgttggtgagaatggagttgaaggggatgggttgaagagtgacattgatgttcctcctgaggaaggtggtggaggttcggagtttgttgagaaaaatgaagtaaagatggagggtgatgttggtcaacatggtgacagggagattgatgattcggtgttggatggggaaattgggagccatgtggaggagattggtggcaatggtgagagggagattaatggttcggtgtcggatgagaagggtgatggactggtgtttggaagcactgaggctgccaataagttcctggaggatttggaattacatcaatcgcgtgatgctgagaggattgttactgactcggacgaagaagaggagtctgacgatgaaggagaaggcaaggagctgtttgatactgctacattggcagctcttttgaaagcggcatcgggtgcggaccaagatggcggcagcatcacaataacctctcaagatgggtccaggcttttctctgttgagcgccctgctggcttgggatcaccgctccagtcaggtaaacctgccgtgaggcaaactcgtccgagtctttttactccttccatgagtagacctagtgccatttctgatagcaatttgagccaagaggagaaaaataaactggagaaattgcatgaaattagggtcaaatacttgagactagttcataggctgggttttactacagaagaatcaatagcagcacaggtgctgtatcggatgacacttgttgcaggcaggcaaagtggtcaaatgtttagcgtagagtctgcaaaggagactgcttcgcgtcttgaagctgagggaagagatgattttgatttttctgtaaatattctggttcttgggaaagcaggtgtgggcaagagtgctacaataaattcaattttcggcgagacaaagaccagcattaatgcttgtggtcctgctactacttctgtgaaagaaattgttggggtggttgatggagtgaagttaaggatttttgacacaccaggcctcaaatcttctgcattggaacaaaatttcaatatgaaagtcctgtctgcggtgaagaaattgactaaaaaatctccccctgatattgtcctctatgtggatcgcctggacctgcaaactagagatatgaatgacctgcctatgttaagatcaattactagtgtcctgggttcatcaatatggcgaaatgtcatagtcactctgacccatgctgcctctgctcctccagacgggccatcaggtgccccattgagttatgaagtatttgttgctcaaagatctcatacagttcaacaaaccattggacaagctgttggggacctacgtcttatgaatccgagcttaatgaatccagtttctcttgttgaaaaccatccttcttgtcgaaaaaatagagatggccagaagacacatacatacccaaaactccctgcagatcaaagtgggcctgacaatggtgattctgatgttgaaatggctgatttatctgattctgatctagatgaagatgaggatgagtatgaccagctcccaccatttaagcctatgaagaaatctcaggttgctaagcttactaaagaacagcagaaagcatattttgatgagtacgattatcgggtgaaacttctacagaaaaagcaatggagagaggagttgagaaggatgagagagatgaagaaaaaaggtaacacaaaagaaaatgactatggttacatggaagaagatgatcaagagaatggaagtccagcagcagtgccagttccattgcctgatatggccatgccaccatcctttgacagtgacaatccagcctatagataccgtttcttagagccaacttcacaactcctgacaaggccagtcttagacaaccatggatgggatcacgattgtggttatgatggtgtaaacattgaacagagtctagctatcatcaataaattcccagcagctgtcactgttcacgtaacaaaggataagaaagacttcaccatccagttggattcctcagttgctgcaaaacttggagagaatggatcagccatggcaggctttgacattcaaagcgttggaaagcagctatcttacagtgttagaggagagacaaaattgaaaaatttcaaaagaaataaaacttctgctggggtgtctgtgacatatttgggtgaaaatgtgtgtactgggctgaaagttgaggatcagattgctgtggggaaacgcttggtattagtgggtagcacaggggttgtgaagtctaaaactgattctgcttatggtgccaacgttgaagtgaggcttagagaggcagattttccaattggccaggaccagtcttcactgagcctttctcttgtgaagtggaggggagaccttgctttaggggccaatcttcagtcccaaatttctgttggacgaggttataaggtggctgttcgtgctggattgaacaacaagctcagtggacagatcactgtgagaacaagtagctcagaccagcttcagattgcccttgttgctatccttccgattgccaaggctatctacaaaaacttctggcctggggctagtgagaattattctatctactag

SEQ ID NO: 57590 - DNA, 789 bp, Glycine max
  Peptide Sequence Number=SeqID_149275
atggaaaaaagtgaaggcatggacgtatcaattttgtgtgcattgggaaaggatattctacttgatttgttggaaaatcccattctggtatcagcctcaaactctttgaaggctaactcagagaggaagttctcagtatctgatgagtctagtccagagagatcaaaatgggtttatatattccagagagaatatgctaccgttgaccccgcccttgttgattttgttggcaccgatgaagcaacaacgtgtgttggccttgttattcggaaccaaaagaatggaatgacgtcagttgcccatatggattcaccaaaaattgtagaaatgggcctctcccaaatgttatcatcactcgtcgacaacagtttggagactgagtttgatcatgcaaatggtagcacagtatcagaaagccctgcagatttggatggttattcctttcctctgtgtttaaagattgttcacactttatggtcaagagaggagaagtttcacatccgaactatctgtgttcttggacataataccagaagggattctgatggaaacacatacccctttttcaatggatttgtgctgttgtactgttttttggtgaataactacatgcattttcaacctttaaatgggatatttgacttctcacatcctttcaggcggagactacaacaggaatcatcatcccagctatctttgatagaacttctagatgtccagatgaaattgtcagaagaatacgagtatccgtgtcttatgaagatgccaactggaacggaaagttactag

SEQ ID NO: 57591 - DNA, 663 bp, Glycine max
  Peptide Sequence Number=SeqID_149276
atgagtgaggatgcagcacacactctaatgccacagcgtttcaccaaggagcatggcaaaacacatattttgccaagaagaacagaaatagtcatttatttcgccaagaggaactgccgaatgggctctaggtgcagtgtgcgtcagagtaggggtgaggaggaagtggttgaaactgctgaacaacaattgggttggttactgttttgcaccccagtggtgctaattctcatagttcgttggttatcatcaatggaaaattcatattggttcttctctgcttcattaccgggggaaaggcaggggcgaactcaccaaggcctttcagaagggagctctccttggggtgtggctcaaccatctggaagtgaaaaaaaaaagaagaagcaagcagcaccatttaaacaagatggtgtcatgaagctgaggcggtcatgggcagtaaagactttcaccaaaggattggaatttttcaggatagtagctgttcttgctgaaaatgaaggtcatcatcctgatcttcaccttgttggctggaataatgttacaatagagatttggactcatgctgttggtgggttgacagaaaatgatttcatacttgctgctaagattgataagcttgatgtgcttgacctacttagacggaagccttcagactga

SEQ ID NO: 57592 - DNA, 372 bp, Glycine max
  Peptide Sequence Number=SeqID_149277
atggctgtgcatggatccaaaaggtgggctgtgaaatgggttgctgaaaaggttctggttgcttttcttcttgtttcagtctatgttgcttcttctcagcaaaatacagaccagaaaacaatctcatcagcatccaatgagacgaaaggggttgatactaaagctcatcatgctgagggtttttacaaacacacttggccggagatgaaatttgggtggaaaataatagtgggcagcataattggattcctaggatcagcatttgggactgtgggaggtgttggtgggggtggcatctttgtgcccatgcttacccttattatcggattcgatgcaagatcagcaacagcaatatcaaaatgtaagaactag

SEQ ID NO: 57593 - DNA, 1410 bp, Glycine max
  Peptide Sequence Number=SeqID_149278
atggctgtgcatgtaccaagaaggtgggatgtgaaatgggttgttggaaaggctctcattgcttttcttctccttgtttcagtctcagctacttcttctcatcaaaatacagacaacaaaacaacttcaccatccaatggaactataggggttgatcatcatgctaaagcattttacaagcaccattggccgagtatgaaatttgggtggagaataatagtaggcgccgtagttggattcttgggatcagcatttgggaccgtgggaggtgttggtgggggtggcatctttgtgcccatgctaaccctcattgttggattcgatcaaaagtcagcaacagctatatcaaaatgcatgattacgggtggagcaacagcaaccgtgttctacaatttgaggcaaagacaccccacccttgatttgcctgtgattgattatgacttagcacttcttttccaaccaatgttgatgcttggaatcagtattggagttgctttcaatgtcatcttccctgagtggatgctaacagttttgctaataatatttttcgttggcatttcagttaaatcattctttaagggtgttgatacatggaagaaagaaaccattatgaagaaggaagctaagaagaattcacggattgatgatattggaagtcctgaagatgatgcacattatattcaaacaggagaccccaccaaagacgatactaatcaatcaaggaaaaaagtttctatcattgagaatattcgttggaaggaacttggacttctcttcgctggctggatcatgatacttgcattagagatcggaaaaaaacacacaacaacttgctcacggctatattggctatcgaacctacttcaggtccccatagctgtaggaatgagttcatatgaggctgtgcgtttatacaaagggaagagaatcatagcatccaaaggagataaacaaacacattggtgtgtgttgcagttagttctattctgcgcttgtggcacacttgctggcatgattgctggtttgctaggccttggtggaggattcatcttgggaccccttttccttggacttggaattcctcctcaggttgcaagtgctacatccactttggtgatggcattctctgcatctatggcagtggtggaatattaccttctcaaacgtttccctgttccttatgctctttacttcgtagctatagccactgctgctgcacttgttggacagcatttggtgagaaaggctattgccatactggggagagcatctgtgatcattttcatacttacactcacacttagtgttagtgcagttttactgggtggagtaggtattgcacacatgattcaaaagattgaaaataaagagtacatgggatttggagatctttgcacgtacagaaaataa

SEQ ID NO: 57594 - DNA, 198 bp, Glycine max
  Peptide Sequence Number=SeqID_149279
atgactcctagggaatccgtcaggacaaggaaaagcatttgctgggggctgttgtttaaaatatctgttgtagaagcatgggtggtggatgagcccagttttgcaatggcatccacacataagtttccttcacgtaagtgcagtcaaggagtcaaactcgcatggcctcttcctcacaccattttcaatccctgctga

SEQ ID NO: 57595 - DNA, 3195 bp, Glycine max
  Peptide Sequence Number=SeqID_149280
atgccccgtaaagtaaattacggactcgattacgacgacgattactatgatgatgattatgatgactatgcttatgatgatgttgatgcagaagactatggaggacctgatacaaagcaagagaccattaagcctggcctttggcaatgctccatttgcacttatgacaacgatgagagtatgactttttgtgatatttgtggtgttgtacgccgtcccttggttaatactggaacttccaacagtaacaaaacagttgaagacgtaaccaaaagtcctggagcatccaagttggccagatctctttttcaatcattacaacaacagattgccaaagagactgtattatttccaaagccagatgatggttttctgacagatggcagtaacttctacaagcttgacaatgtccgaggagaatttcatgaaattcataaggattttagtactcaaagccatccacatttaaacatagatcctttcaagttcaatgttccatcccccgacgatgtggtttatactggcctacgttcttccaaaacgggtttgaaagacaaagctacaaactctaattctcagctttcatcaagcaccagagagaagaatgaactttctgtacagtcaaatgctgaaagttcagacaacttatcatccttaatgcaaaagagcagacaggatagttcaactgagagcaagctttccaaaaaagtagcaattgatctgcaaacaagtggtaaaacttcaaacagcttgccggaatctttgtcaaaagacaaagataacaatattaataaaataaattcttcgaaaaatggtacaattgatattcaatcaagcaaagaaaagtcaggtagtttgtctacacggtcaaaagtcaaggaaagtgataacatcagttcctcttctatcaaagatggaaaacctgaaagtatttccagcagtttcagcaacatggttgtcgatgtaagatttggaaattctgataacactaatgctaaaggaactcactcacgtgtttcttataagccagaaaaatggatgctccctgaacaagctgaagatacattgactcagctgaatcttgcaattgttggccatgttgattctggaaaatcaactctatctggtaggttactgcacctattgggacggatctcccagaaagaaatgcacaaatatgaaaaggaggccaagttacagggcaagggatcctttgcttatgcttgggcacttgatgaaagttctgaagaaagagaacggggaataactatgacagtggctgttgcttattttgacacgatgagatatcatgttgttgtgctcgattcccctggccataaagattttgtcccaaacatgatttctggggcaacacaagctgatgctgcaattcttgttatagatgcctcacttggttcatttgaagctggtatggatggcagcaaagggcaaacaagggagcatgcacaacttatcagaagctttggtgttgaccgggttatagttgctgtaaataagatggatgctgttgcgtactcccaagatcgatttgattttataaggcagcagctgggagtttttctccacttttgtggtttcaaagattcttctctatcttggattcccatgagtgccatggaaaatcaaaatttggtggcatccccttctgatgctcgtttaaaaaactggtatggtggaccttatctattagatgcaattgactctctccaacctcctactagagaattctcaaaacctctactaatgccaatatgtgatgtcatcaaatcaactacacttggacaggtttctgcctctggtaaactagaagcaggagctcttcggagtggatcaaaggtcttggttatgccttcagctgttgtgggaacagtacgctcattggagcgtgactctaatgcttgtactgttgcaagagctggagataatgtagctgtaacgttgcaaggtgtggatggaaatcatgtgatggcaggagatgtactatgccatcctgactttcctgttgcagttgctaagcatttggagttgaaagtgctagtgttggatggtgcaagtcccatattggtgggcacacagttagagtttcacatacaccatgcaaaggaacctggcagagtttcaagaatattatcagtacttgatcccaagacgggtaaggtgaccaaaaagtcacctcgctgtctctctgcaaagcaaagtgcagtaattgaggtgattttgaatgagacagtctgtgtggtagagttctctagttgtaaagctcttggaagggtatccctaagatcaatgggaagaacgattgctgttggagttgtgacaagaataattgaagaacaagcctggattaagttgtgctcccagaccacaggcagctatataactctcgatgaggtttatgggttaacactcactgctgagggtgatttctttgaagatattgacatcacttggggtgaacatggtggtgtaaatatactaggaagcaactctctcgtgctttctcttgaccagtcctctggctctggctttcgatccaacgcagaatatctatatggtagaatagacatgcagattaaacttgtctctgggccaaaccatgatgagattgattttgagttcttgggaaatctcagtggagaaccctacatagtccacaccaatatctacactcaaggcatagggaatagagaacaacagttctatctttggtttgaccccacaaaatatttccacacttacactattgtatggaaccctcagcgcatcattttcatggtagataatgtccctattagagtcttcaacaactatgaagccaggggagtaccatttgctagcagccaggccatgaggctatactccagtctatggtgtgcagatcaatgggcaacaagaggagggcttgtgaaaaccaattggtcctatgctcccttcaaagcttactataggaactttgatgctaaagcatgtgtgtggtccaaaggatcatcttcctgtccttcaagcccaccttccatgactcataatacttggcaagctcaagatttggatgctgatggtagaagaagtctgagatgggtgcaaaagtattacatgatttataactactgcaaagattacaagagattccctcaaggtcgacctcgtgaatgcaggctttctagattctcttga

SEQ ID NO: 57596 - DNA, 468 bp, Glycine max
  Peptide Sequence Number=SeqID_149281
atgcaggcaatgctagttctggttgagagaatcctgcacaacattatccggttcacaggaaatcagaaatcgttattcttgtctcccttgctaccagcagcaatcttgcagcatcattcttcaggatcaggattatcaaacgtaatccttaaggtcaaagaaaaattctttgctttcttgctctttgcactgagttatcaaaacaagacaactacttgggtgttgcaggtcaaagaaaaattctttgctttcttgctctttgcactgagttatcaaaacaagacaactacttgggtgttgcaggtgaaagaaacattctttgctttcttgctctttgtactgagttatcaaaacaactctgtggaggatgatgctaccaagtaccttctttgctttcttgctctttgcactgagttgcttcagatggctggaatatgcagaatcaaaactaccccaagtggagggtaa

SEQ ID NO: 57597 - DNA, 720 bp, Glycine max
  Peptide Sequence Number=SeqID_149282
atggagcatggagggaaggatgtcgtcaagctcaaatcacccaaacttgactcaaagagagcctcttacatcacttgtttagaaactgataaccctaacggactttttccaacccgcttcgaagcggttgaagcccactctccccacatccgacgacgtcaatgcctccgcgctctccgtcgatcaacaaactctgcgtcgagaggctctccaaaaccaaaggacccttatcattggcctggtcaagcaatggggctttcattctcagtccctgaaggagtcaaagtcccttccagtttggtaaatatatttaaggagcttcaccaagaccttggctgctctattccaactcatggaaatcttcaaaaatgggctttgcagggtgttctcttactcaatgctgttctcacagtcaggaagcatcatgcgaattctcatgccaaaaaaggctgggaacaatttactgatggtattatcaaagacaatctcacagaagatggaagagttgtgtttctgttgtggggaaacaatgctcgggagaaatctaggaaccatcgggtttttcgggaccaaatgtggagtgaagagtttctagctcgtctaaagaagctggaagaagcatggaaagctgctaaaaatgttggtgacaaatttccggccaataccgtctacaacaaaagcaaagagccaatgaaatggattccggcaggggaatattga

SEQ ID NO: 57598 - DNA, 375 bp, Glycine max
  Peptide Sequence Number=SeqID_149283
atggtgctgaagtccaaggcagtgttcctggtcctcttggtccttgttgtgtgccaactctcttgtgggttgggggaggattggtctactaggagactcagtaggcataataataataataaggtgattcctccaagctgtggagagctggtgttgaagtcacagtgctcagagaactcaaagtgcaggtggtgcaccagtgaggaccttgatgacatgtgcttctctaaatctgaggcattgaggttgcctcaccagtctatgatttacttcaaacttaagccatggttagggtatatagttgaaggtagagaggaaatggccacattttatccttttgctttatctgttgcaaaatgtcattcaaatagctga

SEQ ID NO: 57599 - DNA, 219 bp, Glycine max
  Peptide Sequence Number=SeqID_149284
atggtttcagtaaccgagcagttcccccaaggaaaggagagaaatttcgaaggctgggagatatgtgtgtggaaacggtggtggcatgctatgaaacagttttgcggtggaaaatttgaagggtttaaagaaattctgcaaagcagtgcagttttggggttcttgataagacatggccctgaggctgaggagtggtcagaatttgtgaaatgggaataa

SEQ ID NO: 57600 - DNA, 447 bp, Glycine max
  Peptide Sequence Number=SeqID_149285
atgatgcatacttgtcttatggctccgatacatgatttactgggaaagactaaaagtcatcaaatgattttctgggcattttcaatatacttggaggcagttgcaatattacctcagttggttttgttgcaaagaagtggaaatgtggacaatttgactgtgcaatatatagtcctttctgagttattgaggtatcttctagtggcaatgacttatcctgatgtttattgggctgaattggacttttctgcttatgtatttcctactttgtctcctgtcttgatgtttgcacaattacttgaggatttacctgtgcctcaggtgttgttcagacagctttgtatgcagatttcttctactattatttcatcagagcgtggtttggatgatgttagttttgagagtgaagggacaaggctaactcctctccctggtaaacagttttaa

SEQ ID NO: 57601 - DNA, 1758 bp, Glycine max
  Peptide Sequence Number=SeqID_149286
atgaacatcatagttgcgtttgtggttcatatgaatcctgcccttttccaaatggaagcgttttacacaactctctcctcccctgcgtccacgtctgttctcaattttcagggctctgaattgcctagaagaaatctttgtaagaaatcttcacacactatttttgcatcacctacgctgcctaaaccgtttcttcagatttgtggtagacctcagacattgatttatacgtcaacccgactctcttctggagcacatagagcaacaatatctgctgaagctggaagacaaaattgggattttggaagatttgttaaaacactgttcttcttcaatgggttcccatctcctgctaagttctttgattttctagctgagaaaatatctgatccttcccctagtgaagtcattaacacaatgggaacttctgatattgtcctggtagctggagcaactggtggtgttggtcgaagggtggttgacatattacgcaagaaaggaattccagtccgagtattggttagaaatgaagagaaagcaaggaagatgttaggctcagatgttgatttggtcattggagacattacaaaagatagcactttgatccctgaatactttaaaggcgtgaagaaagtgattaatgctgcttctgtcattgttggtcctaaggaaggagacactccagacagatcaaaatacagccaaggaattaagttctttgagccagagataaaaggtgactcaccagaaaaggtagagtacataggaatgagaaatttgatcaaggctgtgaaggacaatcttggacttcgaagaggaaagctattatttggatttgaaggcattaattacaggcagcttccttggggtgctttagatgacgtggtaatgggtggagttagtgaaagcacatttcaaattgacccaagtgggggtgaaaatggtggaccaactggggtttttaaaggtgttgtttcaacagcaaacaatggtggctttacaagtatcagaactaagaatttctcagagcctgaaaatctttctgcatatgatggtttggagttccgcctaaaaggtgatgggcgtagatataaaatcattgttcgcacaagcagtgattgggacactcttggttacactgcaggctttgacactgagaaaggaaaatggcaatcactcatgttcagcaagtttgagtctgatggtaaattaaatgaaacttttgtggaaggtccatttgagcttccggtgtctagcatacgggcatatataaaggatccaataacacccaggtttgtgcatgtgagctcagcaggagttacaagacccgaaaggcctggaatcgatctaagtaaacagcctcccgccgttcgattaaacaaggaactggattatatcctcacatttaaactaaagggcgaggatttacttagagaaagtggcattccctatgcaatcgtgaggccttgtgcattaactgaggagcctgctggtgccaatcttatttttgatcaaggagataatattacgggtaaaatatcaagggaagagattgctcttatgtgtgtagctgcgcttgatagcccttacgcatgtgacaaaacatttgaggtcaaaagtgtcattccatttagcgagccatttactgtggatccaacaaaccctcctccagaaaaggactatgacgtatattttaaaaatttaaaagaaggcattactgggaaggaagctctccaacaaaatcctgtttctgtttag

SEQ ID NO: 57602 - DNA, 432 bp, Glycine max
  Peptide Sequence Number=SeqID_149287
atgaatgtacacagtggaaaatatcgcagcgagaggtcagatcttcctttcttctcaaaagctcatttcgaaccttttgtagactcatcgttggtgccttccgctctagatcttcgaaaggaagatctgattcgagagaatttgcaccttagaaagggtgacctcgcaaaaggccaattggtcatggaagtgcgaaaccgccttcgtacgcgttgtcaccgccgttcgtgccggtgcttgtcgctgcccttcgtgccggtgctcgtcgctgcccttcgtgccggtgctcgtcgccgccatggggtcgtcgcttcatcggagctggagaagatcgccggtgaagttgccgcaggtgttgaagttgtcgtcggaggtcatcaagcagcagcatcgttcaagagcgggaaaggttttgcgaaagtgaatgaatga

SEQ ID NO: 57603 - DNA, 813 bp, Glycine max
  Peptide Sequence Number=SeqID_149288
gcgataggaacgacttcatcccttgaaccaaagctggataattggcagacccagtgtgcttttcacaatgagaggaacattggtgaaactctcagatgtaatagtagaatcggatctgggggggacgccatactgacttgtggctgggggcaggctgggttgtgtggtggcatgatgggctatgatggaggaaggttactggcaaagggggctcttggttattgggtgatgttggcgaaaaggcatggcagcagagacctggaccagcgaagcattgatattgttctagagagaattgcccaagcctttggaagctttattttaaccatatctatagttgatgtgggatctcaacaccagactttctatggggagctcaagttccatgtcttagccccgattcccaagtgggttggttgtgtactagccttcgactatttccaggcaaacaatgaaatgctggtgtcaccacctatgcctctttcacagcagaaagatgtaatgaaggctcttcctaaaccattgcctgcatctatggtggctagttatctgtcaaacaagaaagaagatgaaaaagatgaagatgagaaggaagagaatgagcagtctgttgagcacttatcacctcaagatctattgaagagacatattaaacgtgccaagaagggtaggatcgttgaggagtggaatcgtaccatgattgatgattggcaagccgatttgctagctcatgagattctcatgttcctgcaagttgaagatccacacttttgtgactcatttcctctcccaaacaccacaacttttctctga

SEQ ID NO: 57604 - DNA, 1023 bp, Glycine max
  Peptide Sequence Number=SeqID_149289
atggcttcggtggaccccgagatcgcgaagacgcgggaagagcagaagcgaatggagcagcaactggcttcgctcacctccgtcacgtcgcacacaagctggcttcttacaccgccccctaagtcgcttctcaagtacatgccctccgcccccgactctgacaacgacatcggcttccgcaagccgcagcgcatcatcgatcgcgacgacgactatcgccgccgtcgcctcaaccagatcatctcgccggcgagaagaccccggacccttcgggagaaggaggagactctgaaggccatcgctatgaagaagaaggaggaggaggaggccgccaagggcgcgccgcctcaacagcagcagaaaaggaggaaccgctgggaccaatctcaggatgacggtgggattgacccgggctccaagcatgcaactgaacaaagtgagggactggaacatgagataaagcaagtgagagaatctctcatctctgcttatgagaagaatatagctacaaggctgaaagttgaggtttgcaggctggaagctaacaactacaatatcacaaaagatgcttgtgcaacatcaatgcaaaatgtgagggccatcaaggcgatgctgaggagtttggagatggtttcagatcctaaaaaaggtggtacacaagcttgtgaaactacaacgatggttcttgtggggagtagatacagaacacaagaagatcgcttgggtaagcaatggatcagcatgtctgtcgaaagaaaaaggtggtctgggaattttagagatttgaccaagtttaatcaggctcttcttggaaaatggaagtggaatttgttttattatcaaggagaattatgggctagagtgctggattcaaaatatggaggctgcaacctgagagtggtgcttgcaatggaggagcaacaagataggtgggtgtggctaagcgactcaactggggtatatactataagcagtgcatatcaactgcttgacagggaatcaagagatgagaatatagatgag

SEQ ID NO: 57605 - DNA, 513 bp, Glycine max
  Peptide Sequence Number=SeqID_149290
atgataagaatcaaagctagaaacggaaggagcacggtggctaaggaggtggacgaatgtgactccgtgcatggctgtgcatgtaagatcaacgttgttgatgcgtccgaaactgtgtggaaggacttgggactcaacaccgatgatggccttcattcccctccatacaatccctctggaacgcacgccactctcactctcaacaacttcgctcgcggcggggacggaggcggccccgctgagtgcgacggcaatttccacccgctgccacaaagagtggtggcactgtccaccggatggtacaaccacggcgcacgatgcgggaaaatgataagaatcaaagctagaaatggaaggagcacgttggctaaggtggtggatgagtgtgactccgttcatgggtgtgacaaatcacacgcatgcaagacgaacgttgttgatgcgtccaaaaccgtgtggaaggatttgggactcaacaccaatgatggtgaagtaccagtcacttggaccatg

SEQ ID NO: 57606 - DNA, 387 bp, Glycine max
  Peptide Sequence Number=SeqID_149291
atgagaaaagctaggtatgtcagcatcttgtcaatcaaatggtgctcactcaccagcattcaaccctcgggaacgccggccattctcaccgtcaacgacttcggccccggcagggacggaggagacccctccgaatgcgacgggaactaccacccgctgccacaaagagtggtggcgctgtccacaggatggtacaatggtggttcccggtgcgggaaaatggtaagaatcacggccagaaacggtaggaccgcggtggcgaaggtggtggacgagtgtgactccacgcaaggctgtgaccaggatcacgccaatcaatcaccatgcaagacaaacattgccttaacactgatgatggtgaagtaccagtcacccaccatggcctaa

SEQ ID NO: 57607 - DNA, 1104 bp, Glycine max
  Peptide Sequence Number=SeqID_149292
atggagaacctcatactagaagatgcaggaacacaatgctctgagaggattgggactacattcataatttgggccaagaatattaaaattaactttggcaagattatgaaccacacgtttcaattcaactacccggaggttgataaccggagccccatcaagcttcatgtggttatgtttccattccttgcatttggtcactttaacgcatttgttcaactctccaacaagttgttctatcatggtgttagtatcactttcttgtcagctgcatccaacattcccagaatcaaatcaacccttaatctcaatccagccatcactgttatcccattacacttaccaaatggcataaccagcactgctgaattgccacctcacttggctggaaagctcatacttgcaattgaccttactcaatctcatgtaaagtcccttttgttggaactcaaaccccattatgttttcttggactttgcacaaaactggctcccaaaactagcttctgaacttgagatcaaatctgttcgctttgtgtccttctctgcaatttctgattcttgcattaatgtgccttcaaggcttgctggtgttgaaggaagaaacatcacttttgatgatcttaaaaagcctccaccggggtatcctaaaaaatccaacatttccctcaaggcctttgaggccatggacttgatgttcctcttcaaaagatttggtgaaaaaaaccttaccggttatcagcttatgctgaaacactctagtgtaggatgccatttaggccatggtggctttaattctgtggttgaagctctgaccagtgactgtgaactggtgctgttgcctttcaaggctgaccagtttttcaatgctaagctcatagccaaggatttggaggcagggattgaggggaataggagtgaagatgggaactttaagaaagaggatatactgaaggcagtaaaaactatcatggtggaggatgataaagagcctgggaagcacataaaagaaaatcacatgaaatggaaggagtttttatcaaataagggaattcagaacaaattcatcactgatctggttgcccaattgaagtctatagcttag

SEQ ID NO: 57608 - DNA, 987 bp, Glycine max
  Peptide Sequence Number=SeqID_149293
atggccgaggtaattttgaatctaatcgtggaatccatgatgcctgatgggtctttcttgaatgtacccatgaaatcaggctatcaacacggtggagttgatattactcacactaaggcctttctaacatcactgtcagctatggtggctgagaccacaactttccccatagatttgatcaagaccaggctccaactccatggcgagtcactttcctcgagtcaccccactagtgcatttcgagtaggcttgggcattattcgtgaacaaggtgcccttggcctttacagtggcctgtcaccagcaattattagacacatgttctactcgcctattcgaattgttgggtatgagaacctgagaaatgttgtttctgttgataatgcttcgttctctatcgttggcaaggctgtagttggtggaatctctggtgtcttggctcaggttatagccagcccagctgatcttgtcaaggtgaggatgcaagctgatggccaaagggtgagccaaggtcttcaaccccggtattcggggccatttgatgctctaaacaaaattgttcgtgctgaaggatttcaaggattgtggaagggtgtttttcctaatatccaaagagccttcttagtgaacatgggagaattagcctgttatgatcatgctaaacaatttgttattagaagtaggatagctgatgacaatgtttttgcccacacttttgcttccatcatgtcaggtttagcggcaacgtctttgagctgcccggctgatgttgtgaagactagaatgatgaatcaggcagctaaaaaggaagggaaagtcttatataatagctcttatgattgcttggtgaagacaattaaagttgaaggaataagagcattgtggaaaggattcttccccacatgggcaaggcttggcccatggcaatttgtgttctgggtttcctatgagaagttcaggaaatttgcagggctctcttctttctaa

SEQ ID NO: 57609 - DNA, 864 bp, Glycine max
  Peptide Sequence Number=SeqID_149294
atggaggaagtgaagggtgcttcagacttgttggtgggtgaccctgctttactggagaagaaaattgatgcaattcgattgggtgattcctgctaccgggtgattgctgattttgatgctacgttgacaatgttttgggttaatggaactcgtggccaaaccagtcatggtcttttgcagcagggtaatccagattataatgccaaaaggcagcagttatatgaatattaccatccattagagttttcgccaaatattggacttgaagagaaaacaaagctcatggaagagtggtggggaaaggcacatggtcttcttgttgagggaggacttacatatgactcaataagacaatcagttgctaatgccaacatagctttcagggaaggtgtttgtgaactttttgagtttttggaggtagatttcccatccttctataagttcttaaatgttgatatgttcattgtatatcaggaaagagatgctcctgtgttgatattctcagcagggcttgctgatatcattgaagaggtcctaaggcagaaacttcacagatccttcaagaatgtgaggatagtatccaacaggatggcaatttgtgaagagaggcctgctaaggttggtgccataggtttcaatggcgtgttcatatggaagaattttgcccttctgcccgtctgcccgtctgccattgggtttgaaatcatgggtggggtgggggtggggggggtagctaataacattctagaatctctaaccttggatatcttcatcataacaccaatgataccacttgttactaatgggtccagaatatgtatgagaagtgactcaaatgttggttggattgacacttattattag

SEQ ID NO: 57610 - DNA, 1485 bp, Glycine max
  Peptide Sequence Number=SeqID_149295
atgaagggggtgaaaggaaaattcctgaagaagctcaaatccatcaaaccaatcctgaagcaagatttaattctccagatcaaggcctcagatgggtacgtccattttctcccaaagattccgagtttcaatctgcattccccgtttgtttcccgagaaaacaagcccgagaaagttgttcagagctgcgagaaaatgcaggacgaacccgaggtgatcgacgttgcagagctgatgaaagaccttgaggaagaagatgattacaatgacaacaaagagaacataggtccatgttcacagaaaccccaacaacaccacaagggtgttttgcagaacgggaacagagcaaaaacagattcaaaacagagaggggttttggaggaaaaaaagtcttcaccagaaaatgctgacaataacaacaacagaaacagcaacagaaaaatccctttgttagacactgatgttccatcgttccggcggccggacttgaactccggcagcctattcgatccgaatctactggccgcgttcgagcaagccgtgaaggaacattctagaataacagaagaacagaggagaagcagagtcgaagaagagtcttcacagaaagtggaagatgatgaccctgaccctttgatgttctttgaagagaagtgtccacccgggggcgacggaatggttattttctacaccacgacacttaggggaatcctgaagacattcgaggattgcaacaaaatccgcttcctcctccagagtttcaaggttttgtattttgagagggacatttcaatgcacaaggagttcagggatgagttgtggagcagtttggaggggaaattagtgcctccaaggctttttgtgaagggcaggtacattggtggagcagaagaagttctgagtttgcatgagcagggaaagctgaggaaaatctttgaaggggttccaatggattattctaatggtccttgtgatgcatgtggagggataaggtttgtgctgtgcttcaagtgtaatggaagccacaagaaagagtacgagcattgcacatcacttgaacctctaaggatattcaatactagcccagtaattcttccactgagggagagaggtgtgatgttcttcatatgcaacatcccaaactactgttgtctaggccagaagattgtgatttctgtacatgaaggttccatagaaaaacccccatcaccatcaccatcaccttctcaagtgccaatcaatatctctccacaaccatcaccaaatgcttctgctcctcaacctcatggatctagtggcatgagtagccctccatctcccactacaaacacttcaggaggtaatggtgggaattctcctgttccatcttccactcaagagggaaagtctaatgcagtggcattggtaggtgggaaaagtttcactgtgtcgctggggcaacttttatctgtgcttggtgctttatttggattttggattatgtag

SEQ ID NO: 57611 - DNA, 1740 bp, Glycine max
  Peptide Sequence Number=SeqID_149296
atggtatttagtcctgtgacaaaggagaaggggacagagagaccaagaaggacaatggagaaggcagaggcaaaaatacttaaagggccacatgaagacttggaaaactatcttgaagcaattgataagttgagaagcaacattcagttttttggtagtaagaagggtttcaagagtagtgatggcattgtcgtgcatgctaataatttgctagctaaggctatttcgaagctagaagatgagtttaggcagttattattatcttacagcaaacctgtggaacctgagcgcctctttgactgccttccaaactcaatgcgaccttcatcacctggccatgagggtgatcctagtggcaagaatcaccattctgagtctcacaacaataatgctgaggctgttgtatacacacctcccgctcttataccgccaagatttttgccactgctacatgatttagctcagcaaatggttgaagctggccaccaacaaccgttactcaaaatatacagggatgcccgttctcatgtattggaagagagcctccaaaaacttggagtggagaaactcaacaaagatgatgttcaaaagctgcagtgggagattttggaagccaaaattggaaactggattcatttcatgcgtatagcagtgaaattgttgtttgctggtgagaggaaagtttgtgatcagatatttgaaggctttgattcactcagtgaacagtgcttcgctgaggtgactacaaacagtgtctctatgctactcagttttggagaagcaattgccaaaagcaagagatccccggaaaaattatttgtacttttggacatgtatgaaataatgcaagaacttcattcagagattgaaactctttttaaaggcaaagcttgctctgcaataagagaagctgcaactagtttgacaaaacgccttgcacaaacagcccaggagacctttggagattttgaagaggcagttgagaaagatgctacgaagactgcagtaacagatggaactgtccatcctctaacaagctatgtaattaactatgtgaagtttttatttgactaccaatccaccttgaagcaactttttcaggaatttgagggtggtgaggattcttcacagctagcatctgtgacagtgcgaataatgcaagctttgcaaaccaatttagatgggaaatcaaagcagtataaagaccttgcgttgacacatctttttctcatgaacaatattcattatattgtcagatcggttcggaggtctgaagccaaggatttactgggggatgattgggtacaacgacataggaggattgtgcagcagcatgcaaatcaatacaaaagaaatgcttgggcaaagattcttcagtgcctatctattcagggccttacttcatctggtggtgggagtggtactgctggtggtgatggtggaaccggaagcagtagcggtgcttcaagagcaattgttaaagacaggtttaagtcattcaatattatgtttgaggaactccatcagaaacaatctcaatggacagttcctgacactgagttgcgagagtctcttaggcttgcagttgctgaagtcttgttgcctgcctatagatcatttgtcaaacgatttgggcctctagtggagagcggaaagaatcctcagaagtacatcaaatactcagcagaagatctagaccgaatgttgggtgaattttttgaggttgtatttgggggctga

SEQ ID NO: 57612 - DNA, 2583 bp, Glycine max
  Peptide Sequence Number=SeqID_149297
atgagaggaggtatttgtagcatacagcttcaggctcttacacctgaagctacaactgttgtcaagcaagctgtgaatcttgcaacaagaagaggccatgcgcaagtgacacctcttcatgttgcaagtgccatgcttgcaacttccacaggccttcttcgtaaggcttgtcttcagtgtcactctcaccctcttcagtgcaaggctcttgagctttgtttcaacgttgcactcaaccgtttaccagcttccacttcaagccctcttctggctcctcaatattccaccccttcactctccaatgccttggttgcagccttcaaacgtgctcaggctcaccaacgccgtggttctattgagaaccagcagcagcatattcttgccttgaagatcgaggtggagcagctcgtgatttcaatccttgatgaccctagtgttagtagggtcatgagagaagctggtttctctagcacccttgtgaaaacaagggttgaacaagctgtttcaatggaagtttgttcacagaaggcttcttctgataggagccatgccaaagaaaatatcactaagccccatcatgttgttcttggtggtagtaataatgtgtctccatcatctggaccttttggtcaagttgctggtggctccttcatgaagcctaatttagaccatgttaacaatgatgatgtaactagtgtgctgagtgagttggtgaggagaaaaaacacagttattgtaggggagggtgtggccaatgctgagggagtagctagggaagtgatggagaggtttgaggtagggaatgttcctggggacttaaggtatgtgcaatttgtgagccttcctctcatgtgcttcagaaacattagcaaggaggaagttgaacagaagcttatggagattagaaaccttgtgaagagctatgtgggaagaggggttgttctttacttgggtgatctaaaatggttgtttgagttctgggctaatttttgtgagcaaaaaagaaactactactgttctatagagcaaatggtcatggagcttaaaaaattggtatgtggtagtggggagtctagtagactgtggcttatggggattgcaacttttaaggcatacatgaagtgtaaaatatgtcacccatccctagaagctatttgggagcttcaccccttcacaattcctgttggcagcctcagcctaagtttaaattttcacagtgattttcaagctcaagagagaagcaaggtgtttttcaaggatgtggcttttgaagatagaacaggagtcagaaaccatctaacttgctgcagggattgcttgataaattttgaaaaagaagctcagagcataactaactgtataagtaagaaagtttgcactgctagtagcttgccaacgtggcttcaaaattgtaaggaagagagaagtgacataatggaagatcaggaaagttcaaggcttgagtatctgtgcaagaaatggaattccttatgcaattcaatacacagacgacacccttccattattgagaaaccagctgttttctttgtttcatcatccccttcatctcccacttctgtttcctcaaatgaaagaaagtccaactttcatcacagccacctaaattggccaatcatttctgaatcagaaaagtcaccaaaagaatgtgagttatacactgaaactggtgatgatgatgatgatggctatgatagcaactttataatgttcatgccagatagagatgtccctaaaccagatcttctgtcaaatccaaactctagccccaactcggcttcttcaagtgaagcagtggatggtttggaaagcactcaaatgttcaaggaacctaatgctgagaatcataagattctgtgtgatgctttggagaaaaagattccacagcataaagatgttattgttccagagattgcaagtactgtccttcattgtagatcaggaatgagaaaaagaggattaaaccacttgatgaacagagaagaaaatcaagaaacttggatgttctttcttggtgtgaattcccaagccaaagagagcatctcaagggagctagctaaagttgtttttggctcttatagcaactttgtctcaattggcatgagcaatttctcttccccagaagatgatcatgattccactgatgaaaaatccaaaaggaagaggccaagagaagagttgaaaagcagttatgttcaaagattcggggaagcagtgaatgagaaccctcatagggtgttcttcttggaagacttggatcaagttgattacttctctcaaaagggtgtaaagcaagcaattcaaagtggaagcataacactccctagtggtgaatctgttcctctcaaggatgccattgtcattttcagttgcgaaagcttctcttcaccaaagttgagaaaatcaccatgtgctgaaaacaaagggaaagagatcactgtggatgatgaaagttctagcctctctttggatctgaacctagccattgaagatgaaagtggagctacacttagtgaggtcgggggaaagaaaaacatgaatggaaaagtaatattagagacatag

SEQ ID NO: 57613 - DNA, 285 bp, Glycine max
  Peptide Sequence Number=SeqID_149298
atgacggtgaaacctctgacacatgcagctcccggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 57614 - DNA, 1872 bp, Glycine max
  Peptide Sequence Number=SeqID_149299
atggctgctggttctgctggtgctcgatttaaacttgttacatgtgcaattgtgctgctaccattccttgtcacaatagccacaagtgctgatatattccttgattggcacgtttccacagacattaatttaaagcccgtgtctactgatcaaccagttataacaattaatggcttgttccctggaccccttataaatgcaacaacaaatgatgttgttcatgtcaatgttttcaacgatttggatgatcccttgctgtttacatggaatggcatacagcaaaggctggattcatgggaagatggagtgtctggcacagactgccccatccaacctggcaggaattggacttatgaattccaaaccaaagaccagattggcacattctcttactttccttccatcaatttccttaaagctggtggagggtttggtccaattcgagtcaacaatcgacccgtgataagcgttccttttccaaaacctgaggcagagtttgatcttctgattggtgactggtacagcagtagctacaaggatattaggtccaggttgaatacgtcagatgttcttcctcctgattggatgctaataaacggaaaaggaccatttatgaacaatttatctctatcatatgagacattcaatgttacacaaggtaaattatacttgcttaggatatcaaacgtagggacagcctggagcttcaatttcagaattcaaaatcatcaaatggttttggttgaaactgaaggttcttatgtcaaccagatagagttggagtctcttgatgttcatgtcggccaatcctactcagttcttgtcacagcaaaccaaagtgctgctgattactacatagtggcctctcccaaaatgagtaatgccacaaataataacactcttgtcggtgttgctatacttcattatgataactctaccgcaccggctactggttctctcccaagtggtcctgatccatttgatgtgcaattttccatcaaccaaacaaaatccattaggtggaacctcactactggagctgcaaggcctaatcctcagggaacgttcaatgtaagaaatgtgacaatagctgagactttcattttccaggcatcaacagcagtgattgatgggttatctcgctacactgtcaacaatgtgtcttacttgaccccaaatacaccactgaagcttgctgattacttttctaatggaactggagtatataaacttgatgcttattctaagaacacttcaaatgctaatgctgtgcgtggagtttttgtagccagtgcgttatataaagggtggacggagatagtgctcaaaaacaatttagacatcattgatacttggcatttggatggatacagcttctttgttgtcgggattggggaaggagaatggaatccagaatcacggtcaagttataacctttatgatccggttgctcgctccactgtgccagtgtaccctggagggtggagtgcagtttatgtgtaccctgacaaccctggaatatggaacctgagatcacagaacttggaaagctggtatttaggcgaagagctctatgtgagggtttatgatgctgatcccaaccctgccaaagagaagccacctccacagaatctccttctatgtggcttgtttcaaccttcacctccatcattgaaggcacataatccaaatgctccttcagtgtccccagcaccaaatgctccctcagtgtctccagcaccaaatgctccctcagtgtctccagcaccaaatgctccagcatccaaggcatataatccacatagaacaagttcttggtacatcaagaatggaagtgttattcttagatcatacttggtgggtgtttcttaa

SEQ ID NO: 57615 - DNA, 2169 bp, Glycine max
  Peptide Sequence Number=SeqID_149300
atgttgatgagccagatgcagaatggcttgctgtactccagagcttattgggttgctgaatctctcatagcttgggacgtggatgttggaaacgggttttcttgctacctgcttgccagcaaaaatgcttctttgaccattgcaaattgccaaattcaaggcgaggatttgaaaattaagcttcaggaggatagggttggccttcctgcaaatgtggtggagaaatttccccatattcgaggtcacaaagttttcagcctgccacctactttggatgttaagcctcttcttaaattccggttagcagttgttatttgtgattctgatggggaatgcatgaactgtactggtttgcaattacctggtgttttagatgaccttttctcatatagtggtccccttggtgcacttttctcagaggaagctgtgtcactttacctgtgggcacctactgctcaagcagtgcatgcttacatctataaggacccatcaggagatgatcccatagaaattgtttgccttgaggaggaaaatggtgtttggagaactaaaggaccaaaaagttgggaaggttgttactatgtttatgaagtatgtgtttaccaccctagcactatgcggattgaaaaatgctatacaagtgatccatatgcaagaggactttcatcagatggcaggcggagttttctgcttaatcttgactctgttaagttaaaacctgatggatgggataatctggcaaataaaaaacctactatacattctttctctgatataagcatatatgaaatgcatataagggatttcagtgtaaatgccctaaaaaacattctagagtactcctacatactgaaatggatacttgtgattttgttgtttggttccgtagaaagaggagaaaatagtcagaggatagagagtgccagtgacctctctgtgcaacctgaatttcgtggtggttatctggcctttacattgcaggattctgcgggtgtacttcatctgaagaaattatcaagtgctggtatcactcatgtccatctattgccaacatttcagtttgctggggttgatgatcaaaaggaggactggagatttgtagatacctcaatactggaaagtttgccacctgattcagatcagcaacaagctctcatcacagccatccaaaactttgatggttacaactgggggtacaaccctgttctttggggcgttcctaaaggcagctatgcaagtaatccaaacggtccataccgtacaattgagttccgaaagatggttatggctcttaaccatatcggcctccgtgttgtcttggatgttgtctacaatcatttgcaaggaagtgggccttttgatgaacattctgtccttgataagattgttccaggttactatttaagaaggaatagtgatggtttaatcgagcacagtacttgtataaataatactgctagtgagcactttatggttgagcgtttgatccttgatgatcttgtacactgggctgtcaattacaagggagttgctagctctgagttgcagagtttaagagctggcagcttttgtagttttattgttcttcgttgtataagttatcatgttttaaaggacttcttatctcttcctcctcttaattgtactttctatcaaaatgaaaaatgtttaattaagttccatagattgcttatcttagaccccaagatgcttttcctttttcagattgatgggttcagatttgatcttatgggccatataatgaagagcacaatggtgaaagcaaaaactgctctccaatgtttaacaaaagaaaaggatggacttgatggttcaagcatctacatatatggtgaaggatgggactttggtgaagttgccaaaaatggccgtggggtaaatgcttctcagttcaatctcccaggaacacaaattgggagctttaatgaccgaattcgagatgccatacttggtggatctccgtttggccaccctctacaacagggttttgtgactgggctactcttgcagtattggtctgaatttcctgctaagagagggaatgagaagttacttcagaaggttggattattagtttgtcaggggaagaaggagataataaatacaggaatctgggggaagggattgattgagtcttgtatcatttga

SEQ ID NO: 57616 - DNA, 60 bp, Glycine max
  Peptide Sequence Number=SeqID_149301
atgaaagaaggaaagagtgaagagaaaaaggccttggtggttggttgggttgagtgcaag

SEQ ID NO: 57617 - DNA, 1713 bp, Glycine max
  Peptide Sequence Number=SeqID_149302
atgtcaggtgaggaaatcttgtcatccaatgaagaaaaatataatagatctcaacctccatttggtagcaggagtggctacaattcaagaacaggcatttatcactctctaattaagcttggcatcaagcatgaaatcccaacaaggcctgatcttaacactgccaattttgtgctgtcacagtttccacaagcacaccttgctgaggcaagaattgcattcattgatgcgagaactaatctgagtgttagctatggtgagctaagacggtctatttactcccttgcatcagctttgttccatggacttgaggttaggaaaggtgatgtggtatttgtattgtcaccaaactcaaccctgtactcaaccatatgcctagctgtgttatcagttggagcagttctgaccactgccaaccccatcaacaccgcaacggaaatcgcgaaacaagtgcacgattcgagtgctaaactagccatctcagcacctgaggagctacacaagttggtcccaactggggttcctaccattctcacttctcattgttctgatggcaacatgttatcagttgaagagttaataaaaggctgttgtacttcaccagagttgcctcaagttcccgtggcacaatcagacactgctgctatactttactcttcaggaaccacaggggtaagcaaaggtgtggttctgacacatgcaaatctcatttccataatgagactactcttgtggtctgcagatgtaagtggatcccaagatgatgttttcttggccttcattccaatgtttcacatctatggacttgtgttctttggattaggattgttgtgtgttggtgttacaacaattttgatgcagaaatatgacttccaagctatgcttgatgccatccagaagcacaaggtgaataacttaccagcagtgccaccagtgatccttgcactagtaaaacatgcaaggaaagctacgtgtgacttatccagcctaagaagggtggggtcaggtgctgcacctttgagcaaggaagtggcactagagtttagaaggatgtttccatggattgaactgaggcaaggttatggcctaacagaaagtagtggtggagcaacattttttgcctcagataaagatgctaaagctcatccagattcatgtgggaagttgattccaactttttgtgcaaaagttgtagatattgaaaaggggaagcctttgcctcctcacaaagagggagaattatggttcaaaagtcctaccattatgaaaggatatctaggaaatttggaggcaacaagtgcagcaattgattcagaaggttggttgaggactggtgatcttggttacattgatgagaatggatttgtttatatagtcgaacgaataaaggagctaatcaagcacaatggttatcaggtggctcctgcagaattggaatctgtgctgctaagtcacccccttatagttgacgcagcagttataccggttgaagatgaagaaactggacagataccaatggcatatgtggtgagagcagctggttctgaactctcagaaaaccaagtcattcaatttgttgcaggccaggtggctccatataagaaagtgagaaaggtgagtttcattgacactattccaaagtcagctgctggcaagatattgcggaaggatcttgtttctcaaagcaaatatcaacttgtctccaagttatga

SEQ ID NO: 57618 - DNA, 1776 bp, Glycine max
  Peptide Sequence Number=SeqID_149303
atgtcaagaaaggaagaacggtcatccagaaaagatgaatataacaaatctctgcctccatttgataccaggagtggatacgattcaagaacaggcatttaccactcgctagttaagcttggcacaaagcatgaaatcccaacaaagcctgaccttggcactgccaattttgtgctgtcacagtttccacaagcacaccttgctgaggcaagaattgcattcattgattcaggtactaatcggagtgtaagctatggcgagctaagacggtctatttactcccttgcatcagctttgttcaatcgacttaaggttaggaaaggtgatgtggtatttgtattgtcaccaaactcaaccttgtactcaaccatatgcctagctgtgttatcagttggagcagttgtgaccactgccaaccccatcaacactgaatcagaaattgccaagcaagtgcatgattcaggtgcaaaactagccatctcaacactagaggatctacacaaattggtcccaactgggattcctacaattctcacttctcgtccttttgacggcaacatgttatcaattgaagagttaatagaagactgttatggttcaccacagttgccacaagttcctgtggcacaatcagacactgctgctatactttactcttcggggaccacagggagaagcaaaggtgtacttctgacacatgcaaatatcatttccataatgagactactcttctggcaagttgatgtcagtggatcccaagatgatgttttctttgccttcattccgatgtttcatatctatggaatgattttctttggattaggattgctgtgtatcggtattacaacagttttgatgcagaaatatgacttccaagctatgcttgttgcaatccagaagtacaaggtgaataacttaccagcagtgccaccagtgatcctcgcactagtaaaacattcaagcaaagttaagtgtgacttgtccagcctaaaaagggtgggatcaggtgctgcacctttgagcaaggaagtggcacaagagtttagaaggatgtttccttcggttgaactaaggcaaggttatggcctaacagaaagtagtggtggagcagcattttttgcctctgataaagatgctaaagctcatccagattcatgtgggaagttgattccaactttttgtgcaaaagtgatagacattgaaacggggaagcctttgcctcctcgcaaagaaggagagttatggttcaaaagtcctacaattatgaaagaatatctaggaaatatggaagaaacaagtgcaacaattgattcagaaggttggttgaggactggtgatcttggttacattgatgagaatggatttgtttatatagtcgaacgaataaaggagctaatcaagcacaatgggtatcaggtggctcctgcagaattggaatccgtgctgctaagtcacccccttatagttgatgcagcagttataccggttgaagatgaagaaactggacagataccaatggcatatgtggtgatagcagcaggttctgaactctcagaagaccaagtcattcaatttgttgcaggcgagaaaacaatatttcctgggaattttttttgccaagtttcccacgaaaatattctcatgggaaaggtagctccatataagaaagtgagaagggtgagttttattgacactattccaaagtcagctgctggcaagatattacgcaaggatcttgtttctcaaagcaggcatcaacttgtctccaagttatga

SEQ ID NO: 57619 - DNA, 159 bp, Glycine max
  Peptide Sequence Number=SeqID_149304
atgggaaaaggagtggaacctgtggctagagagagatgtaagatatcgaaacaccgtcgtcagttacggaggaggagatcggacggtggcggatcgaaagccaccgtcgagatctcaatggatacgtcgtcgtccgaaggaaataaagggtacaactag

SEQ ID NO: 57620 - DNA, 1150 bp, Glycine max
  Peptide Sequence Number=SeqID_149305
atggagtccacagaatcttcatacgtgtcttctcccgagggaccgaggaagcacgctgcatcgcctcctccgaaatcgccttcgctagattctgaggagaagccaacatacattaggtttctagtatcaaactctgcggctggttcagttattggaaagggcggttcaactatcactgattttcagtcacaatctggagcacgaatccagttgtcacgtaatcatgaattctttcctggaactactgataggattatcatggtatctggcgcaataaatgaaatacagagggctgtagaacttatcctttctaagttgctcagtgagcttcatagtgaggatgacaatgatgctgagccaaagacaaaagtgagactcgttgttcctaatggttcatgtggtggaataattggcaagggaggtgctaccattaggtcattcattgaagactctcaggctggcataaagatatctcctcaagataataattactatggacagaatgataggctagtgacgctgacaggatcttttgatgaacagatgcgtgcaattgaattaattgtttcaaagttatctgaagatcctcattatgcacagtccatgaattctccattttcatatcctggttatcagggtgttccatacacatatgtgcttccgtctgttgcaccaccggcatacaatgcagtgaattacagaccaaatggtgctgctggaggaaagctccagaacagcaaggaggagcggagtaactcattgaccatgggtgttgcagatgagcatataggattggttgttggtcgtggtggaaggaatattatggaaattagtcaggctagtggggcaaggataaagatatcagatagaggtgattacgtatctggaacaaccgataggaaagttaccataacaggatcccagagagcaatacgtacagctgaatctatgatattgcagaaggttgcttatgctaccgagaggggggtgatggaatctgaaattggtgaaaaatggtgctttgattctggaattgtaactttaacggtggtgattggtggagtagagtgtggagagaatgcgtatgccgttggtgctgatggttgcttggacaaccgtgagaggctgcatggcgaggacgggtttgccg

SEQ ID NO: 57621 - DNA, 2550 bp, Glycine max
  Peptide Sequence Number=SeqID_149306
atgacagattttcagccgttacagcagaagcctgagcctgctgatgcccatgccgagtttgagcttggactggaggagtttatgcgtgggcacttggatgattgtatgtcgtttgcttcgtgtagctcgtcccgtgcaccggatgatgaggatgacgagggtgatcagctggttcggaggagaaggaggtctgaccttgaaggggatgatttggctgagtcgtcggctgcacgccggcggcattcgaggattttgagcaggtgggctgcacggcaggcacaggagatgataactaccatcgagaggaggaatcgagagtctgagttgatggcgctcgcggggttgcatactgtgtcaatgttggattcttcttttctgaggggctcgcagtctccaacttctgggcaggagggggctgtggagaggccgagcactcaggcatctgctattctgcagatgtggcgtgagttggaagatgagcatttgttgaaccgggcgcgtgaaaggatgagggtaaggttgcggcaccagaggaattctgactctcataccaatgtgtccagtaccatgtctgatagtcgaggcagtgagaatcaaggaagtttgggggatgcaagtgaaagtgaaaatgattatggtacttggtcacatgatcaaactggatcaaggaatgcacatggggatcataatgggtctagcagggagcaatctcttgatcttggcgaagttgagagggagagagttagacagattgttcagggatggatggaaagcggtattagtgatcattcgtctaatgtgagtcagataaacaatagccggagagcagaatggcttggagaaacagagcgcgagagggtaagaaatatcagggaatgggtgcaaatgattagccagcagagaggttcacgtgggagccggagggatgctcaagtaagtgagggtgcccaagctgatcgagctcgtggcttagtagctgataatgatgagagtcagccagagcatgttcggcgggacatgtcaaggttgcgtggaagacaggctctagttgatttgcttgtgaggatagaaagggaaagacaaagagagctgcagggcttgttggagcaccgagctgtttctgattttgctcatcgcaaccgtattcagtcactgctcagaggtagattcctccgaaatgaaagaactgttgaagatgagaggccattgtctatggctgcaagtgaattagttcagctaagacaacgacacactgtctctggtttaagggagggttttcgttcaagattagaaaatattgttcgtggtcaagcaggcaccagtcctgataccacatcaaatagtaatgcaagtgaaacaagaggcgatgagagccaagcaaacagtctggtagatggccaacaagaaaattatgaacaacagcagattaggagcctggaaactgatgtgcgtcagttgcctaatcgaacaggaactttggagagtagcacaagtgagagtattagttggcaagaagctagtaatcaaggggggaattggcaggaacaaattgctgaagaagggggaggaaactggcgacagagtccattcaatcagacaagagatggaagggcagtcggtgattggccacaggaaactcccagaaatttagctggggaagatcctcatccccgggaagctcaaagaatttggcatgatggtaacactagggaaactgttggtaattggtccgaaggaccttctggagctacaaggaatcgccgtggggttcctataagaaggttcaatagatttcatccacctgatgatgataatgtatacagtatggagcttagagaacttctgagcaggagaagtgtttctaaccttcttcgtagtggtttccgtgaaagtctggaccaactaatacagtcatatgtggaaaggcaaggtcgtgcaccaattgactgggatttgcatcagaacttaccagcatcaactcctgcctctcctgaacaggacccagaccagcagggtgaggaacgagatgagggtcaacatgaaaccattaacagaccttcactggtgttgccttctccaccagtacctccaccacaacctctgtggcaccaagatttgcatcaaactggatggtctcgccatagcatgcatcgttctgaaattgagtgggagataatgaatgatttaagatcagacatggcaagacttcagcaaggcatgaatcacatgcagaggatgttggaggcctgcatggatatgcaactggagttgcagcgctctgtcagacaggaagtatctgctgctctaaaccgctcaggtggtgagaatggatcgagtgctgagacatctgatgatgggtctaaatgggggcatgtgaagaaaggaacttgctgtgtttgttgtgataaccatatcgattctcttttgtatagatgtgggcacatgtgcacttgttcaaaatgtgccaatgagttaattcgtggtggtggtaaatgtcctttatgccgagcaccaattcttgaggtggtccgagcatattccatactgtaa

SEQ ID NO: 57622 - DNA, 885 bp, Glycine max
  Peptide Sequence Number=SeqID_149307
atgtcacagtggaagtgtttttcgttaagggtaatagaatctcggtttccattggcacatagaaggaagaaaggtgttggttctagaaatagggattcttggaaagaatattcaattgggttggtgccacgaataagcagcatctcttatcctcattgtggttattttccatcaagtgggggtttcattgcaaaaaggaggaaacgtaacagtcttctgagactgaatgattgttcagacaacataagacaacatgcttctattttgtttgtgcggctggttagtggagtaatgttggtcatgtctgtttctttggcttctactgagccatcctataaggtgataagaaagatgcttgccacattggatgatccattcactagatttttggagcctgaaaagcagtctggaactgaaggcgctctaactggagtggggttatcaataggctaccctaccaaagctgaaatgcaacctggtgggcttgttgtcatttcagcttctccaggaggtcctgcatacagagttggtgttttgtctggagatgttatcctggctattgattgtacaagcacagaaaacatggggctgtatgatgcagctgaacgcctacagtgggttttttctcctgcattccacttgtgctttcaactatacacatgctggaagatccaatcagtttttgagctctcagatggctccggaatagttgttacagttgctcgctatgagacagctgcacatacagatattgacaaggttggtgtcattcccgaccatcctctaccaacaccatttcccaaggatgaggatgcattttgcaattgcctccaggatccagcatcttcttgctatgtcaataggatcaagctattttcaaaatga

SEQ ID NO: 57623 - DNA, 755 bp, Glycine max
  misc_feature (121)..(121): n is a, c, g, or t
  Peptide Sequence Number=SeqID_149308
gctcggaacaggagagcgcacgagggagcttccagggggaaacgcctggtatctctatagtcctgtcgggtttcgccacctctgacttgagcgtcgatttttgtgatgctcgtcagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaataggagtaggattggcctcgaacaagcttgaaggcgcggaggagtatgccaatgccgactctgacgccataggagaggaggaaggtctggcagaggttgccaatggcgtgagccacgcaggactcgtcggggccgtgatcgcagggcggcgagtccacgcggcagtgctgctgggcgtgagcggcggcgcggcgctgccggcgctggagctcctcaatggcgtcgcggaagcgctcctccgcttcgcgaaggcggccctcggcgtcggagtcggagttgtcgacgagcggaggagaggatggtggtgccatgagaatgaaatgggaatggaaatggagaatactaatagagtcacatcacattcacatcacagactcgtggtttcgttttcaatccgatcactctaa

SEQ ID NO: 57624 - DNA, 1089 bp, Glycine max
  Peptide Sequence Number=SeqID_149309
atgggtgtaaatgaagtacaagttttacacaaaatctgtaaggcaggcaccactagatgcccaaccctcctggtgtggaatttgttatcatcagatcttgcatggaggcttaaagaagagtcactaactagctttctgattatgcctaatgtgcatataccacccccatgcccaaaatgtaaagttatgtatgcctttgtaatgcgtcctgagagcttgccaaaatcctatcaagacttcattcaaaagactgggccagttgcagagcctgtatacaaggctgtaagggatagctgtagaggtcattcagttgatgttgcttcactacatgcttatttatctcgtgtaggaaagatcgactatgcaaagttggaagaatttccctccataattccgtgttccctcattcatccagtaacaaattcatgcttagctcatcaaggaaatgcaacatcattaacgtttaagaaaacattcccgctttacttctctttgacctttgtgccttttgttgttctgcaccttcagaagttcactgatgctcctttccgcactttctggcttgccattaaaggtgctgttcgctcaacaacctttttgtctgcttttgttggaatctttcagggagtcatatgttcacatagaaaagtttttccaagagatcacaagcttgtatattggatagcaggtggaatagctgccctatctgtgctattggaaaaaaaagctaggcgtggtgagctagctttatatgttcttcccagagcagtagattcattatggtatatcttggtgaacaggcacctccttccaaatatcaggaatgctgaggttttcttgttttctctttgtatgggaggaatcatgtattacttggaacatgagccagaaaccatggctccatttcttcggggtctgatccgtcgcttccttgccagcagaatcagcaatccaagcccacctagtcagactgcttcctacacatacctgcaagctcttgatggcataacaaaaccagcattacaggagaagagggatactgaatcttcttcccaaaagtacaaccttgaatctattcctgggctttaa

SEQ ID NO: 57625 - DNA, 714 bp, Glycine max
  Peptide Sequence Number=SeqID_149310
atgaagggtgacaagaatgttaaggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcaggtaatagcctttctttccatctctcttgaatgcacaaatgctcaaattgtttttatagcaaacacatgcaagctcaattatggacattcagaaaacatagtgttactagatgtttacttaatcactgcatggtattatagtgttactacgtgtttacttaatactgctgacaatgtgccaaaccagtgggagtgtgggacattagcgtttatttccccagctctggatgtcatgaactcatga

SEQ ID NO: 57626 - DNA, 1026 bp, Glycine max
  Peptide Sequence Number=SeqID_149311
atggagatggaacacccaagaacagtagcagaaattcttgcccggagaaaacaggatgaggagcgacgaaacagaatttctaaaatgaccccgattgaggatcttcaggcacaagataatcatccatatgcaccactctgtatcaagttaataactcgatttatgaaatgtgtgctcgtgggcacatgtaacaatattaatatagggaagagaaagaggcatagcctcgtaggtaagggtgaggtacacgtacaacaactcaggagagagaaaaatatgcattgtagtgtgtggcagtggtacaggcgtataacaagcaacagaggaaaaagaaaaagaggcatagtaaaaagtgagcatgcagacagacatcggggaggcttgaaccagggcactggttcccgggttaatgagttgacccggtcggatcctcgtgactattttgattcccaacaagctaatgctgtaaaaacattggatgattcccaagctggaatggagcaaatgaaatgcagtttgggttctgaggaagcctatgactctttgagggcatcaatatctaaaatcaaaactactggattaagggatcctctctttagtccagatgttgctcttaaggtccttaacggattgactaaaaatatcacaagcaccaaatatcatcttgggaaaagttctcaagagagtgtccttgatattttacccaattcaactaaggagaaactactagatcattgggtgtgcagtcaggaattgctgaggcacttttggtcttcatatccagtttcaacacaaaaccttgtcagtaaggcatcacctcttctgtcaggcatttgtggagaggggctgatgaaaagtcccacatcaccaatgacaagaagactgaaagattccatatcacaaatatattctaaacttgaggacataaaggtatctgctgagtcagacctgcggcaccatgtttcccttgttgtccatcctatgcagcagattggatttgacaaacacaaaccacttcctacttaa

SEQ ID NO: 57627 - DNA, 327 bp, Glycine max
  Peptide Sequence Number=SeqID_149312
atgaaagagactttggaaactttgagagtgatagaaaaggaaaatgggcttggtgaaaagaaattgatgggtggcaacacaattggattggcagatttagctttggcatgggttgcacatactttggtggccatgggagatgtgattggagtcaagttcatcacagctgatacctttcctcacattcactcttggatggtgaatttcttggaaattcctgtcataaataacaatctcccacctcatgagctagcagttgagtacttcagagaaaagaggcagatgtttcttgcaatggttacacaagcttgtcaccaccaccactag

SEQ ID NO: 57628 - DNA, 693 bp, Glycine max
  Peptide Sequence Number=SeqID_149313
atggccactttcggttttcaggcaatggcacactgcttgttgcttcggagaatttcacaattgtcaaggttcagatcaatgccagatatacctgggacttcttcagcaagaatggcagcttctgaaacaaattctagaagaacaggtcaacgaaacaatagagttgtttgggagaatttatctgaggaagagaagcttgctgcgatagagagtcttactgtttattgcaggcctatagagctctacaacataattaagagtcgtactaaaaaaaagccattataccttcggagatgtatggactaccatataaaggctaagcgcaagaagaggcttgtattgacggcttcgttgtcatggaaagatgatgataatcgggcgctgtttcctttgtgtgtctgtctgggaaggctggatcccaatacggaagctcgaagcgcacaaaggtatcatgttggtaagatatcctcatttaaaggactctcaggagttgatgggaaggggaatactcaactcgaagtaaacttcatgcttcccgaatttgataagttagctggggaagttagcactgccaaatattggttcttggtctttgcttctgcggggaacccaatttcattatctagagccaattcgagcccgtggcctgtggaggtgtcttctaatgaatgtgagatatgcttcaactactaa

SEQ ID NO: 57629 - DNA, 114 bp, Glycine max
  Peptide Sequence Number=SeqID_149314
atgctacaatgcgaggggttaggtggcctgcgggaaaaagagagggttttgggagaagagagaagaaacgaaattgtgaggcagaggagactgaggagtcagtccgaaaactga

SEQ ID NO: 57630 - DNA, 462 bp, Glycine max
  Peptide Sequence Number=SeqID_149315
atgagtgaaatagaggaggtgcaagagcagatgaaggctgacatgaaaggccatgaaagagcaaaaatgaccataatgatgcaagtcatgatgagtatgagaaaaatgatggaggtcaacatgactatagttgttgccgcaagcactgccactgaggtggacccgactcacctatctagcctcaatcaagtaaatcctccagtctcggatatggtagggcaaggaggcgaagcgttaggatgtacgggcgacccccattttgtgcaagttcagaacaagcattccttcccaccatatggcttgctcccaactatacaccactcaatgttgcacacgctctcgatgagaatgtcaataactccactcccatactcattgggagccaacaaccccaatctggtcaggcacaggtccctcaacccatgggggagacacatgaagtaccccgagaccacactctag

SEQ ID NO: 57631 - DNA, 348 bp, Glycine max
  Peptide Sequence Number=SeqID_149316
gcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgataccttcgtgggattggggcttagggtttcctccttgtgacaaagaagatgcgcgagtgagagagatgatgtgcgagttagagagtcgcatgtag

SEQ ID NO: 57632 - DNA, 782 bp, Glycine max
  Peptide Sequence Number=SeqID_149317
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctgaaagagatatctgcaatccaatgttcattgcagcattagtcatagcagccaagatacggaagcgacctaagtgtttcttgatcaataaagggataaaaaattgtggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57633 - DNA, 171 bp, Glycine max
  Peptide Sequence Number=SeqID_149318
atgcacattcatggacaagattctaaaggaaaaggagaaggaagcaatgaagatcctccagtagaagtcaaagcaaataatgatcttccaagagagtggaaagctttaagagatcatcccattgacaacattattggtgatatctcaaaagggctatacaagaagaactaa

SEQ ID NO: 57634 - DNA, 165 bp, Glycine max
  Peptide Sequence Number=SeqID_149319
atgttggtggcaactccgcgcatctttcctcctttggaaagcgcacccgtgagcctcgcccttgctcgcccgcgaagggcacgttgcgacagttggcgactccactggggattatttttgagtggaggtgaatctatcatcatgctaggtctccgacttgcttga

SEQ ID NO: 57635 - DNA, 312 bp, Glycine max
  Peptide Sequence Number=SeqID_149320
atgcgtatccaaggcaacgctccagcctttgtagatgagctgaggggctctagaggtggcggcagtgcgtctattgtccgctgccggccatccccaggctactgtggtgtgtcgccctgcgcctgcctagggggcgcagtacttcttgatgaaagcctggttaatagggggcctgatgaccttgttgggggcgacagatacttcgtagaactaacaaaggcctctaatcagagctggaaatcccaggaccctattggacttctccgggtccactgggtgtcttgcggtgtgatccttgcaaacaatagatga

SEQ ID NO: 57636 - DNA, 249 bp, Glycine max
  Peptide Sequence Number=SeqID_149321
atggtgaaagttggaacctcttacgtgccgatcaacgtctcattttcgccaaaagttggcccagggcttcccggtatcaacagggacaccaggatttatttattctgcgaatggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 57637 - DNA, 378 bp, Glycine max
  Peptide Sequence Number=SeqID_149322
atggaagaggcaaaggacagtagaaaagttgagcaacttggagaatggtgggagatgtttggtgatggaactccaaagttgaggagatttgctattcatgtattgagcttgacttgttgctcttctggctgtaagcgtaattggagctcatttgaaatgaatgatgaggatgagcaacctcgaggtgaaggtgatggtggcaatgttgaattagtaggagatgttggaagaagttcaaatgatctagttgtagacgtttttgatctagataatttaattttggtggaacctaatgatgatgcacaatctaaggaagaccttgatggtgatgaaagtgatgatattcatggagataatcctattagaggattggacatt

SEQ ID NO: 57638 - DNA, 597 bp, Glycine max
  Peptide Sequence Number=SeqID_149323
atgcgtcctgcaggcagagcaccacagcaagttcgccccctgacactgacccgtcactataccaaacacgctgaaggttcagtgctggttgagtttggcgataccaaagtcttgtgcaccgccacggtagaagagggcgttccgcgcttcctgaaaggccaggggcaaggttggatcaccgccgagtacggcatgctgccgcgctccacccacagccgcaacgctcgtgaagccgccaaaggcaaacagggtggccgcacgctggagatccagcgcctgatcgcccgctcgctgcgcgccgcggtagacctgaaaaagctcggtgaattcaccatcaccctcgactgcgacgtactgcaggccgacggcggtacccgaactgcctcgatctccggcgcctgcgtggcgctggccgatgcgttgaacacgctggtggccaacggcaagctgaaagccgacccgatgaagggcatggtggcggcggtttccgtcggcatcgtcaatggcgaagcgctgtgcgatctggagtatgtggaggattccgcggcggaaaccgacatgaacgtggtgatgatggaagatggccgcatgattgag

SEQ ID NO: 57639 - DNA, 750 bp, Glycine max
  Peptide Sequence Number=SeqID_149324
atgttatctgataactttagcattgataaggaaacccttaggaaagacttttattctccggagaatgagcctcaaaggaaatggtttttccaacattacaagggtacaaacagaaaacaaatccaagacaaattttacgaatttattagtagacaacagatccaagacaagttctatgaatttgtcgaaagagtaaaaatcaatgtccttttctttgactggttccatgcttacaccataagaaaggatatagattacccatggaaacaagatatcataggtgaaccaataacaaatgtcataacaaactggcaattgaaagacggcgagttaatccaagcagatttaccccccgcaactcagtatcaactccccaatatcaaagatagtagtaataaacctgtcatggtagttcctttcaaaacaaaagacatcaatgaagaagtaacctctagggatattaggagcctaatggaacaaactaactatacaaacaaatacttacaagtcttaggagaaactctcaagacaaaaatttctaaacaaaaaacaattgaagaagcttcaacaaaaaattcaaatatagttccagaagcaattataaacccaattagttctaaacactggaaaaccccatctaaattataccaacgtccaactgcccctgaccttctactagaagaaagaggagaaaataatttcaagagtttttctacaaataacatctatgaatggaatatagatgcttaa

SEQ ID NO: 57640 - DNA, 396 bp, Glycine max
  Peptide Sequence Number=SeqID_149325
atggaacctaatggaaaggatcaaaaagttcactatctagtgacaactaccgagggtggttttatggactaccagcaacaatgcatcaccaaaagaggaaaactcttgatgagtcttcactgttatcaagcgagtcagagacctagcatgaccacagatcgacctccactccctatgtctcacacagactcgggtatatggcctaatatctcaatgtgtgtgaaaacgtgtaggtgtcatgtgtgcatagagcaatctaagaattaccccactgatgcaatcctccctaggaagggaccggtcactagaaccatgagcaacaagctccaagaagattgggctagagctgttgaaaaaggccctagggttctcatgaacctcagggtagatttctga

SEQ ID NO: 57641 - DNA, 459 bp, Glycine max
  Peptide Sequence Number=SeqID_149326
atgggtgaagcagaggaggtgcaagagaagatgaaggccgacatggaggccatgaaagagaaaatggccacaatgatggaggccatgatgagcgtgaagaagataatggaagccaatgcggttgcaattgccgctaccagcgttgttgctaaggtgaacctgatgtccccatctggcctcaagcaaatgaatcatccaacctcaaatatggcacatacctctcgacccatggaggagacacatgaaattccccaccacgatctagccaacttcgagccttgcctcggatatgctgctgaagggcaagcagttggtggtatacccctgcaaaacactttggagggccctcagtatcacccacaactgcacctcttgcattccacagcggataaaaaccctcatgactatggcaggaatgggaaagttggatcatctaaaggaaaggctcagggccattga

SEQ ID NO: 57642 - DNA, 303 bp, Glycine max
  Peptide Sequence Number=SeqID_149327
atgacaccggtaaaccgaaaggcaggaacaggagagcgcacgagggagccgccagggggaaacgcctggggggcggagcctatggaaaaacggctttgccgcggccctctcacttccctggttaagtatcttcctggcaatgcacactattccaggaaatctccgccccgttgggcacatccgccctttagcgccgctggcaatacgcaaaccgcaccgatcgccctcgcgcaagttggccgattcagcctgaatgcagcaatggcacgacagcgttcccgacggccaaagcgcggcgggtga

SEQ ID NO: 57643 - DNA, 445 bp, Glycine max
  Peptide Sequence Number=SeqID_149328
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 57644 - DNA, 360 bp, Glycine max
  Peptide Sequence Number=SeqID_149329
atgggttctccacctgcctcccctcctcctcctcctcctcctcctcctcctttggacgcatcggcttcgccgtctgccgtgaatcggacacgcaaagcctcacgtctacgatcattgtctactagaccacctggtgctgagagaccaatggtccatgttgatcctgctaccggcaaggccgacggtccctacaggaagaaattaagaacatatttggggattgtggtgtgtgataaggtggacgtcacctacgagaactggaaggaggtccttactgctcagaaggacctgatttgggaggatattcaggacgaaaaggaagttacttcagaccgtgggggagagatggaggcagtttaa

SEQ ID NO: 57645 - DNA, 576 bp, Glycine max
  Peptide Sequence Number=SeqID_149330
attgagaatggagaattggggaaccgtgctaggcaatcaattcgtggggctccagactcgatgcgctacgcaatcaattcgcggggctcaagactggatggtggaggacacatcaacagcgctagacaatcaattcataggtctctgaataagattgagaatggagaattggcgaacagcgcaaagcaactcgatggtggaggacgcatgaatagcgctaggcaatcaattcatgggtctctgaataagattgagaatggagaattggggaaccgcgctaggcaatcaattcgcggggctccagactcgatcgtggaggacgcatcaacagcgccaggcaatcaatgcatgggtctccgaataagattggagattggagacttggcgaacagcgctaggcaatcaattcgcgggtctccagactcgatggctccagactcgatggtggaggacgcatcaacagcgctaggcaatcaatgcatgggtctccgaataagattggagaatggagacttggcgaacaacgctaggcaatcaattcgcggtgctccagactcaatggtggaggacacatga

SEQ ID NO: 57646 - DNA, 392 bp, Glycine max
  Peptide Sequence Number=SeqID_149331
atgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctggggccccggactgtggaacaaaggagtatcccgaacctacaccgagtcagttaacagccgaccgctctaccactgagctactgaggaacaacgggaaattcgagctcatagagttcaattcccgttctcaacccatgaccaatatgagctcgaagtttccttc

SEQ ID NO: 57647 - DNA, 336 bp, Glycine max
  Peptide Sequence Number=SeqID_149332
atgatcatcatcaaaacatcaaagtcatttgcttctacagtgacgacccccaggaggtttatctacgatgccctacaaaagaggggcgtaattccccgcggtgggcacggggaagattcctttttgatgcatcctggcaagctacataacctggaaacatgtttagcagtggaggacctattgcaacagatgatagaccgaggccggctggaagtcgacgatgaggggagtgaagagcaacatatatgtatgcagtccgcagatgagggaagttttggaaggcctaagcctttggtggtatatttcaccagagacgctgctccccaaacgccttga

SEQ ID NO: 57648 - DNA, 309 bp, Glycine max
  Peptide Sequence Number=SeqID_149333
atgatgacaaaggtgatgatgaaaagctcaaaggtcaatcaaagaacgagttcaaaatgttcaagatggaatcaagaacaattcaagactcgagaggaaaagttgaagaacacttcaagattcaagaggaaagttgaattcaagaatcaagattcaagagatcaagattcaagagatcaagattcaagactcaagattcaagaatcaagagaaggcttaatcaagataagtatgaaaaggtttcctcaaaaattgagtagcacatggtttttctcgaaacatgtttaccaaagattttttactatctag

SEQ ID NO: 57649 - DNA, 114 bp, Glycine max
  Peptide Sequence Number=SeqID_149334
gaagattgtgagccaagcaggaaagattggagtaccaggcttgatgatgctctctgggcacatcggactgcctacaaaggatcacccattaggagattttccggatgatcattt

SEQ ID NO: 57650 - DNA, 216 bp, Glycine max
  Peptide Sequence Number=SeqID_149335
atggttaacgctgtctctagaacatttccattggatttaatgatgaaatctgtgcattttcaagtgaaaaagaggctaagttttgaattgcaaaaagtagcagttgggctaagctcagtagttgggctaagcgcatatccatcgctaagtgcaacttcaacgcgcttagcacaaaggagaatctggcagagcatcaacaccaaagccgcgcgctaa

SEQ ID NO: 57651 - DNA, 105 bp, Glycine max
  Peptide Sequence Number=SeqID_149336
atgggattcttggctagaagaaagaacagtggagctttcgatcaagacgttctcgcctcccctgtttgggctctcgctcgaattggaacctttatgcgttggtag

SEQ ID NO: 57652 - DNA, 461 bp, Glycine max
  Peptide Sequence Number=SeqID_149337
agccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaagtgatgtatgcagctgagcatcctaacagaccggtagacttgaaccttgttcctacatga

SEQ ID NO: 57653 - DNA, 413 bp, Glycine max
  Peptide Sequence Number=SeqID_149338
tttgcacgtaacgggccaagctctcaactgcttcttcctgaaaatctcaagctgatgccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57654 - DNA, 408 bp, Glycine max
  Peptide Sequence Number=SeqID_149339
atggccaagttcgatccagacatagtcctcgaattttatgccaatgcttggccaacagaggagggcgtccgtgatatgaggtcctgggtgaggggtcagtggatcccgtttgatgcaaatgctatcggccagctcctgggatatcctttagtgttggaagagggccaggaatgcgagtatggccagaggaggaaccggtccgatgggttcgatgaggaaccggtccgatgcggggcaggattttgcccggactgctgccgggagacgggtatggcgcctaccaggcaccctctggacccagataagtccaacagggccctgggatttcccgccttgatcacaagactctgccagtcgttcggcgtccccgtcgcacctagcaaggtgattcggccgcccatcacctga

SEQ ID NO: 57655 - DNA, 249 bp, Glycine max
  Peptide Sequence Number=SeqID_149340
atgcccttttgcgggcgagcaaaggcgagactcacgggtgcgctttccaaaggaggaaagatgcgcggagtcaccaccaatgtcgacaaaagcggggcttttgctcctacataccctccatcgaagaggaaatcagacctacgtagttctttcttatgcgtgaatcaagtgattcctttttacttgaaaggtgatcattttaaggtgttggaccttaaaaatgatccattttacttggtaagaaactga

SEQ ID NO: 57656 - DNA, 195 bp, Glycine max
  Peptide Sequence Number=SeqID_149341
atgtggtatcatttttcagtgaaaaacctcgtcgggcgcctaggagtacatgacaggacatgcctcacaatgggaagaccagtcagggtcacactattttgtgagattgctccaaccatgtgtgattggcaccgacttaaaggagcacttaaaccggatgacccccaaggcctacactccgaagagtccgtctga

SEQ ID NO: 57657 - DNA, 333 bp, Glycine max
  Peptide Sequence Number=SeqID_149342
atgggatcaagtcaaacgccttcgcttaaaaaaaggttctatcaagtcaaggtcaagagcctagggatcaccagtctaaaagagttagggcagttgatgggtcagctccagcggcaagcttttcgcaaagcttacggtaaaatctgggacctagccatggtagaagtctccacagaggccattgcttccctcgcccagagaccatacctcttctcagggttctatccttcattagctagaatttctaagatagtccaaatctcgatgcaggaattagaccatagaaagcaagtcgaaaatgtagtggttggaataccgagaaaatgtttggag

SEQ ID NO: 57658 - DNA, 231 bp, Glycine max
  Peptide Sequence Number=SeqID_149343
atgggagaccaaccacacataaagagcaggcatacaacagacaattcttgcactgctcttctcgcatctcaggtcgaaccaagaaaggcttcgatcactgctaagtccactagcccgtctacatttggaaatagtatggtcccaaacaccaacaatgctaatatgtcaatgaacgagtcattaccatggtgcccaatgcatgccattaagaaggcaatgcagactttctaa

SEQ ID NO: 57659 - DNA, 654 bp, Glycine max
  Peptide Sequence Number=SeqID_149344
atgccgactgtggaagagtttgaagaaatcctgggatgcccacttggaggaaggaagccatatcttttctctgggttctatccctccacgacaagagttgccaaggtagtgaaaatctcagcacaagagttggaccaggtaaagcaaaataggaatggggtagtcggagtaccaaggaagtgtttggaggaaagggcaaaggccttggcaaatcaaggcgaatgggcttcttttattgaaatcttggtgcttttgatctttggagttatcctctttccaaatatggaagggttagtggacctagcagcgattgacgctttccttgcctttcatcatggcaaggaaagcccggtcgtcgccattttggccattgaccccaacacgagggtactccaaggagttcgcaaggcatgggatgcggtgcgaagaaaggacaatgagcttaggggaagcagtaatgggatcatcgacgactatcataagtggccgagagttcggacacaaggattggattgtctcccaaatctaaagactgtgagagacgatgaggttaaagcttcggaagaaagtgatgaggtacaagccctaaaggaaaagcttgaaagagcctgggtagtcaaagagaagttcaagtccacaaccatcaaagtctga

SEQ ID NO: 57660 - DNA, 402 bp, Glycine max
  Peptide Sequence Number=SeqID_149345
attatcgataccgtcgaccacgcggagataccttatggttatccgcacccttttgtcatccagaggcggcgggcccgaagacaagcagagaccaagtttggtcattctgcacccttgtatcatccagaggcggcgggcccgatgatacgcggagataccttacggttatccgcacccttttgtcatccagaggcggggggctcgatgacaagcagagaccaaatttggtcattctgcacccttgtatcatccagaggcggcgggcccgatgatacgcggagataccttacggttatccgcacccttgtgtcatccagaggcggcgggcccgatgatacgcggaaatacccgagagggttatccgtacatattcttttgctatctgtaagacagaacgcttga

SEQ ID NO: 57661 - DNA, 808 bp, Glycine max
  Peptide Sequence Number=SeqID_149346
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatagccaaggactaaatgacagttccctttgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57662 - DNA, 583 bp, Glycine max
  Peptide Sequence Number=SeqID_149347
ctccttcttccatggcttattccctagtggatggtgtctcccttctcctcttctcctttgcctttcactacatctccatggtggaaaatcaccattgaaggacctcattgaagctcaaagatccagtctccatagaagctccacaagcaagcttttatcagtaaaagaattctacgcaaacctctatgacccagaagtcaagtcacctaagcaggtggagaatttatgtgcttattcgagattttcactcctaaggcctgatccacaggagttagctgctaagctctgtaccccagggaggggatttgagttgaatgctgatggtctccccttgatgatcttaaggaagaacatgactactctcgctcagacatggagcattctttcttattgtaacttggtcccgacctcccacacttctgacatcacattggaaatggccaagttaatctatggcatcatcatgaagatggatatgaatgtggggtacctcatctcccaccagatctctattactgcacaacacgactcctccaaacttggattcccagccttgttgacaactctgtgcaaggctagagga

SEQ ID NO: 57663 - DNA, 440 bp, Glycine max
  Peptide Sequence Number=SeqID_149348
atgacaagaagagacaaaatttggtcattctgcacccttgtgtcatccaaaggcggcgggcccgatgatacgcagagataccttacggttatctgcacccttgtgtcatccagaggcggcgggcccgatgatgcgcggagataccctacggcggcgggcccgatgatacgcggagataccttacggttatccgcacccttgtgtcatccagaggcggtgggcccgatgatgcacggagataccttatggttatccgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggaatacctacgagtg

SEQ ID NO: 57664 - DNA, 150 bp, Glycine max
  Peptide Sequence Number=SeqID_149349
atgggtagaagcccaattgaattaaattttagagggggagcggaatggagaaggaagagagagaggagacgccacttcaaggagaagatgagtctagaagaagctcactactataggaggccatggataagagcttggaggaagaagtag

SEQ ID NO: 57665 - DNA, 790 bp, Glycine max
  Peptide Sequence Number=SeqID_149350
atgtctcaggttcagagcggcattttgccggaacattgccgcgcggcgatttggattgaagccaatgtaaaaggggacgttaacgccctgcgcgaagcgagcaaaatttttgtcgataacgtggccaccttccaggctaaattccctgacgccaaactcggcgcggtggtcgctttcggcaataccgtctggcgtcagctgagcggtggtgaaggcgcggaagagttaaaagattttccggtttacggcaaagggctggcgccatccacgcagtatgacgtgttgattcatattttatccgcccgtcatgaagtgaacttttccgtcgcccaggcggcggtggccgctttcggcgacgccattgaagtgaaagaagaaattcacggtttccgctgggtggaagaacgcgatctgagcggctttgtcgacggcaccgaaaacccggcaggcgaagaaacccgccgtgaagtcgcggtgattaaagacggcgttgacgcgggcggcagctacgtattcgtgcaacgctgggagcacaatcttaagcaactgaaccgcatgagcgtgccggatcaggagatgatgattggccgtaccaaagacgccaacgaagagatcgacggcgacgagcgcccgattacttcgcacctgagccgcgtggacttaaaagaagatggcaaagggctgaaaatcgtccgccagagcctgccatacggtaccgccagcggcactaacggcctgtacttctgcgcctactgcgctcgcctgtataacattgagcagcagttgctga

SEQ ID NO: 57666 - DNA, 177 bp, Glycine max
  Peptide Sequence Number=SeqID_149351
atgggttcctttgtcgcccatggacgtcaggatgtattggctgctgccattgggcgactagaacaccttggtcatgtgcgtattgctggagctagtgtcacgatcaagcaatactttggaccagctccaaggacctcccgcacatcttcgtccatggctcccgaagacctggagtag

SEQ ID NO: 57667 - DNA, 217 bp, Glycine max
  Peptide Sequence Number=SeqID_149352
atgggctcggccaagtatgaggttgaaaaattcacagggcaaaatgattttgggctatggcgattgaagatgagagctattcttatgatggctgatggggataagaaagcactactgcagaaggcacacaatgcaattatcctcagtctcggagacaaggtgctgaggcaagtctctaaggaaacaactgctgctgggatttggttaaagcttgaag

SEQ ID NO: 57668 - DNA, 675 bp, Glycine max
  Peptide Sequence Number=SeqID_149353
atgtcgaatgcgggacggactcatgcaggtacgctacttgctcagggcttgccgccagtgcgtatgttctttccaggagaagctgcaatgtcccttgtcgtgtttgactcccatgccccgacggcgccggccgtcaccaaagccgaacgatgtgcacggagtacgctagcggctgcacagcggctcctacataccggccgcgcttcacttcgcgttcttatccagaaaccgccggatgaccgcgccgatctcggctccgtgggtttccagcgccagatggccggtgtcgtagaagcgcacgtcggcgcccgggatatcccgcttccaggcctcggcgccggcgggcaggaaaaagggatcgttcttgccccacacggccagcagcggcggctggtgcttgcggaagtacgcctggaactccggatacttctggacgttggaggcgtagtccagcagcaggtcgagctggacgtcggtattgccgggccgggaaaccaggtggctttcgagcgcaatcgcgtcgggggccacaagggtctggtccggaacgccttcgaggtattgccaccggatcgaggccggcgtggcgaactcgcgcagggcgtcgcggttggcgtgcgatgggtccttccagtatttctggatgggcgcccagcccgtccccagcccctcttc

SEQ ID NO: 57669 - DNA, 794 bp, Glycine max
  Peptide Sequence Number=SeqID_149354
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgaggtgcaatggcatgcacctgtaatcccagctactcaggaggctgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57670 - DNA, 411 bp, Glycine max
  Peptide Sequence Number=SeqID_149355
atgttacccaggctggtcttgaactcctcacctcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57671 - DNA, 282 bp, Glycine max
  Peptide Sequence Number=SeqID_149356
atgtggatctttgcttgtaaaggtttttacaaggttgaaaagaaatctcaagaaccgcaggttgcttggggactggatgtaggcacgggttgttgtcgaaccagtataaaactcttgtgtttgtcttcttcttccctattgtcgcgacctacccttcggcgggagggcgacgcagggctcacgggtgcgtcttccaagaaaggaaaatgcgcggagtcgccaccaacgtttattcaagaaaaatgtcgaaaaaactggaaaggtgtggtctacaaactttaa

SEQ ID NO: 57672 - DNA, 174 bp, Glycine max
  Peptide Sequence Number=SeqID_149357
atgcgcggagtcgccaccaacgttatttgtggaaaacgtcagaaaaaccgaaggaaaccagtcatgaagaatattccagattcgggagttgtatttatgtttgaggaaggtcgacaaaagtggggctcttgctgctacgtaccctccatcgaagaggaaatcagatctacgtag

SEQ ID NO: 57673 - DNA, 95 bp, Glycine max
  Peptide Sequence Number=SeqID_149358
atggatacctcaaagccctacactagggcaatgagaggcaccatgcatgagcctcaagtgaaccaaggggcagatcaaaagttctcacccaacag

SEQ ID NO: 57674 - DNA, 951 bp, Glycine max
  Peptide Sequence Number=SeqID_149359
atggctccaaagaaactatccacgaagaggtctagaagagatgccacaggagaaggatctagtgctgcctcagagtttgatagtcaccgtttccagagtgccaagcaccagcagcgcttcgaggtcatcaagggatggtcatttcacagggagaggcgtgtccagctcagggaagatgagcacacggacttccaggaggagatagctcgcaggcattgcacacctctagtgactcccatggccaagttcgaccctgagatagtcctagagttctacgttaatgcctggcccacagaggagagagtttgggacatgcgatcatgggtgaagggtcagtggattcccttcgacgcagatgctctcagccaattcttgggtgacccgctgattttggaggaaggccagcagtgtgagttcagccagaggaggagccagggagacggtttcgatgaggaagccatcgcccagctgttgtgcattccggggcaggatttcgctcggaccactgcgggaaggcggttgcggatcatgcgcaccagcatgactaccctgacccagatatggatgacactgctgctcagcaatgtcttgcctagcgaccacaactccgacctccctcttcctaagtgtagaatggcgcctactaggcaccctttggacccggagaagtccaacagagccctggggtttccggctttgatcacaagcctctgccagttctacggagtgcatgtcacccccagcaaggtaattcgaccgccgatcacccgagctttcatcgagaagtacttcacgcctaggcaggcgcaaagtgatgaacatcaggccgcgggtgcacagccaccacctcgacaggccggttcggctggaccactgagcatggacctcagccagcatgggcagggtttcgccccttttgtatgccctaccccggagcagtttggggctgag

SEQ ID NO: 57675 - DNA, 192 bp, Glycine max
  Peptide Sequence Number=SeqID_149360
atgagttcaacaaaaatagaagaaaatcactcaaagtgtatcaatctcacacagggcaaggattatggtaaattgggattttggctcaaggcttgtagcaaagctggacatgaaatatgtcagggtttggccagcggttcagggataaaggggatgtcccacataatttccatgatacacatgcaacaatga

SEQ ID NO: 57676 - DNA, 155 bp, Glycine max
  Peptide Sequence Number=SeqID_149361
atgtactcgcactggacgaagtacaagtgaaagataacctcacctataaagcgcatcctcagaagattactgatcgaagaatgaattcgctgagaggaaaagatatcgcgttggtgaaagtgcagtggggacccgacgagggtgattcaacctga

SEQ ID NO: 57677 - DNA, 351 bp, Glycine max
  Peptide Sequence Number=SeqID_149362
gattcacatattactgttgaacctgttcaaaggtcaaataatgttgttgtagatgatcccttgtgtgggttgattaagagcctttatgatatttacgagaagcctattgagttgttgtgggatacgactaaatttgggattccaaatgtagatgcatccttcttcttaacatattctgatgttaatgaaacaatatcaggttcatggatgagtggagctcaagcttgggtcatggttcggtgtatggattccttaagccttagtccatacacaatgcaaaggattgacgtgttgaatgtcaacattacattgaaacatggcttaaggaatcccaacgagaggtctacctag

SEQ ID NO: 57678 - DNA, 255 bp, Glycine max
  Peptide Sequence Number=SeqID_149363
atgctcaatttacttgaagaaactactcaaaaaatatcttggagacctcaagagttacacaccgcttggaaatcgacattgcctatcacttaccactggatcaactactcagaagataatttcttgcgaatggggcctaaagttgagacgcattttccaatccattcggtctcattgccttccatgctaaaattctttgccatcttgatgtttcttgtaattctgctattgttgattaccaagtgtgaagcataa

SEQ ID NO: 57679 - DNA, 583 bp, Glycine max
  Peptide Sequence Number=SeqID_149364
aacttgtaaaaggaatttacaagatagtggaactctcaagcgggttgcttggggactggacgtaggcacaaggaatgtagaaatataccatacggagttggatgagttcaaggctgaattggagaggcgtaacttccataagcgcctcaccaatttagttgacagcagcatcgacctagccttggtgaaggagttctatgccaacctctatagccctgaagggccttcaccaaaacaaacacctgtggtactggctgagggagaatccttacccgcttactctagatactgcaagatgcccactgatatcagagagattgaggttgctttgtgtatactcggtcgagggtttgttttaaatgctgaaggccatcctgggaagatcctcaggaaagatctaacaactcttgctcaggtttggagtgttctctcatactccaacctggctccgacttcccacacctcggatttgactctagatagagctaggttaatctttggcctagtctctcaactggacatgaatgtaggagctctcatctctggccagatcacatctatggcccagtctaactcctcttaa

SEQ ID NO: 57680 - DNA, 384 bp, Glycine max
  Peptide Sequence Number=SeqID_149365
atgaaaaaatggtgggctacacaccttcaaagctttgcggatttggtctttgccagtgaaaggatcaatgtgggtctgaaaagaggcaaatctgatcatcatactttgataaatgccaaaaaaactggggcaaatgaagagggtgaggatgaagaaaaagctcgtgctgtgacagccattcctatacagccaagtttcccaccaacccaacaatgtcattactcagccaataacaaactgtcgcaacctacccttccgcgggagggcgacgcgagactcgcgggatgcgtgttccacgaaaggaatacgtgcggagtcgccaccaacgtttatttgaggaaaacgtcgaaaaaaccagaaaagacgcgatctacgaacctttaa

SEQ ID NO: 57681 - DNA, 551 bp, Glycine max
  Peptide Sequence Number=SeqID_149366
ggtgtggaattgtgatgctggattttgaaatccgcacacatttcctgcatcatcttgttattcagattggtaccattgtcggtaatgatcttcctagggagtccgtaccaacaaatcagctccctcttgatgaatctgaccactacactcctcgtgacattggtgtaggaagccacttcgacccatttggtgaaataatccattgccacgagaatgaagcgatgaccattcgaagtcttgggttcgatggcccctatgacgtctatcccccacatggaaaaaggccaaggggaggacatgacgttcagaggatgtggcagagcattgacattgtccgcgaacgcttgacttttatggcatttccttacatggatgcaacaatcactttccatggtgagccagtaataacctgctctcaggatttccctggccatagcatgccgattggcgtgcgttccgaacgaaccctcctggacctccttgatcatgtggtctgcctctttggcatccacacatcgcaggagattcatgtcatggtttcttttatatag

SEQ ID NO: 57682 - DNA, 198 bp, Glycine max
  Peptide Sequence Number=SeqID_149367
atgctgatgttcgctacgggatactacttgtttgtgtggatgcgaagtctattggcaagtgcaccaggtcgtcaagcgttgggtcctcttactgagcaaattgatgcaattaaggatgtttctctaattaaagatgtttctgtgttctatgctgaaggctcaagtactaaacatggatgtctcgtgagtttagcctaa

SEQ ID NO: 57683 - DNA, 808 bp, Glycine max
  Peptide Sequence Number=SeqID_149368
cgcttgcgcgacgcgctgcgcgccattcccaacttccccggcgtgacgctgttccgtgccgagggcttcacggccccggccgccatcgacaagcgcagcgtgaaggaggagttgaccgacttttccgacaagatcatggtctgcgtgctggccgaggcatccatggtcgagcccatccgcgcggccatcacctcggcctgtcactcgggccaggtcggcgacggcctgggcgccggaatgcagggcgacataaaaaagtcatgcattccggaattgccccaaaaacgctggagtggtattcagttgttagaatacggctgtcacgccgggggtcgcgggttcagtgccgtccactccgccagatcaagggggtatagctcagctgggagagcgcttgcatggcatgcaagaggtcatcggcctaggacatcaccctttcacggtgagtaccggggttcgaatccccgtagggtcgccaagtttgcagcacttggctcgaaagagcgcaaaagctgtctgccaggagtggtagttcagttggttagaataccggcctgtcacgccgggggtcgcgggttcgagtcccgtccactccgccagattccttgtgcagaccctcgtgtttgcgcagacaagaagccaccgcaagggcgtccatctttcaccgactcgtctgccccgctccatgcgccttgcgccatcgtttgtcttttcgttgctgatgctgctgtccatcttctgcgggcaggtggcagcttcggcatcttccgatggactggaaggcgatggcctgctggcgcaccatccc

SEQ ID NO: 57684 - DNA, 507 bp, Glycine max
  Peptide Sequence Number=SeqID_149369
atggcttctatgatggaggccatgctaggaatgaggcaactcatggagaaaaacatggccaccgctgccgctgtcagttcggctgccgaagcagacccaactctcctagctaccgtgcaccatccttccccaaacgtagtaggacgagagaagagtacacaggggcacaacagcaacccccatttgggatacaatcgggtggcttacccttatggattgctgcctaattacacgccgccagtcatgcacgatgacgtgggtcatgtctcttcccccatccttgaaagggagcctcctcaacagccccacgaggcccatgaagatcatcaagagcatgcccaaggggatgttgatttctatcccccgatccccgttgaggggccgacgcccaatacattgcctcagcacaacctcacagcacagccagtattcttgtccacggaaggaccacccccggcgaccgaagaaagaaggaaactcgatgtcctcgaggagagattgaaggct

SEQ ID NO: 57685 - DNA, 699 bp, Glycine max
  Peptide Sequence Number=SeqID_149370
gctgccgtcccttgggacgggcgtgtggggtgctaataccttccccgtgcgtaaatacaactcccgaacctttcaccaaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacaaggcccaaatgttaaaaccaacccgctagctagtcatggaggtgctagcgtgaacgccgtcgtagaggacgggccatcacggacaaagaggttgggagacgtggctacttctagatgcttcatctatcaatcactgcaagcggcgtgcatggtctcccgagatggagatgaaagggatgaatgtttgtttcacctcggggagtcgcatgacatggaaacctgtcccgtggtggaagaattgcttcagcggctcatggattgcgggcagcttgaagtgttcataggagggaaggaagaaccacaaatttgcatgcagtcggaagagaagaaggttcctctaacccccaaggccctagtgatatgttttactaggaaagggaacggctccacacccatatacccgcgggcggcgcccaagccaacgccatttgcatatcaaagtgataaggccgttccgtggaagtatacccctcccgc

SEQ ID NO: 57686 - DNA, 1332 bp, Glycine max
  Peptide Sequence Number=SeqID_149371
atggcgctgattgtactgtcggtggtgattgccaccatttcggtgacctcgggcgtggataaaggcatccgcatcctgtcggagctgaatgtcgcgctggcgcttggtctgattctgtttgtgctgtttatgggcaagacggatttcctgctcaacgcgctggtgctgaacgtcggtgattacatcaaccgctttatgggcatgacgctcaacacctttgcgtttgatcgtccgacgcagtggatgaacagctggacgctgtttttctgggcgtggtgggtggcgtggtcgccgtttgtcggcctgttcctcgcccgtatttcccgcggccgtaccatccgcgagtttgtactcggcacgctgatcatcccgttcaccttcacgctgctgtggctgtcggtgttcggtaacgcggcgctgtacgagatcatccacggcgatgccggttttgcccaggaagtgatggcgcatgccgagcgcggtttctacagcctgctggcgcagtacccggcgtttaagttcagcgcctcggtcgctacgattaccggcatgctgttttatgttacctcggcggattccggctcgctggtgctgggaaacttcacctcgaagctgaaggatatcaacagcgatgcgccaaactggctgcgcattttctggtcggtggcgattggcgtgctgaccatgggcatgctgatgaccaacggcatctctgcgctgcaaaacaccacggtgatcatgggcctgccgttcagcttcgtgatcttctttgtgatggccgggctgtataaatcactcaaagtggaagatcaccgccgcgccagcgccagccgtgataccgcgccctatattccggcgagcaatgaccgtctgagctggaaaaagcggctgtcgcgcctgatgaactacccgggcacgcgctatacccagcagatgatggaaacggtgatctatccggcgatgcaggatgtcgccaaagagctggagctgcgcggcggtcgcgtattgctggagagcgttgcgccggaagagggccagccgctgggctaccttgatctgcgcgtgcacctcggcgaggagcaggatttcgtctatcaggtgtggccgcagcagtactcggtgccgggctttacctatcgcgcccgcagcggtaagtcgcactattaccggctggaaaccttcctgctggagggcagtcagggtaacgatctgatggactacaacaaggagcaggtgatcatcgacattctcgatcagtacgagcgtcacctgaactttatccatctgcatcgtgaagcgccgggcagcaatatcacttacccgagcgtgtaa

SEQ ID NO: 57687 - DNA, 602 bp, Glycine max
  Peptide Sequence Number=SeqID_149372
ccaagattaaagcccgcgtgcagtccattcgcactcaaatcgaggaagccacctcagagtatgacaaggaaaaactgcgggaacgcgtggccaaactggcgggcggtgtcgccgtgattaaaatcggtgctgccaccgaagttgaaatgaaagagaaaaaagaccgcgtggatgatgccctgcacgccacccgcgcagcggtggaagaaggtatcgtcccaggcggcggtgtagctctgctacgtgcgcgcagccgcatcagcgcactcaaaggtgagaacgatgaccaggaagcaggtgtgcgtattgtgttgcgtgcaatagaagagcccttacgcgcgattgtgaaaaatgccggtgaagagcctactgtcgtcatcgccaaagtgcttgaggcaacaggtaataccggctacaacgcagccaccggtgaatatgtggatatggtggaaaccggtgtggtggaccccaccaaagtcacccgcactgcgctgcaaaatgcagcctcgattgccgggctgattttgaccaccgatgccacggtggctgagttgcctaaagaggagaaaaagacctcggctgtgcctgaaatggattactaa

SEQ ID NO: 57688 - DNA, 843 bp, Glycine max
  Peptide Sequence Number=SeqID_149373
gaattgaactgcgggaagcaagtcgaaaatggggtggttggggtaccaaggaaatgtttggaagtaaaggcgagagtcttggcaagtcaagacgaatgggacccgttcatggacatcatggcacttttgatcttcggggtggtcctctttccaaatgtggatgggttggtggaccggacagcgattgacgtttttctcgccttttacgaccgcaaggaaagcccggttgtcgctatcttagccgatctatatgacacattcaaccgaagatgtgagaagaacaatgcaaggatcatttgctgtacaccggctctctacatatggttggtttcgcacttctttcgccaagagatgagacacgtttgcccgctagaaggccaccgctcatgcaccgagaaaaaagaggcaaactgggaccgactcttagcaagcaaagaaggagtgtctgtcaattggttcccccgatggaaggaaggaagaaccgggactcttatttcgtgtgggaaatttccaaatgttcccttgatggggacgaggggttgcatcaattacaatcatgtcctcactataagacaacttgaaatgccacaaaggaaggacaaggaacttagggggagtagcaatgggcccatcggcggttaccataggtggttgaaagcctacgcacaagatctggattggctcccaagtttgaggaccactaaggggatggagggtgaaactccggaagaagacgaagaagagaacgccgaactgagagacgtcaatatagccaccaccaaggctttggagcaagagaccaagaaggcccgtaaggaagaacatggatggaacaaattctga

SEQ ID NO: 57689 - DNA, 242 bp, Glycine max
  Peptide Sequence Number=SeqID_149374
aacctgccccaagacacagcagacacttgtgcatacaggatgctgctgctgctgttatacgaaccggctctccacacaatcgagagaatgttgctgctgtcttgtggtcactatgcaccggagatccactgcaattaaaactagcgaaagaacatggtgcagaagcagcactgcaggagttgtcagaaaatggaactcatagagctaagataaaagctggaagcatattggaactcttgtag

SEQ ID NO: 57690 - DNA, 366 bp, Glycine max
  Peptide Sequence Number=SeqID_149375
atggtggtgcgcgttatgctcaggaacggatttgagcccggaatgggtctaggcaaggactgcctcgggaatgccgacgtggtcgatatcaagggaaatccatacaagtatggattagggtatgaacccgggatgcaggggaggaggaacgtgccgtcaagatttcgggcggatagggtgtggcccggccgtattagccagtgtttcaccagcactggaatggtgtccgaggaggaggtggccgcaatagaagaggagttccctcaagatccaccaagttttgtgcaaccatgccaccccgattcccaagtggggaactggcgcgtgataagccagtcagaagtctataccgctgattcaatgtaa

SEQ ID NO: 57691 - DNA, 417 bp, Glycine max
  Peptide Sequence Number=SeqID_149376
atgagtacctcatcctccatcgcttcaaccagaatcagatatccaattgtgagaccacctgcaatcatgcaattcaggacattcatagagatacccctattttaccatgaacaatgggcacccaattacccacacgaagttcggttcaaatacaatggagcaacctacccaatacggatccaacaacaccgaggcagatatttttttgcagatggactctcagacgtcagggcagatttaaaaatctacgagtctattatcatcaacttctttgcctacgatgataacaccatctttgatctacattttacacctcccctgaatcaacaaacatgtggtagaccaatacttcattcccgtgtacatgcccggagaactgaaattacccaatgtatacgggatgctccccaaccaccg

SEQ ID NO: 57692 - DNA, 93 bp, Glycine max
  Peptide Sequence Number=SeqID_149377
atgttttacggcgtctcttaccgaactcgtgatagagctagagtaatgggtaaagtagagaaggtgcaagagcagatgaaggccgacatggag

SEQ ID NO: 57693 - DNA, 244 bp, Glycine max
  Peptide Sequence Number=SeqID_149378
aagtttaaaggaagagaggaatgcaaacttgatttatactggttcggccacttcccgcgcctacgtccagtcctcaagcaacctgcactccctcaccttcgtagggctacacgccctcacctttagaggactacacgtcctcaccatcagaggactacacgtcctcaccttcagaggactacgcgtcctcacatcagaggactacacgtcctcaccttcagaggactacacgtcctcaccttag

SEQ ID NO: 57694 - DNA, 541 bp, Glycine max
  Peptide Sequence Number=SeqID_149379
atggataatgaagagggcgtgcaggaacagatgaaggccgatctatcggccttaaaagatcaaatggcttccatctcagaggtcatgttaaaactccagaaaaccatagaggataaagccaccgcaaccgcctccagtacagttagggaagcggaaccggtgctgcagcccgccttgaatccgggcctagacagaaacacagttgtgttcggtcgaaggtatagtccgcaagcttatccttatggcctcccttcggacttcaccccccgtgccaccccggaagatttaagccaagcccctacttttgaggggcaactcccaccttatgaagactatcccgggcaagacaatggagaaggagatacccatcgtggccccctgctccacctcaaagatccatccccgcatgaactaccccagccgaacatagcccgtcatatctcggcctcacccacacctgtaaaagaatctgttccctttgcagaagataagggaaagattgaggcgcttgaggagaggttaagagcagtcgagggcctcg

SEQ ID NO: 57695 - DNA, 384 bp, Glycine max
  Peptide Sequence Number=SeqID_149380
atggggacaaggggttgcatcaattacaatcccgtcctccctataagacaacttggctaccctatgaggggggcaccactagaggaagacctcatgcctattattgcacgaggtttcaatagcactaacgcgaaggcaattcagaaggtccgcaaggcatgggagatggagcaaaaaaaggacaaagaactcagaggcagtagcaatgggcccatcagcggctaccataggtcgttgaaagcctacatgcaaggtttggattggctcctgaatttgagaaccactaagggggtggaagttgaagtttcggaggaggacgaagaggtgcaggccctcaggacaaaactcgagaaaacccaaatagtcaaagaaaagttcaaataa

SEQ ID NO: 57696 - DNA, 187 bp, Glycine max
  Peptide Sequence Number=SeqID_149381
atgttggcaacccattctggataccgagcgatggccaaaaaaccagcgtcaaattgcttcctcacttcttttatcttcaaggattttcgggcttcatccttctcagtttctgctttaccggggaacactcgggatttagaggtaatcggtgctgtacaatgtcagaactcaaactgggcatatcttg

SEQ ID NO: 57697 - DNA, 849 bp, Glycine max
  Peptide Sequence Number=SeqID_149382
atggcttctaggaaatgcaagagtatcggttcaagacccacaacacaatatgctagaaggagatttcactccttagatgcttggaactggtacacgaataatgtcctggggagaaacatcttgctagagaggaaggtggagctctaccacactgagttggatgattttaagactaagttggagaggcgtaatttccataaatgcctcaccaatttggttgatgggagcatagatttggctttggtgaaggaattctatggaaacttatatagctctgttggtccttcaccaaagcaagccagggtcagaggccacctagtgaagatcgacgctgacaaccttaacacattcttagagacacctgtggtgttggcagagggtaagactttacccacatactccagatactgcaggctgcccacagattacagagagattgaggctaccttatgcataccaggccgagggttcatcttgaacgctgagggccatcctgggaggatactcaggaaagatttgactactttagcccaggtgtggagtgttctctcatactccaacttggcccccacatcacatacctctaatctaacagtggacagagctaggctgatctttagcctagtctctcgcatggacatgaatataggagctcttatgaaaggatctgactcttcacaattgaatttgaattccaacgttcagatgcactggatgttgtcaccagaggttcgcctaataggggagagttcaaatgacaatcctgctcatctccatggtgattctaacatcactagtgaccaagtctccagcgttcacattggtaatgtcgttgctagtggtgtcatg

SEQ ID NO: 57698 - DNA, 611 bp, Glycine max
  Peptide Sequence Number=SeqID_149383
ccgatcaggacgatgtggaggacactgtctatgagaaatacaacataagcaaggaaaaatgggcccaactttgccagactcgcagagacccttcttgggaggatgtgcgcaagaaggcacaggccatccagaagcagaatactgccccccacgttttgtctcgtgggggttatgactatttggagcagaagctcctggctgagaagacaaagaagaagctggaggaagctgcacaatcaggaagtgttgatggcgtcatcgacccttcatccccgatcagacgccacgtgaagtggaagatggcccgcacgaagaaaacaggggagatgacgactgaggccgcgaaggaaatcgttgagaaaatcgattcctttgaggagcaggcgacacagggatccttcatcccccatggacgtcaggatgttctcacccctactattggatgtccaaagcaccctggacgtgtccgtgctgctagagtcggtgtcaccatcaagcaatactttggatcgactccacagacgtcccgcagctcttcctccctgcctcctgaagaattgcagcagctgacccagcaaatcagggaccagctagaggagtccatcacataa

SEQ ID NO: 57699 - DNA, 655 bp, Glycine max
  Peptide Sequence Number=SeqID_149384
atggaagagggattttcccatggttcagttccaattatttttagcaggccatttatgaaaacaacccaaaccacgatagatgtttatgctggcacattgtctatggaatttggtgatattgttgttcattttaacattcttgatgccatgaaacatccatctgaggatcattctatttttcgtgctgagataattgatcagattgttgacgattatatgtttgattttgattttgttcttcatggtaggaaacatccatttttatctgatctgcatacttgtcattccttatgcattgaatctaaatctgagtttgaatttgatcctatatctgatttttatgcaaagagtaaatttgaatttgagtctggttctgattttctgggtgttgtacctcttgatgttgattttttagagtcaaaatgcactaaccatgttgtaggaagtacatatacttctgactttctttatgagccagcacccacactagagttgaagcccttaccaacaaccctcaaatatgcttacttggaggacaaggaaaaatttctagtaatcatctttgcctcctttgttgctgagcaagaggagaagttgttgctagtgctcaagaagcacaagaaagctattggaaggactttagcagacattcctg

SEQ ID NO: 57700 - DNA, 575 bp, Glycine max
  Peptide Sequence Number=SeqID_149385
atggctacctcaccaaaagaaacttcagcttctggttcaccctctgtaccatcatctccgcaccaggaacaacctgaattcaacatccaacccatacaaataattcctggttcagcccctgttcctgaaaaactggtccccaaacgacaacagggagtgaagatttctgaaaaccctagccttgcaacaagtcctagggaagtagacacagagatggacaagaagatccgcagtattgtgagtagtattctgaaaaatgcttctgttcctgatgctgatgaagatgttccaacatcttccaccccaaatgtttctgtgcctgatgctgataaagatgttccaacatcttccactccaaatgctgaagtcctcccttcacccagtgaagaggaatcaacagaggaagaggatcaagccacagaggagacccctgcaccacgggcaccagaacctactccaggtgacctcattgaccttgaagaagtagaatctgatgaggaacccattgccaacaagttggcacctggcattgcagaaagattacaaagccgaaagggaaaaacccccattaagag

SEQ ID NO: 57701 - DNA, 184 bp, Glycine max
  Peptide Sequence Number=SeqID_149386
gtcgactctagaggatcccactactccaggccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 57702 - DNA, 954 bp, Glycine max
  Peptide Sequence Number=SeqID_149387
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaagatgcttaatgaattacaacagtactgcgatgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57703 - DNA, 261 bp, Glycine max
  Peptide Sequence Number=SeqID_149388
atgatcatgagaggtcaagacatctatagtagcgaagaggaggctacttcttctccttcctcaagtggaagtgagggtgaagccaagggtgatgagcatattgaagaggtttacccctatgaagaagggcacattttcttgggtagaccatggcaatttgagaagaaagcaacccacaatggtctcaccaatgaaataaccctcacccatggaagcaaaaaaattcaaacttgttcccttgacaccttcacaagttgctag

SEQ ID NO: 57704 - DNA, 255 bp, Glycine max
  Peptide Sequence Number=SeqID_149389
atgaatatcgaggaatccattcatattacctttgatgaatctaatgctatcttgtcaagaaagaatatgctagatgatattgcagattctttagaacatatgaatattcatgaacaagattccaaaggaaatgataaagaaacaatgaagatcctccagaagaagtcaaatccaatgatgaacttccaagagaatggaaagcttcaagagatcatcccctcgacaacattattggtgatatctcaaaaggggtaa

SEQ ID NO: 57705 - DNA, 436 bp, Glycine max
  misc_feature (49)..(49): n is a, c, g, or t
  Peptide Sequence Number=SeqID_149390
cggatgccgggagcagacaagcccgtcagggcgcgtcagcgggtgttgncgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccacaaaactcaatgagcagaacgcttcggaacggaatgggatcaaagcccgacgaacccatcagtacggtggggaagtctattccctctcaatcaatgcccgggaagggaactatgagaaaggcacttcaagaatacatatggagataggccatttagatagaccgattccaatagcgtcccgcaaactaccgggaagccaactacatag

SEQ ID NO: 57706 - DNA, 267 bp, Glycine max
  Peptide Sequence Number=SeqID_149391
atggcacatgaaaaccccccatacttagccttttgcactcctgggcaaaatgaaataaagaacaaaatccaaggatatcaaagagaggcaaacaaaaacatttacatatttctcaatgaacatcaaggaatgaaaggaatggagcattgtgttcccgtgtcctctagcatgaggttcttcatagtcatccacctattcatctactcccctgaacacaaagttcaagatcatcacaggatccaaacacaaacaacacacagggagtga

SEQ ID NO: 57707 - DNA, 204 bp, Glycine max
  Peptide Sequence Number=SeqID_149392
atgggacaccttagtgatcaaggggttcccacggactccaagagaataaaggtcattcctgagtggcccactccaccaagtgttgaggaaagaatccctgagtttcaagaacctatgaatttgaggtcaaatccttttcaagggggagggaatgatgcaatcctacccccaagggcattggatagaagactccaagaagattga

SEQ ID NO: 57708 - DNA, 285 bp, Glycine max
  Peptide Sequence Number=SeqID_149393
atgaaagaaataagtcaagatgaaggagaggaaataagaggggaagaaagaaggaaaatactaaaagagttaaggaaagaaaagcatgcctcctgtagtagtcataactcttgcaagagcctaagtgaagaaatttgtgactattatgaaggaaggcataggtcacatcttagacctcactcctataggagagaaaaggaaagaaagcctcaagaggctaacattaacctcccatacttccatgggaaggacaatgtagaggctaacttagattgggaaataagg

SEQ ID NO: 57709 - DNA, 399 bp, Glycine max
  Peptide Sequence Number=SeqID_149394
atggagtgcctagagggagcttgggagaccctcgaaggcaacacgaggtgccgatttcggggcacgattcgattcacggctacttctttggtgcatctagatgaacccgtgcgtacgcttcagcgcactgtagagtggatactacccacgcctacaccataccgtctagtggagccagtccaagtgatcgaggtgacgtcatccgaggaagaccctgaggaggatcccgaggagctaccgtctgagcctgctgtggatgctattaactttctagagggcaatgaggacccacttcctgaggtggattctcccgaggaagtcatgtcggcatctgaggtagactctacggaggatagtggctcgagagagatggcgaccagtggaggctcttcatcatag

SEQ ID NO: 57710 - DNA, 375 bp, Glycine max
  Peptide Sequence Number=SeqID_149395
atgttggtgcgcatgatccgcactcgtctctttgcagcggcacgggtgaaatcttgccccagtatgcatagtagcagtgtgatagcctccctctctagttgtgctcgcacagttggcgctcctccaatatcagggggtggcccaggaaccgttaaaaggaaactactggtgtggatatggagcccactgaaagtgaggacacgtagtcctctaaaggtgagggcgtgcagccctttcaaggcgaggatgtgtagtcctctagaggtgagggcgtgcagccctctgctggtgaggacgtgtagtcctctcaaggcgaggacgtgtagtcctctcaaggcgaggacgtgtagtcctctcaacggtgagggtaactag

SEQ ID NO: 57711 - DNA, 642 bp, Glycine max
  Peptide Sequence Number=SeqID_149396
atgagtcttcattcttcatctagtgttaatggtgagggttctactcctaaggaccccttaaaaacaagagagaaaagaaaaaggaaaaaaagagtggaagaaataagtcaagatgaaaaagagaaattaagggaagaagaaagaaggaaaatactaaaagagttaagaaaagaaaaagatgcctcctatagtagtcataactcttgcaagagcctaagtgaagaacttcgtgactattatgaaggaaggcatagggcacatcctagacctcactcccattggagagaaaaggaaaaaaagcctcaagaggctaacattaacctcctatacttccatgggaaggacaatgtagaggctaacttagattgggaaataacggtagagcaacaacttaaaaggaagtctacttcaaaatcttatggctctcactcttatccaaagaaagaccaaggtcaagacatcttaggggtgacaccttctaagcccaaagatgataaggggaagacagtagaaaagcaaccccttaaggctagtatgcaagagaagactagctccataaagtgctttaaatgtcttggaaaagggcacattacttctcaatgccccaccaagaaaaccatgattatgaggggcccaaaatag

SEQ ID NO: 57712 - DNA, 261 bp, Glycine max
  Peptide Sequence Number=SeqID_149397
atgtcgctgcatattcttttatttttgtgtgttcttcttggtttcccccagggattcatgtctgctgggcagaatcgtcttaggccgtggtcagataccgggactaagctgaaggcagaaaccaatcaaggtaaaacggtacttagggacggacgcaagcagaggctagggtcacgaccgatagatcgtcatcccttgcctagctttggagaaacgttaagcgccgctgcagggcagccttatcctttgaattcccggtag

SEQ ID NO: 57713 - DNA, 204 bp, Glycine max
  Peptide Sequence Number=SeqID_149398
atgactatgagtgaaatattgagtgctggcatggaatttgacaatgtagttgcaatattggaattttggtatgaatatgtatcaacaaactggagaacccatttgagactctctgaaattggaggaaataaaaaggaaaaggttgaattagaaaagaagatggaaagaacaacactacaagtttgtttattgcaaagagagtaa

SEQ ID NO: 57714 - DNA, 210 bp, Glycine max
  Peptide Sequence Number=SeqID_149399
atgggtctccgaacaagatttgagggtggaggattggcgaacagtgctaggcaatcaattcgtggggctccaggctcgatggcgaacaacgctaagcaattaattcgcgggtgtcgcaacctacccttcggcgggagggcgacgcgagactcgcgggatgcgtgttccacgaaaggaatacgcgcggagtcgccaccaacgtttatttga

SEQ ID NO: 57715 - DNA, 388 bp, Glycine max
  Peptide Sequence Number=SeqID_149400
atgaagggtatacgaaagaaggcccaggaaattcaaaaatttaatgactgccctcacgtactgtctcgtggggggtatgaactgcttgacaagaaacttatggaggagaagagcaagcgtggacatgaggaacattcgtgtactgaaagcccaacactcaacgtcgacccaccatccctagttgcaagacacttgaagtggaagatcgcccgcactaagcggcatggccaaatgacgtctgaagtggcacaagaaattgcagacaaaattgattcattacaggaacaagcaacacaggggagttttgttctgcatgggcgacaggacatactcaacacggcccttgaccgacctgagcatccaggccgtgttcgcgtcgcagggacag

SEQ ID NO: 57716 - DNA, 766 bp, Glycine max
  Peptide Sequence Number=SeqID_149401
atttcctacatctaatgtcctcgccttcagagggctgcacaccatcgccttcagggggctacacatcctggcctttagaggactacacctcctcgccttcagagggcttcacatcctcgccttcagagggctactcgccctcgccttcagaggactccacgtctccgccttcagaggcctgcacgccctcgccttcagaggactacaggtcctcgtcttcaaaggactacacgtcctcgccttcagagggctggatgccctcacctttatagggctacacgccctcgccttcagagagctacatgccctcaccttcagacggctacatgccctcacctttagaggactacatgtcctcaccttcagagggctgcacgccctcgccttcagaggactacaggtcctagccatcagagggctacacgccctcgccttcagaggactacacgtcctcgccttcagaggactacacgtccttgccttcaaagggctacacgccctcgccttcagaggactacacgtcctcgccatcagaggactacaaatcctcacctttagagggctacatgccctcaccttcagaggactacatgtcctcgccatcagagggctgcatgccctcgccttcagaggactacacatcctccccttcagaggactccacgtcctcgccttcaaagggctgcacgccattgccttcagaggactacacgtcctcgtcttaagaggactacacgtcctctcttcagagggctgcacgccctga

SEQ ID NO: 57717 - DNA, 410 bp, Glycine max
  Peptide Sequence Number=SeqID_149402
tcagaggactacacgtcctcgccttcagagggctacatgtcctcaccttcagaggactgcacgtcctcgcctttagagggctacacgtccttaccttcagaggactacacgtcctcacctttagaggactacatgccctcacctttagagggctacaagtcctcgccttcagagggctgcacgccctcgccatcagagggccgcatgccctcaccatcagagggttgcacgccctcgccttcaaaggacttgcgctcccgattaaggggcgagtagttcaaccgttcttgggccaccctctgatcctggaggagcgaccaactgtgctagcacaacttgaaagggaggctatcacgcagctactatgcataccggggcaagatttcattcgtgctgctgcaaagagatga

SEQ ID NO: 57718 - DNA, 564 bp, Glycine max
  Peptide Sequence Number=SeqID_149403
atggcttcgaagatacaaatattaccagtcgtaggcgtggtggccatgtatatcatgaattcaattattacagtcttgtatttcaacggaagagtatatgaagacaatgatggtgtaatatttgaaggcagtaaaaaggcgattcagattaaacgcggaaatagtttcaatgctttgaaaaaaaaaattggagataagcaaatttgtgatgacgaagatgttgaaactatgatcgaaatttttcaacaacaacaacaaatgttagttctagaattgtacgtagaaaaggatgttgctggtggttctatgtttcatgctgcaaattctgttacgtcatgtggaggtaatgtatctcatcatgagtcggaactgccaagaaatataagcaatttacatgttgatgaagatgatgatgatgatgattatcttgcatctaactcatacgttgaagagtctttcgatgaagatgatagtgatgatggaatatctgatacagacgatgaagtcactgacatcgttgaaccagtttcaattgttcacccaagcgaaggtaaatgtttgtga

SEQ ID NO: 57719 - DNA, 162 bp, Glycine max
  Peptide Sequence Number=SeqID_149404
atgtttcgggaagaaactggtcaaaaacacgaaaacgggagtgtatttagcaaagtgggggccttccggaacattttcgaagttgggttgcttaaggaggaagcaactgggaggcaagctcctccatattttgttgaaaaatggtttccgcggcttccgtaa

SEQ ID NO: 57720 - DNA, 423 bp, Glycine max
  Peptide Sequence Number=SeqID_149405
atgccaatgaacgctattgataagaacatcaaattcgtcaacgcggatgccaaagttgacgaagctgccaccaaaccttttgccaaatcgcgcaaaatttacgttgaaggttcccgcccggatatccaggtgccattccgtgaaatttccctgagtgatacgccgtcgagctttggtggtgataccaatcctccagtggtggtttacgatacatcaggcccttacaccgacccaaatgtcgagattgatatccgtaatggtttgccagccttgcgtgcgcagtggatcatggagcgtggcgatgtcgagcaactggatggcccaacttccgaatttggtcatcagcgtctggttgacccgcaattggcggaaatgcgttttaacctgcatcgcaaacccctgcgagcaaaggccggccagaat

SEQ ID NO: 57721 - DNA, 414 bp, Glycine max
  Peptide Sequence Number=SeqID_149406
atggggtctttcgcaacctacccattgacgggagggcgacgcgagactcgatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57722 - DNA, 646 bp, Glycine max
  Peptide Sequence Number=SeqID_149407
atgaatcatttaaaaacgggattctccttttttagtccaagtgcttataagaattacaagtacaacggaaaagagttacaggagacaggaatgtatgattatggagcaaggatgtatatgagtgatattggaagatggggagccattgatcctctagccgagcaaatgcgtcgtcatagtccttataattatgcgtttaataatccaattagtttcatagacccggacggaaggcagggaacagactggatcaagaaagataatcaatggacttatgatgctaatattacaactgcagctcaggcaaaagctgccggagcagatgattttgctaaaaatggaactgtgatttcagatgctaaaattggttccaatggggaacctgggtatgtaaaattgggtgaagggggaaatgcttcttattcggactttaatggttatattggcagtgtaatgagtcaaattcaaagctatactgctggaaattacgtaagagagactccatcattaaacactcaggagggtgcatttgctaatccttcggctcaattggcttctactatgcttagtgctatgcaagaagcgccattagccgttgctccagaattaattgctgctaaatattttagaggagtgacattttatc

SEQ ID NO: 57723 - DNA, 917 bp, Glycine max
  Peptide Sequence Number=SeqID_149408
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataattatcgcaaatctgacagagcgtacagcacgtggggacttgatctattcacatgctttgtataaagcattgcaagaagaattggtagcattattggctcctcgtgtgaagccactacatattgatcctaacaagtctccttatgtcattttaatggtaggtgtaaatggtgttggtaagacaacaaccattggtaagcttgcaaaacgtttacagggtgaaggaaagaaggtcatgcttgccgctggtgatactttccgtgccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 57724 - DNA, 347 bp, Glycine max
  Peptide Sequence Number=SeqID_149409
atgggtgaagtagaggagatacaagagaagatgaaggccgacgtggaggccattaaagagaaaatggccacaatgatggaggccatgatgagcgtgaagaagataatggaagccaatgcggttgcaatttccgctaccagcgttgttgctaaggtgaacccgacgtccccatccggcatcaatgaaccatccaacctcagatatgaaatgggaaagttggatcatctagaggaaaggctcaaggccattgaaggaggtaaagattatgcctttgctaacctagaagagttgtccctagaacccaatatcatcacccctcccaagttcaaggagctggactttgacaa

SEQ ID NO: 57725 - DNA, 147 bp, Glycine max
  Peptide Sequence Number=SeqID_149410
atgaggtgggttaagcgtgcatccatcgctaagtgcagcttcagcgcgcttagcgcgacagaagaatctggtaggacatcatcatcaaggtcgagcgctaagcgcagcagttgtcttcagccaggctctacgcacaactggcactaa

SEQ ID NO: 57726 - DNA, 387 bp, Glycine max
  Peptide Sequence Number=SeqID_149411
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgattttagaggagttagtcttgaagtcatgcgccggttaaggctaaactga

SEQ ID NO: 57727 - DNA, 286 bp, Glycine max
  Peptide Sequence Number=SeqID_149412
gggtagcgcccacaagacacccagtggacttggaggagcccaacagggccctggggtttccgactctgggatcacgcccgcaagacactcagtggacccggagaagtctaacagggtcttggagttgccagctctgattacgggtctctgttggttctacggggtgtctgtcgcccccagcaaaggtcatcaggccctcctaccaatcgagctttcattaagaagtactgcgcccccaggcaggcgcagggcgaagcacccacagcagcattgggatggtcggtag

SEQ ID NO: 57728 - DNA, 501 bp, Glycine max
  Peptide Sequence Number=SeqID_149413
atgacacgcagagacaaaatttggtcattctgcacccttgtgtcatccagaggcggcgggcccgatgacacgcggagataccttacggttatccgcacccttttaggcggcgggcccgatgacacgcggagacaccttacggttatccgcacccttgtgtcatccagaggcggcaggcccgatgacatgcggagataccttacggttatccgcacccttgtgtcatccagaggcggcgggcccgatgacacgcggagacaccttacggttatccgcacccttgtgtcatccagaggcggcgggcccgatgacacgcggagacaccttaaggttatccgcacccttgtgtcatccagaggcgacgggcccgatgaaacgcaaaggccagtgaggtcattctgcacccttgtgtcatccagaggcggcgggcccgatgacacccggagataccttacggttatccgtacaccttttgtcatccagaggcggcgggcccgatga

SEQ ID NO: 57729 - DNA, 1050 bp, Glycine max
  Peptide Sequence Number=SeqID_149414
atggcgcttctggccgccagccacattgacgacgcgtggctgcagcagcacgggctggacgacacgcagcggcagcagtttctcgccctctgtccacgccagctggaaaaaacgcagcgctggctgcaacaggcgcaacatcatctgatcgcctgcagcgatgcacattatcccgcccggctgcgggaaatcagccgctatccggctgccctttatatagcgggtgacctctctgcactcgcgacaccgcagctggcggtggtcggcagtcgtcactgttcaccgtatggcagagaatggggcagctggtttacccagcagctggcgctaagcggtttgaccatcaccagcgggctggcgcgcggtattgatggcgtggcgcatcgtgccgcgctggaagtgcagggcaaaaccctggccgtgctgggcagcgggctgaatcatctctatccgaaaagccatcagccgctggcacaggagattatcgccaacggcggcgcgctggtttcagaactgccgctgtcaatggcgccccatgcggtaaattttccgcggcgtaatcgtattatcagtggcctgagtcatggcgtgctggtggttgaagcgtcactgaagagtggctcgctggtaacggcgcggtatgcgctggaacaaaaccgtaacgtgtatgcgctgcctggcgcgctgggtaatcccggctgtgaaggcacgcactggctgattcagcagggtgcgctgctggtggcgcatcccaacaatatccttgaggatttgcattctgccctgcaatggttgccggccagcatctcagaaacaatatattcacaactcagtgatgatgtgccattgccatttcccagcgtgttggctaacgtaggtgatgaggttacacctgttgacgtcgtcgctgaacgtgccggccaacctgtgccagttatcgcagcgcaattgctggagctggagttagcaggatggatcgcagctgtacccggcggctatgtccgattgaggagggcatgccatgttcgacgtacttatgtacttgtttga

SEQ ID NO: 57730 - DNA, 438 bp, Glycine max
  Peptide Sequence Number=SeqID_149415
atgacaccggtaaaccgaaaggcaggaacaggagagcgcacgagggagccgccagggggaaaatcgaattcctgcagcccgggggatccactacttctagagcggccgccaccgcggaggagctccaattcgccctatagtgagtcgtattacaattcactggccgtcgttttacaacgtcttgactgggaaaaccctggcgttacccaacttaatcgccttgcagcacatccccctttcgccagctggcgtaatagcgaagaggcccgcaccgatcgcccttcccaacagttgcgcaacctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57731 - DNA, 848 bp, Glycine max
  Peptide Sequence Number=SeqID_149416
tcatcttcagagggctacacgtccccgccttcagagggctacacgccctcgcctttagaggactacatgtcctcgccttcagaggaatacacgctctcgcctttagaggactacacgccctcgcctttagaggactacacgtcctcgccttcagaggactacacgtcctcaccttcaatgggctacatgtcctcgccttcagagggctacacgtcctcaccttcagtggactacacgccctcacctttagaggactacacgtcctcgccttcagagggctacacgtcctcaccttcagaggactacacgtcctcccgtttagagggctatacgccctcgccttcgtagggttagatgccctcaccttcaaagggctacacgccctcaccttcagaggactacacatcctcgcctttagagggttgcatgccctcgccttcatagggcaacatgccctcgccttcagagaactcaagctattatgcttaccggagcaagatttcacccagccgctgcaaggagatgagtgtggatcatgcacaccaccacaactccgatctacccctgcaaaagtgttagttggtctgtgtcgtcatgacatagttgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaaggaagagggagagaagagcacgaaattttgtgctctaaatga

SEQ ID NO: 57732 - DNA, 237 bp, Glycine max
  Peptide Sequence Number=SeqID_149417
atggaccgtattctgaaggaaaaaatctcatgtaggtcttcaagtacgtgtaacctcggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 57733 - DNA, 252 bp, Glycine max
  Peptide Sequence Number=SeqID_149418
atggggaaagagatgataacaatgatagttgacacattaccagtgttctactatgaaaaggtggtgggttacacacctttaagctttgctgatttcgttttcgtcggcgaaaggatcgaagtgcgtctgagaagaggcaaatttgattatcctgcattggtgaatgaggaagctgcggcaaatgaagagaatgagaaggaggaaggaatccatgttgtgattgctgttcctacatggctaaatttctcgtaa

SEQ ID NO: 57734 - DNA, 390 bp, Glycine max
  Peptide Sequence Number=SeqID_149419
atgtcagaattcacaagcaattctcctcgaatttcagccaacccgcatcaattagaccttgcaccttatgcttcagggtcatacaatgctcaatggaatgccccagaactcctccatgataagcacatgtggcattcgagttgtatcctcggaaaaatggagggtggtgtttggcattggatgtgcaacaggcaggctttggctgatttagggattgcctttgtggatgattgggtgaacaccggtaacatgtctactattgtcgcaacctacccttcggtgggacggcgacgtgagactcacggaaataaaggttcgggagttgtttacgcacaaggaagggtcgacaaaagcggggctcttgctcctacgtatcctcaattgcgatga

SEQ ID NO: 57735 - DNA, 880 bp, Glycine max
  Peptide Sequence Number=SeqID_149420
attcacatcccaagagacttgggagagatacactgacatagtggtgccacggaagctactaccagagaggaatgaggtagtctattatacagagtttgacgagttcaaggaggaactcgagaggcgccattgggatgaaaagctgagtgatttttttgacaacagtatagacatcaacattgtgaaggagttttatgccaacctctatgacctcgaagataaatcacctaagcaggtgagggtgagaggtcatttagtgaagtttgatgaggataccttcaacacatttttgaagacccatgtagtgctagaagagggggagaacttgtgtacatattccagatttgcaatcctgaggcctgatcctcaggagttggctgctaagctttgtatcccagggaggggattcaagcttaatgctgatgggcagcctttgaagattctgaggaagaacatgactactttagctcagacatggagcattttttccttttctaacctcattcccgcctcccacacatctgatgtgaccttggacatagccaaattgatttatgggattattatgaagatggacatgaacctggggtaccttatctcccaccagatctctctggttgcacagcatgacacatccagacttggattccctaccttgatcatagctttatgcaaggccagaggagttcagtcagactctagatccctagagagcttgagccctgccattaacttggcatatattaagaagaactgttggaatcttgatgatccaacagtgacatttagagggccaaggaaggccaagggtaatagatcagaggcccctaccatttcagcaccacctgagacaccagctccttcttcttccacagctcca

SEQ ID NO: 57736 - DNA, 699 bp, Glycine max
  Peptide Sequence Number=SeqID_149421
atgggtaataccgccgaacatcacgtgcgacatctttctccagctgctggctggcggcctgatttcaggcgaggatggtgtaaccgtggatcgccgcccaccaggaggacatgccgtctaccagacgccggccgtccgccagctgcagctcgacgccgctggccgactcgatcgggtaacagggtaacgggcggctcatggaggtgtaggggtgccagatatgacgttggtcaaacgccaggtcggaaagcggtgatagacatacttgtaaaccaaattgaattaagattggttgacagtatatccacaatatttaaactggcgacactttttcgttttggagacgccatgatggccgatcgcattcactggacagtagggcaagcccaggccctgtttgataaaccgctgcttgaactgctgttcgaagcgcaaaccatacaccgccaacacttcgatccgcgtcaggtgcaggtcagcacgctgctgtcgatcaaaaccggcgcttgcccggaagactgcaaatactgcccgcagagttcgcgctacaagaccggcctggaggcggagcggctgatgcaggtcgagcaggtgctggaatcggcgcgcaaggccaaggcgaacggctcgacccgtttttgcatgggcgcggcgtggaagaacccgcacgagcgcgatatgccttatctgcagcagatg

SEQ ID NO: 57737 - DNA, 336 bp, Glycine max
  Peptide Sequence Number=SeqID_149422
atggtttttgaaatattggcgatcaaaatttctattcctgtgaacatagggtcgaaccaagcgcaatcttttaagaaaaggattttatcaagtcaagagaaagatcgcgctttacgacacccttaccagacacgtgccaaggctagaataataagtgaaatcgaaaaagtacaagaacaaatgaaggctgatatggaggccatgaaggaaaaaatgacaatgatgatggaagaaatgatgagcacgaggaagatgatggaggataacactactacaattgttgttgcgagtacaactactaagatggacccgattcacccaatcggtttcaattaa

SEQ ID NO: 57738 - DNA, 444 bp, Glycine max
  Peptide Sequence Number=SeqID_149423
atggttagaacattcttgcaaaacaccgtggccctgactggtctccctatgatcttacctagtgagagtgacctgacttgctacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57739 - DNA, 405 bp, Glycine max
  Peptide Sequence Number=SeqID_149424
atgacccaagagctggtaacccgcggagacaccttaacggttatccgcacctcgtcattcagtcaccccaaaggcggcgggcccgatgatacgcggagataccttacggttatccgcacccttgtgtcatccagaggcggcgggcccgatgatacgcggaaataccttacggttacccgcacccttgtgtcatccagaggcagcgggcccgatgatatgcggagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatga

SEQ ID NO: 57740 - DNA, 671 bp, Glycine max
  Peptide Sequence Number=SeqID_149425
gtcgccagcgtgtgcgagctgctgccgctgcgcatgcgcacggcagatcgctggaactggtcagccgcgagcggcagtgggagttcgttccggccaggggcggtgaagtgggcgacgtctccgccgacaacgcgcgctgggcactggacgaggcgggattgcgggccctggcgggcgtgcgtgccgagcgcggtatctacccggtggtggaggcgctgcgcatcgaagtgggggtcagagccgcctgctgcgcagacggatccgaccccaggtcaagatcaggccaggccttcagccttcagcgcggcctgcacgccggcgtcggcatccatgcgcgccttgtaggcggccaggttgtccaggccggacaggtcgaccttggtgccggcggcccagcgcagggtgatgtagaagtacggatcggcgaagctgcggaagccggccagccacggcttgtcggccagctgcttgtcggcggtctcgaacaggccacgcaggcgcttgtgcgcggcggcgcggatcgcatcgaactggctctcgtcggcgatgaacttgcccggcgcgaacagcggcgagaaggccggatgcacatcggaattgacgaaggccagccagcgggtggcttcggcgcgctggcgcgggctgccatcgccaccgaggccggcctgcgg

SEQ ID NO: 57741 - DNA, 668 bp, Glycine max
  Peptide Sequence Number=SeqID_149426
agtttgccaagctctgcggcatcccctcaagccgctcctcaaagcagctcagagagcgtatcagcccgtctctgaagcgtattgccagcactaccatctctttctcttcaaaaagcggcgacgacgcaaaagaatacatcacgcatctggtccagtctgctttttacgataccaaaaaggacattgtcatcctgcaggctgacccgaagcttttcgagctctacgagtttgatcacaaggtgttactgcagctcaaggcgatcaacgcgcttaaacgccgtgagtccgctcaggcgctctatacctacattgaaagccttcccaagaacccggcccctatctccttggcacgcctccgcgaaaggcttaatctgcgctctcctgtgttttcgcagaaccagacagtgcgccgtgcgatggagcagctcaaagagatcggttatctggactatagcgaagtccagaagggacgcagtgtctacttccaggtccataatcgctatccaaagctcagagcgcccaagactgagcagctggaagcaccgaaggcaacaacgaaaacaaaagagccactcgatccgcaactgcaggaaaagattgaacttctggataagctcggtatttctcttcaggatctggaaagatttttaagtctcagtagcacataa

SEQ ID NO: 57742 - DNA, 117 bp, Glycine max
  Peptide Sequence Number=SeqID_149427
ggcgacgcgagggttcacgagtgcgtcttccaagaaaggaaaatgcgcggagtcgccaccaacgtttattcgaggaaaacgtcggaaaaccggaaagacgtgatctacaaactttaa

SEQ ID NO: 57743 - DNA, 776 bp, Glycine max
  Peptide Sequence Number=SeqID_149428
ttcacgtcctcaccttccgagggttacacaccctcatctgcagaggactatgcgtccgccccttgagagggctacacgccctcgccttcagagggttacacaccctcatcttcagaggactatacgtcctccccttgagaggacaacacgtcatcgctttcatagggctacacgccctcgcctttagaggactacacgtcctcgcctttagaggacttcacatcctcaccttcagagggttgcacaccctcatcttcagaggacttcacgtcctcacctttagaggagggttgcacgtcctcatcgtcagagggctacacgccttcacctttgtagggcttcacgccctaacctttagaggactacacgtcctcgccatcagagggtcatgtaccttcaccttcaaaggactacccgtcctcacctccagaggactacatgtcctcgcctccagaggactacatgtccttgccttcagaggactacacgtcctcgccatcagaggactccacgtcctcgccttcagaggactgcacgtcctcaccttcagaggattgcacagcctcacatttgtagggctacacgcccttaccttcagaggactccatgtcctcgcctttagagggtcatgtaccttcacctttagaggactacacgtcctcgcctccaaaggactacatgtcctcgcctttagaggactacacgtcctcgccattagaggactccatgtcctcaccttcagaggactgcgcgtcctcaccttcagaggactgcgc

SEQ ID NO: 57744 - DNA, 404 bp, Glycine max
  Peptide Sequence Number=SeqID_149429
gactctgccagtcgttcggagtccccgtcgtacctagcaaggtgattcggccgcccatcacccgagcttttattgagaagtattgcacacagagacaggcccagggggatgctccgcaggccgcagacgcgccgccacctcatcaggctagtccagccggatcgtttgatacggagcagtatttgcggcatttgatgagcctcagcctgcagagccagggttttacttctttcccgtgccctactccggaccagttcagggcagaggtcgcatggcctggagattggcctgaggcccgggcaggagaggcaccagcagaggctcccgacgaggcagatgaggcccgcgaggacgaggagatggccgatttatttgatttcttaggaggaagcggggccacatga

SEQ ID NO: 57745 - DNA, 636 bp, Glycine max
  Peptide Sequence Number=SeqID_149430
gcttttcgtcttacagaatgcaaaaagtttatacgaatacccactcgggtatttctgcccgtcagcgtgactcaaaagtcagtatgacagatcttgtgagcgcggaagatgacgtaaatctccacgtgtcaacgggcttgtcggccgcgattgacgaaggtcgcagaagaccgacgttagtctctgcgtgtgtttcaggcttttcgtcttacagaatgcaaaaagtttatacgaataaccactcgggtatttccgcccgtcagcgtgactcaaaagtcagtatgacagatcttgtgagcgcggaagatgacgcttttcgtcttacagacaagcaaaaagtttatatggataaccactcgggtatttccggccgtcagcgtgactcaaaagtcagtatgacagatcttgtgagcgcggaagatgacgtcgcagaagacgatgttagtctctgcgtgttatcaggctttttgtcttacagaatgcaaaaagtttatacggataaccactcgggtatttccggccgtcagcgtgactcaaaagtctgtatgacagatcttgtgagcgcggaagataacctaaatctccacgtgtcaacgggcttgtcggccgcgattgacgaaggtcgcagaagacgac

SEQ ID NO: 57746 - DNA, 212 bp, Glycine max
  Peptide Sequence Number=SeqID_149431
caagaaattgcccagaaacctttagaagggcccagatttgataattactatttgcaccctgtcgcaacctacccttcggcgggagggcgacgcgagactcgcgggatgcgtgttccacgaaaggaatacgcacggagtcgccaccaacgtttttttgaggaaaacgtcagaaaaaccggaaaagacgcgatctacgaacttttaagtgaaag

SEQ ID NO: 57747 - DNA, 456 bp, Glycine max
  Peptide Sequence Number=SeqID_149432
atgccgagtgaaaaccgtattcagcctgggttccaatatgggagacccttttgcccatctgcgagacgccgtccgcctgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57748 - DNA, 192 bp, Glycine max
  Peptide Sequence Number=SeqID_149433
atgtcttcctcactcgatacgataaccaaatgcccctctactatgaatttcaatttttggtggagtgtagagggaacaactcccaccgagtggatccacgggcgccccaaaaggcagctggaggtcgatctctcccctaacctctcggcgggtgctgtcgaaggcacgaactaccatggaacttggctttag

SEQ ID NO: 57749 - DNA, 134 bp, Glycine max
  Peptide Sequence Number=SeqID_149434
gtttagctgattcaaatgatgagatgtctatagatttgaggaaaaatcctcttcaagagggaggggatgatgcattcctcccaaggaggggacccatccccagagccatggctaggagactccaagaagattag

SEQ ID NO: 57750 - DNA, 255 bp, Glycine max
  Peptide Sequence Number=SeqID_149435
atgacaaacattgcagcaagacttaagaccttgggaatggctgtgaatgagaacttcattgttcagtacgttagttcagaagaaacgaggtttctttttaagaatcaagaaagtcacttagtccattatgtaagccaccagggaacaggagttggaaaaagattggtgaagaagcatgatagaggcaaagggccattaaagatcaatgacaattctacctgcaatctagattttagaaggatcaaagagcaataa

SEQ ID NO: 57751 - DNA, 840 bp, Glycine max
  Peptide Sequence Number=SeqID_149436
atggtgggtgatgtcaacaataccgtacagacggctttggcgggtaatgcggccaatactttttatgatggtgaccgccattttgatgtgactttgcgtctggacaggccgttccgcgactcggtcgatgatattgatgaattgccgattgccttgcctaatggagcgggtagcattcccttaagtgaggtggccgaagtgagcatcaagcagggggcctcaagggtgagccgggaggcaggtgcacgtattgtctctattaaagccaacattaccgatcgggatcaaggcagttttgtgaaagaggcgatgcaaaccgtgaaggcaaaggtgaagctaccgccaggctataccatgacctggggtggtcagtttgaaaaccagcaacgggccatgaaacggttaatggtcattgtgccactgtctgtgctgctgatatttgtgctgttattctgggcatttaaatcggtgaagaatgccttgttagtgttgttgatgattccatttacactggtgggtggactggccgggctggcaattgctggtttgcatttgtctgtgtctgctgccgttggttttattgctttggcgggtatctcggtgcaaaacggcgtgattatggtcgaacagatcaaaaaattgatgcgtgagggccaaagcgtgacggagtcggtgattgaaggggcggtagcaagggttgggcttaatgccggccgcgttatcccatggtatcggttcagaaacacaacggccttttgcggtggtgattgtgggtggcctgattactgccactctgttcactttgctgttactgccgctgttgttcccgctattttctga

SEQ ID NO: 57752 - DNA, 465 bp, Glycine max
  Peptide Sequence Number=SeqID_149437
atgcaatctcagggacttgcactgcctctggttggtccctcagttcctcaagtaaacacaaaggagagttgtgttgatccctcaggaagcgatcctgagacgggtgactcagacaggtgcggcttgtacatcgaagcaaatcctgcccacctagttgccctgggaagagtttatgagggatccactattgttcataaaactcctttgttgtctggccaagtaaaggtgggtgtggaggaggttaaagatctagatgcttccattcctgtacccaatgatgaggtttccttagtggggcatgcaattgacaccttccttacttggccgaaacatctggtcaagcctttatcacagcaagcaattgtgtctccggcaaaaccacctcaaacgccagatccagaggtcgatgatccgctttatctgatgacattgaccatcctagagcttttcttgaggccttactag

SEQ ID NO: 57753 - DNA, 420 bp, Glycine max
  Peptide Sequence Number=SeqID_149438
atgaagcacttcactgacaccctcatcagtgccaacataaaacaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57754 - DNA, 285 bp, Glycine max
  Peptide Sequence Number=SeqID_149439
atgaacctcaagttgattgttcggatgcattcaatacttctcaggtgtttgacagtcgagacgatgttttgcagtgggctcgatccattactcatgaaacggatttgtggcggtcattataaggagcacaatgccaatagttgtacaaccatcaaacaaatatacaatgcaagaaatgcatatcgttcatccattagaggaagtgatactgaaatgcaacatctaatgaagcttcttgaacgggatcaatatattcattggcatagattaaaagatgaagacatg

SEQ ID NO: 57755 - DNA, 132 bp, Glycine max
  Peptide Sequence Number=SeqID_149440
atgacttgttgttcccggaggaacaaaagaatgaccaaacttggtctctgcttgtcatcgggcccgccgcctctggatgacaaaaagggtgcggataaccgtaaggtatctccgcgggctaccagctcttga

SEQ ID NO: 57756 - DNA, 366 bp, Glycine max
  Peptide Sequence Number=SeqID_149441
atggagaaggttgtttatgagtggtttctccagcatcaagaacgtgtgaatataacaagagaattaattttgcagaaggcaagagatataatgaaactcgtgtaccctcatgataattcagattttaacttctctataggatggcttgggaaattcaagcaccgacatggcataaagtcatttcgtcattttggcgagagtgggtttgttgatgtacaagacatggaacagaaattggtatcgattcgggagaaaattaatcagttccctatgaaagatgttttcaatatggatgaaactgggttgttttataggctacaagctgatcattcactggcaacaaaacaacttgaaggaagaaaataa

SEQ ID NO: 57757 - DNA, 369 bp, Glycine max
  Peptide Sequence Number=SeqID_149442
atggcgaggacgtgtagtcctctaaaggtgaggacgtgtagtcctctgaatgtgaggacgtgtagccctacaaaggtgaaggcacatgaccctttgacggcgaggacgtttagtcctctgaagttgaaggtacatgaccctttgaaggcgaggacgcgtagtcctctaaaggtgaaggcgaggacgtatagtcctctggaggtgagggcgtgcagccctctggtggtgaggacgtgtagtcctctcaaggcgaggacatgtagtcctctgacggtgaggtacccaagggtccatccttatgagaaagcaagggatcgactcatcgagagagccggtcatcccaaattcaaaagatttggacatttagat

SEQ ID NO: 57758 - DNA, 261 bp, Glycine max
  Peptide Sequence Number=SeqID_149443
atggtgaaagttggaacctcttacgtgccgatcaacgtctcattttcgccaaaattgttggcccagggattcttcccggtagaagctcaacagggacagatatttagaacttctctggtttttcgagctccagtggcgtatcatggtttctatcagctgttccctcctgttcagctactgacggggatggtgtacgtccaattcggcacacaagcataccgccggacatcagcgctggcaagtgtagcgggtgcgacgtga

SEQ ID NO: 57759 - DNA, 453 bp, Glycine max
  Peptide Sequence Number=SeqID_149444
ggatcgcacccacaaagacacccagtggacctgaagaagtacaatagggccctggggtttccagctctggttacgggcctctgtcggccctatagggcgcccgtccccccagcaagctcataccatcatgacataggtaaggatcgtgcccgcaagacacctagtggacccgaagaaggccaacagggtcttggagttgccagctctaaatacgggtctctatcagttcaagggagtgccagttgcccccagcagggtcatcaggccccctaccaatcgagctttcatcaagaagtgctgcgcccccagacggacgcagggcgagacaccacagtagcattgggatggccggtagcgggcaatagacgaaccgtcaccacctctagagttcacctctgctcatccacaaaaaggtttgagtattgcctacaccaagtccaaagccaaaggtaa

SEQ ID NO: 57760 - DNA, 210 bp, Glycine max
  Peptide Sequence Number=SeqID_149445
atgtctcctccacctctagaacctcacaatcactcacaaactcatctcaagctctcaggacgacttcctcttcaagctatgttctctgcaggtggccttgatggtgcttgcatgcttagcgcaactcttgaccgcttagcgcacattagtggatttcggcttagcgcgtgtttttctcgctcagtagatggactgaagcagtgcgcttag

SEQ ID NO: 57761 - DNA, 432 bp, Glycine max
  Peptide Sequence Number=SeqID_149446
atgaagcacttcactgacaccctcatcagtgccaacataagtatatgcctcccctcagcccgaaaggccagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57762 - DNA, 267 bp, Glycine max
  Peptide Sequence Number=SeqID_149447
atgcaccgcaggccacagacacactgccaccacctcatcaggcagatccagctgggacatttggcatggagcggtatttacagcacttggttttccagcaggcggccaaccacagggggcagggctgaggttgcatggcccagagattgccctgaggctcaggcaggggaggcgcccgtagaggctcccgacgatgcagaggaggcccgcatggatgaggagatgtcggatttactcggtttcttgggagggagtggagccacatga

SEQ ID NO: 57763 - DNA, 351 bp, Glycine max
  Peptide Sequence Number=SeqID_149448
atgaactcactaagagagcatgctgcgctaagcgagttcatcagtactcattatatggcttctaggaaacataaaagtattggttcaagacccacaacacagtatgacacaaggagattttcttccttagatgcttggaccagatacacagataattttctggggagaaacattttactagagagggaagtagagatatatcattctgagctagatgaatttaaggctaaattggagaggcgcaatttccacaaatgcctcaccaatttagtcgatgggagcatagacttagctttggtgaaagaattctatacaaatttatacagttctgaggatcatccaccaaagtag

SEQ ID NO: 57764 - DNA, 732 bp, Glycine max
  Peptide Sequence Number=SeqID_149449
atggctgttgccgccgtatgcggaacgtcaggagtcgcctcgttattcactaaagcggctttcgccgcggattctgctatcgccgatggccagacgcgccgctttgacttttccgtcctgcaggcgatggctcatgacttagcccgccagccgtggggcggcgcgccgcgtgacctgccgccgacgctggcgaatctgacccctcaggcctataacagcatccagtatgatgcggcgcattcgctgtggaataacgttgaagagcgtaagctggatatccagtttttccatgttggtatgggcttccgccgccgggtgcgtatgttctcgctggacgcgcagtctcagcaggcgcgggagatacacttccgtccggagctgttccagtacaacgacgccggcgttgataccaaacagctggaagggcagaccgatctcggtttcgccggttttcgcgtgtttaaggcgccggaactggcgcgccgcgatatcgtcgcctttctgggcgccagctacttccgcgcggtcgacagcacttaccagtacggcctgtcggcgcgcggtctggccgttgacacctttaccgataccccggaagagttcccggatttcacgtcattctggtttgaaaccgtcaaacctggcgcgacggtgttcaccgtctacgcgctgctcgatagcctgagcgtcaccggcgcctataagttcaccgtgaattgccagcaaacgcag

SEQ ID NO: 57765 - DNA, 285 bp, Glycine max
  Peptide Sequence Number=SeqID_149450
atgactaaccgcctgagatatcttttgtttccccttacaaagattcaagggactaaccgcctaagatttctttgtcttaacacattagagggtacatcctttgtggtacaagtagagcgtacatctacttgggttgtgatactgagaataagagagggtacatctcttgtggatcagttcaagtggagcgtacatccacttggttgttcaaagagaacaagggaaggattttacaaggttattggaaatctcaagaaccggtggttgcttggggactggatgtag

SEQ ID NO: 57766 - DNA, 355 bp, Glycine max
  Peptide Sequence Number=SeqID_149451
atggctgctagtgaccatgcaatcttgcgtgatagagaacacatcccaaccaaaagaagcttgcaagagctcacatcacaggatgaattgttggcacataacaagttgttatccaagcaacttgaagcattaacaaaaacattgagttgtgttatatgtggtggagcacatgattctggctgctgcattcccacagaagatacaacacctgaagtgaactatacggggaaccagccaagaccaaactttaatgcagaccgaccgtcaagctactttggagccaacatagagaagaatcctaaggaggagtgcaaggctgttatgactagcagcaaaatggtgagcatggatgaag

SEQ ID NO: 57767 - DNA, 144 bp, Glycine max
  Peptide Sequence Number=SeqID_149452
atggcagagaagcctaacacatgggaaaattccttgagaatcaaggaaggtagctttgttgggaagctagaggaagaaagcttccttgagaagctagggagggctactcacacccttccaatagctaagctcaccccatgctaa

SEQ ID NO: 57768 - DNA, 159 bp, Glycine max
  Peptide Sequence Number=SeqID_149453
aatcggtcttccgtgtgacaagttatgatgaggacatgaccaagagcaagggcaaggatccacttgaaggacttggaggacctatgacaagggctagagcaaggaaatccaaggaagctcttcaacaagtgctgtccatactgttgaatacaagcccaa

SEQ ID NO: 57769 - DNA, 96 bp, Glycine max
  Peptide Sequence Number=SeqID_149454
atggttttgttggccaaaggagtaactgttgtggaggcggtagttgtagttgtggacatgagggttgtggagacgatggttgtggttgagaaataa

SEQ ID NO: 57770 - DNA, 707 bp, Glycine max
  Peptide Sequence Number=SeqID_149455
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaagagttgaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57771 - DNA, 345 bp, Glycine max
  Peptide Sequence Number=SeqID_149456
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggaactgctgctaaagcgattgctccacgcgcagagattgctactcaagatttcttaaaaaattggcaagcaagctaa

SEQ ID NO: 57772 - DNA, 298 bp, Glycine max
  Peptide Sequence Number=SeqID_149457
atggcgaatttggctgtacgtaatggttgtgacacgatgatttggattcgtgatgcgactgcagctgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 57773 - DNA, 402 bp, Glycine max
  Peptide Sequence Number=SeqID_149458
atggggacaaggggttgcatcaattacaatcccgttcttgcgataaggcaacttggctacccgacgagaggggcgccactagaggataagctcacgcctgtcatttcacgaggtttcaataagaccaacgtggagacacttcagaaggtccgcaaggcatgggaggtgttgcaaaagaaggagaaggaactcaggggcagtaacaatgggcccattggtggctatcgtaagtggttgaaagcctacgtgcaaggtttggattggctcccgagtttgagaaccgctaaaagggaggaggttgaggcaccggaggaagacaaagaggtgcaggcccttaggacggaactcgaccaagcccaaatagtcaaagaaaggttcaaatcagcagctcttaagatctga

SEQ ID NO: 57774 - DNA, 423 bp, Glycine max
  Peptide Sequence Number=SeqID_149459
atgtcgtatgccaacctgctaccatccttgctcagcaaccaattggctgtggatagtttgaatgtgaggactaatccacttgccaatcatggaggcttaacggtgaatgcagtggaagaatgggagtctcgagggctaaagcagataggggacgtgtcaacttccaggcggttcatattggaagcattgcgcgaagccgatgtaattgaccttgacggcaacaaaggagatctgtgcttaatgcatccaggggcgtcgcatgatgtggaaacatgcccaatagttgaggaactgctgcaggggatgataaatagggggcaaattgaaatccacagcgcaaagaaggaggaaggagagggacattaccacttagaggccctgaggcttccagcccttaacagcaaagacgcctacaccctgtga

SEQ ID NO: 57775 - DNA, 797 bp, Glycine max
  Peptide Sequence Number=SeqID_149460
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccatattccctttgggttgtggttcacgcttgtggaattgaagtccacgcggtttcacgactggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57776 - DNA, 836 bp, Glycine max
  Peptide Sequence Number=SeqID_149461
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctccctgtgcagtttctgggtcttggcccctctgtagtgtctgagggttccccttcagtggcacctccagaggtctctgagtttaggactttctgtcccatctcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57777 - DNA, 416 bp, Glycine max
  Peptide Sequence Number=SeqID_149462
tacaatctaaatcccttaacgaggatccattggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgttgcctccggtgctgattctgatcctattgtgttggccttcgggatcggagtaatgattaacaaggacagtcgggggcattcgtatttcatagtcagagggatcaccgatgtgcttttaggactccgctggcacccttatgagaaatcaaagtctttgggttccggggggagtatggtcgcaaggctgaaacttaaaggaattgacggaagggcaccaccaggagtggagcctgcggcttaa

SEQ ID NO: 57778 - DNA, 199 bp, Glycine max
  Peptide Sequence Number=SeqID_149463
atgaccaaacttggtctctgcttgtcatcgggcccgccgcctctggatgacaaaagggtgcggataaccgtaaggtatctccgcgtatcatcgggcccgccgcctctggatgatacaagggtcgacaaaagcggtgctcttgctcctacgtaccctccatcaaagaggaaatcagacctacgtagttctttctttaaag

SEQ ID NO: 57779 - DNA, 219 bp, Glycine max
  Peptide Sequence Number=SeqID_149464
atgatggcacatcagcgggcgagcgaggtgaggctcatgggtgtgctttccaaaggaggaaagatgcgcggagccgccaccaacgtttatttgtggaaaacgtcggaaaaaccgaaggaaaccggtcaaaaagaaaattccaagttcgggagttgtcgacaaaagcggggctcttgctcctacgtacccttcatcgaagaggaaatcagacctacgtag

SEQ ID NO: 57780 - DNA, 135 bp, Glycine max
  Peptide Sequence Number=SeqID_149465
atgggccaaatgattggcgatgagggatgggcaagaggtcttcgtacgtcattgggagtgggagttggaacttggggagcttccctctgggtgggtgccttaggctgcacgggtgctgaactagaggcgttcccg

SEQ ID NO: 57781 - DNA, 150 bp, Glycine max
  Peptide Sequence Number=SeqID_149466
atgccaaaagatagggggaggattgtcatcataaaaaagggggagattgtagacaaaggatcaagccgatgttttgatgatgccaaaagatcacatgcgtctcaaagctttattcaagacaaagaaattaaagatattcaagatggatga

SEQ ID NO: 57782 - DNA, 216 bp, Glycine max
  Peptide Sequence Number=SeqID_149467
atgcaagtgggatcagcaactttcattatcagagtaatcaagcacagcagtatctgtagtggtgacagcaaaattctgcaagttgcaagtcgtttccaggattatcttctatcagctactagtcttttccaggatgtcaagacatctcatgtgacatcagctttctgctccccctgtctccatgctcttactgcagcatcttctatcagctactag

SEQ ID NO: 57783 - DNA, 294 bp, Glycine max
  Peptide Sequence Number=SeqID_149468
atgtctgatttcctcttcgatggagggttgttgtcctttgagacaaacgtgggaggtgctaataccttcctcaaacgtaaatacaactcccgacaaacgtgggaggtgctaatacctttcgttttgaccggtttcctttggtttttccgacgttttccacaaataaacgttggtggcgactccgtgcatctttcctcctttggaaagtgcacctgtgagcctcgtctcgctcgcccgcaaaagggcatgttgcgacagttggcgactccactggggactatttttgtgagttag

SEQ ID NO: 57784 - DNA, 504 bp, Glycine max
  Peptide Sequence Number=SeqID_149469
atggtgaaagttggaacctcttacgtgccgatcaacgtctcattttcgccaaaagttggcccagggctttcccggtatcaacagccgtggacaccaggatcgtgttatttagatatttcaatgcggcaaaccaattccgtcaagcttatcgggcaaagtcgacctcgaggggcccggaccacttttgttccctttatgagcaccgagccggacatcagcgcaagtgtaaagcctggggtgcctaagagtgagctaaccacaccccggcttaattgcgttgccgctcagctgcccgctttccagttcggaccatgtcgtgccaactgcttaagaggccaacgcgcggggatcgagtgcggctttgcgtattacgccagggcgctaagcggagtgtgcatactggcttactatggcgaattcctcggactccaccgcggtggcggcacggctctagaactagtggagtttcccccgggccaggaattcgatccactttctcaagcg

SEQ ID NO: 57785 - DNA, 519 bp, Glycine max
  Peptide Sequence Number=SeqID_149470
atggagttggatgcaatcaagagtgaattatcccaaattcatacacaacagtcagctcccccaagaccgtctaaccctgacgtatttgttgcacgtgttagcacgaaagagagttatgctgaagctgctaataatgttgttggtaacgagcggtctacatttgatacatgtagtatgggcttctacattgtttgtggtgacagtacacagctggtggcagggggaaaggtctttggagtaggtggcacgatacacactgttgcttatggagatgatgtagtaagggtgtgtgttgacactatatacgatggtgaagccgttgtcccgttacccacttcaaagattcagtatgtcagggacgctgtgaactcattcattggatggcccagacatctagtgaaacctttatcttatgattctgaccttaatgtgcggaagccagttgaacatagtggtgatgcaaagcttgcagaatccagtggaagtgccgtgggaggcgaaccaatttggacttcctga

SEQ ID NO: 57786 - DNA, 457 bp, Glycine max
  Peptide Sequence Number=SeqID_149471
aggactacatgtcctcaccttcgtagggctacatgccctcacctttagaggactacacatcctcgccttcagaggactgcacgtcctcaccttgagaggactaaacgtcctcgccttgagaggactacatgtcctcaccatcagagggctgcacgccctcacctccagaggactacaggtcctcgccttgagaggactacatgtcctcaccatcagagggctgcacgccctcacctccagaggactacacgtcctcgccttgagagggctactcacacttgccttgggtactagttaccctcaccttcagaggatccacgatgtcggatacaatgtccaggacatcctgcccgaaaatactggaaggcaagataaaagtcaaatgaagaatggaagctgcaggatccacgatgtcggatacgatgtccaggacatcttgcccgaaaatactggacac

SEQ ID NO: 57787 - DNA, 503 bp, Glycine max
  Peptide Sequence Number=SeqID_149472
atgcatagatctcccacaagcaatttagttcctttagacttagaaattgaagctacattgagaaagaacagggccgagaggagaaggaaacttctgcaagatagaacagttgcatccattcttgaggaagaaactcatttttctgattcattttcacctgattcaccatcatcaagggaatccgctactcaattgcctgaaaccactatcatggcagacgagcaacatcagaggatcacccttgaggattattcaagcagctcagtactgcaattctttactagcattgcacgtcctgaagtgcaagctcacaacatcaactacccacattctttaattcatttaatacaggagaatctattccaaggattacctaatgaagacccctatgcacatttgacaatgttcattgaaatatgcaaaattgttaagattgccggtgtgccagatgaagctattagactcggtctattctcattctcattggcaggagaggccaagag

SEQ ID NO: 57788 - DNA, 564 bp, Glycine max
  Peptide Sequence Number=SeqID_149473
atgaccggctctctcgatgagtcaatctcttgctttctcagaagggtggacccttgggtactagtacctatcgcctttagaggactacccgtcctcaccttcagaggactacaggtcctcgccatcagaggactacacgtcctggccctcagagggctacatgtcctcaccttcagagggcttcacgccctcgccttcagaggactatacgtccttaccttcagaggactacacgtcctcgccattagagggctgcacgtcctcaccttcagagggctacatgccctcaccttcagaggactgcacgtcctcacctttagaggactgcatgtcctcgccttcatagggctacacgccttcacctttagagggctgcatgccctcgccttcagaggattgcatgtcctcacctttagagggctgcacaccctcaccttcagaggactagacgtcctcgccttcagagggctacacgcctttgctttcagaggactacacgtcctcgccttcagagggctacacgccctcgctttcaaagggctttatgccctcgccttcaaatga

SEQ ID NO: 57789 - DNA, 174 bp, Glycine max
  Peptide Sequence Number=SeqID_149474
atgccggaaatcaaaaagaaaatactgatgcacaatcagggtgtaaatagcaattcaaatctaggcccttccggaacattttggaagttgggttgcttaaggaggaagcaactgggtggcaagctcctccacgtttttgaaaaatggtttccggggcttccgcggcttccgtaa

SEQ ID NO: 57790 - DNA, 1305 bp, Glycine max
  Peptide Sequence Number=SeqID_149475
atggcgagtcaagaagagtgggtcccgtttgcggatatactagctttgctaatctttggggttgttctctttccaaacgtggacggtttggtggacctagccgcaattgatgctttccttgcatatcaccatagcaaggagagcccggtggtagctatcttggcggacttatttgatacatttgaccgaaggtgcgagaagaacagcgcacggattgtctgctatttacccgctctttgtgtgtggttggtttcgcacctattccaacaagacataaggcacccgtgtccgtttcaaagttatcgctcgtgcgtcgaaaagagaagagtagattgggaccaatacttggctgggataggaggcagcacaatcaactgcttagggtaccctatgaggggagcaccaacggaagagagcctctcgcctttccttgtgagagatttcggcacgcaaagtctcaaggttgtacaaagagtccacaaggcgtggaaaagtccgttgaggaaagataaagaacttaggggcatccgtaatggcatcatcggtagttatcatgaatggctaagagttcatacacgagggttagattggctctccaagttgaaagttatcaacgaggagaacttcgaagctccggaagaggatgaagaagtccaagctctaaaattagagctagggaaggcaagactcgccaaagaaaaattcaagtcagccgctacaaacatccggaaagagtgtgccgagttacgagaggaaaacgcggctattgcaagagtccttgaacaagaaaccaagagggcccacaaggaagagcatcgccaagataaattccaaggagctttgtggggcaacaacaatgagctcaagctccggagagaggaaagagaccagtcacgagtatatggcatgatcttaaaggaggagttagctgcttgctcaagatccaagaggagtttggcccaacacttagaagccacggagcaaagcatactatctataatagggcagtacaaagaagagttaaaccagtctttgacccatgaacaaaaactagtagaggacttcgcacaagcgtacgccgagaaggaagcaatagggagggtgattgatgtattgcatcaagaagcgaccatgtggatggataggttcgccttgaccttaaatggaagtcaagacctcccgcgactactagccaaagcaaaggccattgctgaagtgtgttcagcccccgaggaaattcacgggctaatcaattactatcaacacatgatagatttgatggcccatataattagaaaccgttaa

SEQ ID NO: 57791 - DNA, 576 bp, Glycine max
  Peptide Sequence Number=SeqID_149476
atggaggcgctgcgctgcctgccgggcgtcggcccgaaatcggcgcagcgcatggcgtttcagctgctgcagcgcgatcgcagcggcggcatgcgcctggcgcaggcgttgacgcgcgcgatgtcggaaatcggccactgcgccgactgccgcaccttcaccgagcaggacgtctgcaccatctgcgccaatccgcgccgtcagcaaaacggccagatttgcgtggtggaaagcccggcggatatccacgccatcgagcagaccggccagttcgccgggcgctactttgtgctaatggggcatctgtcgccgctggacggcatcgggccgggcgatatcggtctggatcgcctggagcaacggctggaaaaggaaagcatcaccgaagtgatcctcgccaccaacccgacggtggaaggggaagcgaccgccaactacatcgctgagatgtgcggccagtatggcgtgctcgccagccgtatcgcccacggcgtgccggtgggcggcgagctggaaatggtcgacggcaccacgctgtcgcattcgctggccgggcgtcacgccatcaagttctga

SEQ ID NO: 57792 - DNA, 289 bp, Glycine max
  misc_feature (206)..(206): n is a, c, g, or t
  Peptide Sequence Number=SeqID_149477
atgattatgaggggccaagacatttatagtagccaagatgaggttactacttcaccttcttatactgaaagtgaagaaacaaaaggggaagaatctagtgaagagatctacctccaagaagaaggacaacctttaatggttaaggaggagtgtaaggaggtaagtgtctcctccaagagcattgccacacctcttgggcttgagtntattcctcaagtaaaggagtggttggataagggtttggttcgcaagagcttaaatccttgtgctttgttggtgcccaaaatag

SEQ ID NO: 57793 - DNA, 385 bp, Glycine max
  Peptide Sequence Number=SeqID_149478
cttgagaggatcgatgggggcccggcattgagaggaacgaggataagggctacgtgggagtacgtgagctcagttggaggtgggcaacaagggatggtgggtttatacgtgatttgcggatgtggagaattgtcttgcaccatcgcccgaccgccacctatggtacctggagatatgtcgtgggggtcaggagaccttggggacgtcaggcgagctcctggcagtctacagataaaaggaacaaagaccacaaagcaaggaggcttgtgtgatatatgggttatggcctctgggaactggaagattgtggaggcctctggtaatcgattaccagtctgtgtaatcgattacacaaaggaatgggtcattggtaatcgattaccag

SEQ ID NO: 57794 - DNA, 267 bp, Glycine max
  Peptide Sequence Number=SeqID_149479
atgatgataacaaaagatgatgacaaaggtgatgacaaaaagctcaaaggtcaatcaaaggatgagtttaagatgttcaagaagaaatcaagaacacttcgagattcaagaggaaggatgaattcaagaatcaagattcaaggatcaagcttcaagaatcaagatcaagattcaagattcaagattcaagattcaagattcaagattcaagattcaagaatcaagagaagacttaatcaagataagtatgaaaagaatttttcatga

SEQ ID NO: 57795 - DNA, 819 bp, Glycine max
  Peptide Sequence Number=SeqID_149480
atgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57796 - DNA, 617 bp, Glycine max
  Peptide Sequence Number=SeqID_149481
gaggactacacgtcctcaccatcagagggctggacgccctcacctccagaggactacatgtcctcgccttgagagggctacacgccctcaccttgggtactagttaccctcatcgtcagaggactacacgtcctcgccttgagaggactacacgtcctcaccatcagagggctggacgccctcacctccagaggactacatgtcctcgccttgagagggttacacgtcctcaccttggagaactgcacgtcctcgtcaacggagggctgcacgccctcaccttgagaggactacacgtcctcgccatcagagggctgcacgccctcacctccagaggactacacatcctcgccttgagagggctgcacgccctcacctttagagggctatgtgtcctcattttcagtgtgctccacatccacaccttaagagaattcaagtttccttttaacggttcctgggccccccctgatattggagggcgaccaactgtgcgagcacaaccagagagggaggctatcacacagctactatgcatactggggcaagatttcacccgtgccgctgcaaagagacgagtgcggatcatgcgcaccaacatgaccactcttacatag

SEQ ID NO: 57797 - DNA, 762 bp, Glycine max
  Peptide Sequence Number=SeqID_149482
atgtcctcaccttcagagggctgcacaccttcaccttcagaggactgcatgtcctcacctttagaggactacacgtcctcaccttcagagggactacacatcctcaccttcagaggactacacgtcctcacctttagaggactacacgccctcgccttcaaaggactgcacgtcctcaccttcagagggctacacgccctcgccttcagaagactacacgtcctcaccttcagagggctacacgccctcgcattcagagggctgcacgccctgaccttcagaggactgcacgtcctcacctttagaggcctgcacatcctcacctttagaggactacacgtcctcaccttcagaggactgcatgtcctcacctttagaggactacacgtcctcaccttcagagggctacacgcccttgccttcaaaggactacacgccctccccttcagaggactacacgtcctcgccttcagagggctacacgccctcaccttcagaggactggacatcctcaccttcagagggctgcacaccctcgcctttacaggactacacgtcctcgctttcagagtactggacgtcctcaccttcagaagaatggatgccctcaccttcagagggctacacgccctcaccttgagaagactacacggtcctccccttgagaggactacacgtccttgccttcggagggctacaatccctcaacttcagaggactacacgtcctctctttcagagagctacaagccctcgcgtatag

SEQ ID NO: 57798 - DNA, 363 bp, Glycine max
  Peptide Sequence Number=SeqID_149483
atggttgctaagcatgttgcgcgcaccattgcccgaagaaccaacaacgcaccaactacattgcagtcatgggcttggtaccgcatgccttttattgcaccaagagtcccacgacccgaaacaactttttcactggctaaaagatggagtggtggtagattagaatatagggccacacctcatggtgacttggtcggatataagtctcataaagatcatatggagagccatgagctacggtttggactacaacaagaaatccctgttgatcccatgaatctttatctacttcaccaaattaacatacgaggcaatcattacactgattggatggaataccatgcggagtggattaatatctag

SEQ ID NO: 57799 - DNA, 381 bp, Glycine max
  Peptide Sequence Number=SeqID_149484
atggagagcatcgcgggatattatgggagtcaatcagacatccgagtaaaaagttattgtcgtttgaatttgctcagaacttcaacatacaattttgagcattcggatttattacgggactcaatcagacatccgaagcttcggtattccatttcgagcgtctcgatatattacgggactcaatcagacatccgagtaaaaagtaattgtcgtttgaatttgctcagagcttcgatattccatttcaagcgtctcgatatattacgggactcaatcagacatccaagtaaaaagttattgtcattcgaatttgctcagagcttctacattcaatttcgagcgttccgatatattacgggactcaatcggacatccgagtaa

SEQ ID NO: 57800 - DNA, 297 bp, Glycine max
  Peptide Sequence Number=SeqID_149485
atggtagaggaggaacaggcacggattggtggttatccttctagtgaggcctccaataaatgtgagaattataaggaggaagcacggaagaaaacacagaagcataaaccaaagagggtggagagtgtcaatgctgatgcagaagcctttgctgaagcattagaacatacgaagaaaagagatacaggccatcaaagtgtgtcattggagaataagacaggagattcaactatgctgaagataggagattcagctaaagttgtgataaaaacaagacatgaagggaagaaggcataa

SEQ ID NO: 57801 - DNA, 285 bp, Glycine max
  Peptide Sequence Number=SeqID_149486
atgccgatctccccctacgaaagtatttgttgggatcacgcccacaaaacaccaagtggacctagagaagtccaacagggccctggggtttccatctcttggttacagtcctctgtcagtcctatagggtgcccgtccaccccagcaaggtcatggcattgtgacatagggatcgcacctgcaagacacccagtggacccgaagaagtctaacagggtcctagggtttccagctctgattacaggcctctgtcagttctacggagtgcttgtcgcccccaacaag

SEQ ID NO: 57802 - DNA, 813 bp, Glycine max
  Peptide Sequence Number=SeqID_149487
gactcgttggaagaacaagtgacacggggtgagtttgtctcccagggtcgtcaagatatacttaacacgaccataggaagaccagatcatggaggtcgtgttcgtgcagctgggtctggggtcacaattagtcaatactatgggaggacatcacgtgccttaagtacctcatccatagcattcaccaaagaacaattggctgaaatagtaggaaccattagggaacaagtcatgaaagagattaaagaagaaaataagcgaagtctacaggtttggaaaaatgagctgaaggatgccatcattattgacatatttaacagagacaaggactcaacacctgctaattttgacttaaatgtgttaggtgcatgcatgagcactaaggagagcaatgctgaaattgctgtgaacctgtctggggaagtacatgttggttgtgtaacaccacctatggggttgtacgtccaaagtcagcattgtacaaagctggtggcgttgggaaaaattcatgatggaccatccaccatacattgcgtagcgtatgcagatgatgtcgtaagggttagcgtcaaacaagtaattgatggtgaacctgaagttccattaccgacatcagaaattaagtatgtgagagatgtcgttaacacattcattgcatggccattgcctttgcattcaggcatcactccagacaaagtattgattaagacccttgttgacatttacgacaagcttgttgagtttgtgtgggatcttactgaatttggaattccaaatgtaaattcatcgttgttcttaactatcataccctaa

SEQ ID NO: 57803 - DNA, 303 bp, Glycine max
  Peptide Sequence Number=SeqID_149488
atggcttccaactcccaacaatttagtgccagaagtgatgctattgtcattagaggagtgcatgaagtagccacaaattcatcctcatcaggagagactaagaagcttgaaggtaaactagatgccttggttaacctggtaacccaactggccatgaatgaaaaatctgcacctgttgccagactctgtggtttatgcttctctgccaaccaccacacagacctttgcccttctgtgcaacaatctgaagcaattgaacagcttgaagcttatgctgcaaacatctacaacagacctccttaa

SEQ ID NO: 57804 - DNA, 198 bp, Glycine max
  misc_feature (116)..(116): n is a, c, g, or t
  Peptide Sequence Number=SeqID_149489
atggagaaaaaggaatctcatgaagacagtacaagtgtaggcttcaatcacttctccgtctctctgacgtttgagaattctatcggagcaatcggaggaaaaactggaggaatctncagggaaccgctagagatgccactatcgttgtcggaagacacgggttttacaccccatgttgtgataaaatcttttgtataa

SEQ ID NO: 57805 - DNA, 779 bp, Glycine max
  Peptide Sequence Number=SeqID_149490
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaagactctgattggccctacttgggtcacatgcccatctatggcccaatcactgttccaagggtaggaactgtaactggctcagctttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57806 - DNA, 420 bp, Glycine max
  Peptide Sequence Number=SeqID_149491
atgtccaaatcttttgaatttgggatgaccgactctctcgatgagtcgatctcttgctttctcataaggatggaccctcgggtactagtaccctggtcttcagaggactacactcctcgccaacagagggctgcacgccctcaccttaagaggactgtgcgtcctcactttcagaggactgcatgtcctcaccttcagagggctacacgccctcgccatcagaggactgcgtgtcctcaccttcagagggctacacgccctcacctccagaggactacacgtcctcgccttgagaggactacacgtcctcgccttgagaggactacacgtcctcaccaccagagggctgcacgccctcacctccagaggactacatgtcctcgccttgagagggctacacgccctcaccttgggtactag

SEQ ID NO: 57807 - DNA, 286 bp, Glycine max
  Peptide Sequence Number=SeqID_149492
atgaaccttggagcaaggtgcaataaagccagtcctttgccactccctctaaagaatgaggaaaagccttcagaaatattggtgatcctcttggacatctggggggctagaccatctgagattagggtgattcctccatccagggttgtatctgttgttggagaggtcataaatgttctaatgtggttgatttggctgctgaggttgaggaggtctattgtaaatgtttgcagcataagcttcaggatgctcaatttgctccaggttgctgcatggaagggcagag

SEQ ID NO: 57808 - DNA, 399 bp, Glycine max
  Peptide Sequence Number=SeqID_149493
atggtagcctggcccgggacccaaccttctcttcacagggaagatgaaggtcccacaacccaggtacctcagcatgtggaggatgagtcatatgaggccaccatcccagagccatttgttataggagaagaggcagaggagacacaggtgagacaagtagttgctgccacacctgagcgatcccttgaggctacttcagagccttctacgcaaggggaggatatacccttacctcagcctacagcagaccccttcactcctcttctagagatgccagaggactcgactacatcagtcctggctatggacacttctcctccagctactccagtattgcatctgacagatgaggaggatgttcagacacaggacacccaggaccaatcacaggaattttga

SEQ ID NO: 57809 - DNA, 321 bp, Glycine max
  Peptide Sequence Number=SeqID_149494
atgaaaaattcaagttggtcgctacagacgtccggaaagagtgtgccgggttacgagaagaaaatgcagctaccgcaagagcccttgaacaagaaaccaagagggctcgcaaggaagagcatggccgtgacaaatttcatggagctttgggggcagcaacagtccaaaagaaacttgtctcagcatttatgcgagacagagaccaacatgttagctatcgtcagcaagtaccgagaagaactaaatctagccacgacccacgagcataaagtggcggacgagtatgcccaagtgtacgcggaaaaagaggctagaggaagg

SEQ ID NO: 57810 - DNA, 201 bp, Glycine max
  Peptide Sequence Number=SeqID_149495
atgttagccatcatcagcaagtaccagaaagaactaaatctagccatggcccacgagcataaagtggcggacgagtatgcccaagtgtacgcgaaaaaggatgctagaggaagggtgatcgacgcgttacatttagaggcaacaatatggatggaccaatttgctcttaccttgaacgggagtcaagagcttcctcgatga

SEQ ID NO: 57811 - DNA, 662 bp, Glycine max
  Peptide Sequence Number=SeqID_149496
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57812 - DNA, 198 bp, Glycine max
  Peptide Sequence Number=SeqID_149497
atggacgaagatcaattgacatattacagtgcgatgtccaaagaagttgatatggattttcaagatgcacaagattgtggtgtgaatgaaggacatcccgattgttcagatgtttttaatacttctcaggtctttgcaacccgagaagatgttttgaagtgggctcgaacggttgcccatgaaacggttttgttgtag

SEQ ID NO: 57813 - DNA, 578 bp, Glycine max
  Peptide Sequence Number=SeqID_149498
gctacatcttttgtggtacaagtagagggtacatctacttgggtttgactgagaacaagagagggtacatctcttgtggatcagttctagtaaagggtacatccactagggtttcaaagagaacaaaggaggtatcaagcaaaacatcattcacttcagccctaggaatagatgagtactttcagagtgtcaaattgtacttaatgccaaggtatgtgggtactcctcattccgttaacccatgtaaggaaccagaagatgaacacgagatggaacttcaacgcctcaatcagaatgaagaaaatgacaaagagaagagaagcgtagcccttaaagtctcatcttcaatacaagaagaaaacgaagaagaagatcatcttcagatgatgaagaagatttttccttctttgttaagaactttcagaaatacatcaataaaagaagaattgacaggcgtcagaatttcaataatggaagaaaatcacacgatgattctcaagtccttaggtgttacaaatgcaaccaaattggtcacatcaaggccaactatccgtcaaatgaagaatggtcggagaaaa

SEQ ID NO: 57814 - DNA, 830 bp, Glycine max
  Peptide Sequence Number=SeqID_149499
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattatatcagacaattttgtgccacatttttttgaggtcttaaattgggatgtgttctcaataatccttgcagagaaagatattcccaacttgaaacagataatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57815 - DNA, 108 bp, Glycine max
  Peptide Sequence Number=SeqID_149500
atgagcaagaggctccaagaggattggggtagagctgctgaagaaggccctagggttctcatgagcctcagagtagatttacgagcccatgggccaaggactccataa

SEQ ID NO: 57816 - DNA, 246 bp, Glycine max
  Peptide Sequence Number=SeqID_149501
atggaaatttatgtgagtgatcaactaggaaaaaaagttgtcatcatcaaaaagggggagactgtagaagcaaaacttcatgatgaatcaagaatgattcaaagatgttttgatgataacaaaggtgatgacaaaaagctcaaaggtcaatcaaagaatgagttcaagatgttcaagatagaatcaagaacacttcaagattcaaggatcaagctttcaagaatcaagatcaaaattcaagactaa

SEQ ID NO: 57817 - DNA, 354 bp, Glycine max
  Peptide Sequence Number=SeqID_149502
atggattcctcgagcctcagtccatttagaggtctgggcaatcgcagtttgaatctgaaagttccactgcagcggacactggcagatggtggtcatcctgcccaaggaacacttagttgtctgcctaaatcaaaggctcctgctaggtggattgtcgtcaagtgtaatagacaaaaagaaactactgagtgcggctactatgtcatgcactggatgtccaccatcattttaggaacttttacaaataattgggaagcgtattttaacgaccctagaccattggagcttgagagattaaaagcattgcggatccagtgggcgcagttttatctccgaattagagatcaggcctag

SEQ ID NO: 57818 - DNA, 1017 bp, Glycine max
  Peptide Sequence Number=SeqID_149503
atggaagagcagaagcgcagcgccccgctcacctgggtcggcgcgctgggttcgatcctgctggcgctggccagcctgcaggccgggatggcggcactgaccggtacgctggccggtacacaacagggcatcatcagtttcacccagggcaacgaacaggaagcagatcgcatcggcattcaggtgctgcagcgtgccggtttcgatccgcaggtgatgcccgcgtttctgcaaaagctggccgatcaaagccgcttctcgtcaaaaccaccggaaatactgctgacgcacccgctgcccgatagccgcctggccgacgcgcgcaaccgcgccaaccagatgcgcccggtggtggtgcagtcgtcgcaggatttctatatggcgaaggtgcgcgcgctgggtatgtacgccaccggccgcaatcagctgactgacgatttgctgaatgagtacgccaaaggcaacacgcgggaacagcaggcggcgcagtacggcaaagcggtgcagttcctgcaggcgaaagattttgccaacgcgaaaaagatcatcgcgccgctgctggcgaagcagccggataacctgtggttccttgatatcatgaccgatatcgacatcggtctgaaccagccgcagcaggccatcagcatgctgaacgccgcccgcggcagccagaccagtccggtgctgcagcttaacctggcgaacgcctacgtcgaggcgaagcagccggccaacgccagccgcatcctgaaccgctacacctttgcgcaccctgacgatctcaacgcatgggatttactggcgcaggcttcagccgcgcaggggctgcgcgatgaggagctttcggcacgggctgaaagtctggcgctgaacggccagctcgatcaggccatcaccaccctgagcagcgccagcgcccaggtgccgctcggcagcctgaagcaggcgcgttacgatgcgcgcatcgaccagttccgcgagttacagcggcgttttaagcagtatgcaaaagggtaa

SEQ ID NO: 57819 - DNA, 279 bp, Glycine max
  Peptide Sequence Number=SeqID_149504
atgggatcaagtcaaatgccttcacttaaaaagaggttttatcaagtcaaggtcaagagcctagggaccaccagtctaaaggagttaggacagttaatgggtcagctccagcggcaagcttttcacaaagcttacggtaaaatctgtgacttagccatggtagatgtctccacagaggccattgcctccctcgcccggtattatgatcagccgatgaggtgcttcacctttggggacttccatctatcacccatggtggaagaattgaagagatcctag

SEQ ID NO: 57820 - DNA, 112 bp, Glycine max
  Peptide Sequence Number=SeqID_149505
atggaagagaatttcgaatcagctttgtctgcaaacaaggaagctataagtaatgcaagtaagaatctcatggagagttcaatccgggctcaggatgacatgccttacacat

SEQ ID NO: 57821 - DNA, 384 bp, Glycine max
  Peptide Sequence Number=SeqID_149506
atgttggatcaatttgcgtcattccttcaaggtttcattcgtgacgttgtggatgtgaaagcggacggtaactatggatatcggtccattgccgctttattaggtatgggggaaaattcgtggccgttagtgcgtaatgaattgattaaagaagttggcaagtggtcgcatgatacattgaatctcttcagtggagaaactagcaatcaaacgattatcaactcaaggttggctttcatttatccaaatggatcgattattcacaatgatactggggtttacttccaaacttcaactccggtgtccattcgagtaccaaataggtgtgattttgcaagcctaaaaactagaatacacaatacccttcagctatccgacaaataa

SEQ ID NO: 57822 - DNA, 261 bp, Glycine max
  Peptide Sequence Number=SeqID_149507
atgggtcaacttcaacagcaagccttccgcaaagtctatggtaagatttgggacctagctagggacttccagctagtgccaactgtgaaagagtttgaagaaatcctgggatgcccactggggggaaggaagccatatcttttctctgggttctatccctcaacgacaagagttgccaaggaagtgtttggaggaaagggcaaaggccttggcaaaatcaaggcgaatgggcttcttttatcgtcatcttggcgcttttga

SEQ ID NO: 57823 - DNA, 252 bp, Glycine max
  Peptide Sequence Number=SeqID_149508
atggtggcgtctctggtgctctctagaactcctcctctgattgctctgttagggttcttgtgcgtcagaaaagaaaaaggggcagaaatcgagaaactaggcaagaaccctagttgtctatgtgctgttatgctctccaacacagccaaaatgtctggagctgaccctaaggttgccataacaatcccaaaacgctgcaaccttgctaatcgccctattggttacaagtgtggaccttacactcttccttaa

SEQ ID NO: 57824 - DNA, 333 bp, Glycine max
  Peptide Sequence Number=SeqID_149509
atgggtattgtgaataaggctcgtgtgttggtggtgttggtaatcttgattgcttcatcagtggcagagaagccttctgttgtggaagcaaggacactttccttaacatcatctcatcaagggtactcgaaattttttgccacgcttggacttgtttgcaagtgttgtgacggggttggagcttttgatctagataatttaattttcgtggaacctaatgatgatgcacaatctgaggaagaccttgatgatgatgatggagatggagatggtgatgaaagtgatgatattcatggagatgatcctattagaggattggacatgcttctttga

SEQ ID NO: 57825 - DNA, 159 bp, Glycine max
  Peptide Sequence Number=SeqID_149510
atgtcagtgaaaaacctcgttggacacccaggagtacatgacaagacaaaccacacactgctttatgattatccaattgattcaagagcaaagcgcaacctgcacatccacgttgtatcattaataagcaatatacaaaggttgttggcagttaattga

SEQ ID NO: 57826 - DNA, 252 bp, Glycine max
  Peptide Sequence Number=SeqID_149511
atgagactagagcctgagaagaaaaggagaatttatggaggatgtcataggaaggggtttggaatgcctgaagactatggatgggaagggaaatcaggaaaatttgtttatttcaacaacccaatgtggccagctttcacgtttagtgtaaattttagatacattgaatcttcatatagaaggtgtagtgctgctgtggcatgtctgaatcatgaccacttattggccggttatagtcaaataatgtattaa

SEQ ID NO: 57827 - DNA, 219 bp, Glycine max
  Peptide Sequence Number=SeqID_149512
atgaaactttcttctacacaatctccagaacttgtagctgaagtttcttatgtgtctgactatgggcaggagaaaaaacttcatcataaaagtctagtggtagtctttgttgcatctttatttgtggaacccgaatccataggtttttcacccaacaaggacttgttgtttgtagtggacttattttgtttgacaggagtagcagaggtaacagattag

SEQ ID NO: 57828 - DNA, 555 bp, Glycine max
  Peptide Sequence Number=SeqID_149513
atgaaaggaactttctacccagagttggtaaaagttttctatacttgtgcccgcactaacatggaaggcaatttgtactctactgtcaatggtgtagagatgatcattgatgctacagtttggaaagcagttgcaagattggatatgggtggagtccagaagttcgaagaatctgcagatggctacaataagatgcaaacatacagaggtatgctccttgacctagcaaggaatctgagtaaccaccgaggaattggtggtttaactaacgacgacttacagatcgtatatgggctgaaatcaaatattatgttaaagagccaacgattggtggattatgagtttccatatgttgtcctagcctctagattcattgattacttcaatatcgatgtttctaatgggatagttgaattcaccaaagcctctaatgagataatcgaaaggcatctcaagaagcttgggatgagatatgttgatcatgaatggattatggtcgaagagccaccaacaacagcaaacatagaccagatggaagaagaagaagaagcttaa

SEQ ID NO: 57829 - DNA, 186 bp, Glycine max
  Peptide Sequence Number=SeqID_149514
atggcaaactctgaatggttatcaaggaatcagattcgattcttggaaacctactctgaagactccaaggtggaaaaacttggtgttgcgatcaccaaaattgatccagtcctgtctcgctcgccctttgagctcacaccaactcctcgtggtccaaaatctgctgaagatcagaccaaatcatag

SEQ ID NO: 57830 - DNA, 333 bp, Glycine max
  Peptide Sequence Number=SeqID_149515
atgagatggcaagtgggcataagatttgaagaacctaagggaattagtgagtggtactactcgatatttggtgcacttatttggcgtagggaactcacatgcctcactttgctactcctaataggttccgagactatacttttcagagttgggagcttggggatcggtatacattctacccgacatcgagagtgttgtttgcctagaaaaatcatacatcattgttatgtcactgaggaccgcaaagatcacactaacatcatgcttgaggaggaggaagtgtatcgcgagcttctacgagatttaaagccttcttttgaggaggaggattga

SEQ ID NO: 57831 - DNA, 153 bp, Glycine max
  Peptide Sequence Number=SeqID_149516
atgaagtatgtatcagctgttgttcgaatatgttccctgcaaccaccattaccaaacaacaacaacaaaacaagttcgagccggaaagttgctccacgtcgtggggttgattggaaggagaagaggctagctaggcctgcagtgtcaaagatg

SEQ ID NO: 57832 - DNA, 984 bp, Glycine max
  Peptide Sequence Number=SeqID_149517
gatactccaacctatgggattaacatgagccacacgaagattccaaactgcataccaccaaggacagagtcatacttcaaatcattcatgccttccctgggaagggcgactcaaaccggacatcgacccggtagcttgcttcagagctcaaagactaaagggggccctcaacttcttacgctaatgggatcccccatccccttcattgcacttcatcttggttgttgcaggaggaaacacgagcgaactcgaacatcttgttggacaagctattcagcgacacccaaccaatcttcttggtcagcttcatttgaaagaagtaaaggaacatgggcacggccacgctcaagtgcctcagcagggcacattggaaagtgttcaatgaaagggtcaagttcaggacctcgaacatgcaatggagttgcccaatttggccaactcaagttgacgccatattgctctgacacccacagaggacggacgaaaagcaagctcaccctagacaatctatcatttttaacccgtaaaatgtttatcgaagctggggggcttgacaagcccacaaccctcagatttgtcgaggttaccaccctcgacattagacaacctttttcaccaaaagccctcctcgttagccctagtacagaagcacatacactactcgctcagcagccaggtggttgggccattaagttgttgagttattacgctattgtaacaactcaaacaatcaaggacccagggatcccatccaacgttataaataaccaggagattgtggagcctatcctggcgacgatctaccctaacatcagtctgctccagattttggaaagtacaatttttaataagaaagtatcatgccatgagttggaacacgacgatgaagccataatgttgtgggggaatggtcttgtgcaatcttcccaagatgaatactacttgattaatgaagttaagttaggctcttcagagtggaggtga

SEQ ID NO: 57833 - DNA, 930 bp, Glycine max
  Peptide Sequence Number=SeqID_149518
atgtcgggaattatcttcccacctaggttcatagacaacttcaacaccctcattgaatgctttagcattcatccagatctgaaatattatcctagagatagtgttgcattccatgctcctcgccctacggcccgacaagtccacggacacaccaagaccgacttacaccagttggacgagaggcacaagccacacaagcgtcggcctctcccaaaaaggcctaggtacgagcgttacaaacccttaacggccaaacacactacaattctggaggaagctttcaacttagaggagcaagacctagaggacaccaagaggagcaacataggaaccacaaagcagatagaagaagagatagagcagaagactgaggaagacaaagacatctccaacaatggcatgagtgacaacctccacaagaacaagaacccacccagaatattagagtcccagaacatcaacatcaatgcatcatcacaacaaagtctccctcccatgatctttacggataaggacttcaagagtatcaaccctgtcaaccaggataacctcgtggttgtctccatcatcattgtaaacttgatggtgtccaaggtccttatcgacatgggaagttccactaatctcctatattggaaaactttccaaagactcgaggtctcactcgacactgtccacccttacatcattccactcctcgactttacaggcaagagagtagagaccagaggctacatggactgggcagattgtaaccgccaaggcagactaaaagaaagcacaatagtgctaagcagagagcttgaagggtctccaatcatagccctaactgtctaccaagcaagcctggacaatgaatttgatatagatccacgagacaacacctctaatagaggcctaaaacccatcaaagagcttgtcaagttgtag

SEQ ID NO: 57834 - DNA, 348 bp, Glycine max
  Peptide Sequence Number=SeqID_149519
atggagcgaccccacaaggaagagctcataaacctaaaagctgagcacaatcagctggaggctcattttagatgccctcatagtgacgagcactctgctcatacactatctgagcatactcaagaggaatcacacgcccgacacccagcaaatctgtacaccaatgacgatgcaatcttgtgttatgtcttcccaaagtctctcaaaggggcaacattgacatggtacagtggacttcctctaaggtccattgacaacttcaacactcttgttgagcatttcaatgtgcaatatgcaaccagccgatcacatcatatgacatcggctgctatggcccgccagcaataa

SEQ ID NO: 57835 - DNA, 873 bp, Glycine max
  Peptide Sequence Number=SeqID_149520
atggttaggtcaacatctattctagatcttcctcttcctcctcctcgaacaacgagtcaaggtagtttatgtcgattggataatgccacgaaaactcccgacttaccttctttgtggaatgttgagcttaaagggtcccagttcatcaagactaaagcactattgtctaagcatgatgcagatatgatgaactatattggtaagatagctaaggctaaggcaaaattgaaagttattgtagaggtgaaaatgaggttaaaggttgaagcaattattgaaatccaagaaaaagatgatattgaagggttgaacaccaagttggacaaactagttaaggatgatgttaactttaaaaggcttgtcgagacattaagttatcaattggctgctgaggaggagaagaaaaagtctatcgtggttgaaagggacgacgccttagaaattgtcgatcttaagaaggagaaggaaaagctaaatgcaaataagcttaaagagattcagcatgcttatgtgttaggctatgacaagggatttaaaaaggctctgcacaaagtagcactccttgcacctaaactagatttgaataagtttagtgtggctatgtatattagagatggtaaattggtgagggaaaaccagattgatactttcaatgagtctgaagagaatgaagtcaattccaaggtaggagatagcaagcaagaccctgctccaattgttgctcgcgtggactatgtagaggtgtcgtactttggacatttggtgatcaaaggcaacttcttcgttgttagaaagttcactacaaaggtgccacttccagcaatggaagataagccaaaggaaggcgccacaaaggtgatggatagcccctga

SEQ ID NO: 57836 - DNA, 693 bp, Glycine max
  Peptide Sequence Number=SeqID_149521
atgtcatcatggttcttaccagggttaaagccatgtgatcataacaatatatgcactgaaactaggaagattcatgaagtgagctttgttgctgatcaatttgatgataatcatgctgaagaaagaaagcagaaaatttcctttttcaactggtggagctgtggtttgtgcagtggactcattctagggtcgaccgtgactgtttatgtacaagatcatgtgaattggggagtttctgatatcatcctcaaattggtcatggctatctcattgctcatattcttgataggaaggttcttgttgctgctatttccaaacgagcttctatatccttccaatccaactcaattgtatgaagtttccaagtctgagggtaatactgaaagatttttggctcacacccagacactcaagttcttgattaaaatcataggaacccatattgacaagaagtgccccttcacaggcaatgtttccatccggggtcgtatcttagccggtacttgccacagtgctaagatgacaaggaccatcattgttatgaggaattatcttcattttattaagaaataccagaggtattccccttccatacctttggccaatctcaaagacagtgtgagtttcaatgtgttaaaagtgattccagctggttcctctagtggtgcaaagaaggtatttactggaatgtga

SEQ ID NO: 57837 - DNA, 552 bp, Glycine max
  Peptide Sequence Number=SeqID_149522
atgttcattctaaccccaattgcgataaactcatcccttacctctgagcggactcacgtgtcatcagctagcgatagtaacatctctagcggttccctgagattccttcagttattcctccaagatcctttcagttattcctccaactgcttcgatagaattcccaaacgtcagagagacggagaagagattgaaacctccactttttacgaaaattgggatgttacatttgacagtagaacaaagaagaaagttcttcagactatcggcgagaggtggaggcagtttaaatctgatttgatgaggaaattggcacttgcagccgacaaggacggtatggacgacactgtttttgagaaatacgacatcagtaaggagaaatggacccagttttgtcagacccacagagacccctcctgggagttcggaagcactgagggtgtcattgaccctccatctcccatcagacgacatgtgaagtggaagatggtccgcaccaagaaagttgggcagatgacgtcagaggtagcaaaggaaatcgctgagaatatt

SEQ ID NO: 57838 - DNA, 279 bp, Glycine max
  Peptide Sequence Number=SeqID_149523
atggggttgtttccaaacatattcttgaggggtgctcttttttctcgtaaaccccatgcatggcaccaccactattggcgctttcggggaggagctgacacgtggcgctggtgtcgccattcccaccaacgccttgcctttgtgcttacgtggcattggagtcgcaagaagcaatggcgcgttgaggaaggcgccagtcaaactggcgtgttgaaggccctagggtgtagcaacgtagcccagagtgaagtgcaggctgcaacagggacgtgccactag

SEQ ID NO: 57839 - DNA, 242 bp, Glycine max
  Peptide Sequence Number=SeqID_149524
atggagccatttatgaaatacgagtctgacaacacaaagacaaaaaagcacatctggactcttcaacttactcaggaaatgctggatgatcctgaacccctgaaactcccacattgtacagaagttcctcttaaagcttgcggtaaccacatgacagtcttaaggcgacatgaccccccactgcaattgaaagttgaaaccctaaatcctgctattggtggaaaaggtgttgtccaaccatg

SEQ ID NO: 57840 - DNA, 375 bp, Glycine max
  Peptide Sequence Number=SeqID_149525
atgaagatgctcgaggactcctttgaaagtgttgcatttgaggtagtagaggattcatttgaaggtcttgcggtggagatagtgaaggactctgttgaaagtcttgcagtggaagtagtagaaaattcattcaaaggtcttgccatggagatagtggaggattcctttgaaggtgttgatgtcatcaaagacgctgatgaaaataaggttaaatctaaaagatttgatgaatcaattgatcatggtagtgaaattgtggttgttccaaaaggatttccaaccattaacttgaacaagattccagaagaccactcacattatcatatgttattgaaggtggggttgtttaaagggggtttccaaccatcgtcttaa

SEQ ID NO: 57841 - DNA, 294 bp, Glycine max
  Peptide Sequence Number=SeqID_149526
atggacaccggagttcgtagcctcaaaagcaataatggattaaactttggtttagccattgaaaagcctatcaaagtggataagaataacttaaacatccattgtgggtctccatattttgtgtgcaaaacgtggttgctatgggcacgtagcaaggaattgcaacaagattgcttcaaaggcaacaacgaaccacctatagaagtgccaaaccataccaacgataacacatcagcatcttctgagggacctagtgatgtcatggcacatggggagtggatggtggtaaaatga

SEQ ID NO: 57842 - DNA, 165 bp, Glycine max
  Peptide Sequence Number=SeqID_149527
atgaaaggtcttattgttgaagaactgctcgaagccattgttcctactgtagaagcaagcttcatgaatgagtttaagattgagtcaagaacacttcaaagatcaagaggaaatttgatttcaagaatcaagaatcaagattcaagattcaagattcaagaataa

SEQ ID NO: 57843 - DNA, 147 bp, Glycine max
  Peptide Sequence Number=SeqID_149528
atggcgatttgtgtgaagaaatggaatctgcttcttgactatgggttcttaaactactctagaaaatgtttagtgcaggtgaaaggaattaatgaaacattgggcttaatccggattttggttatggacttgaagagggcaaattaa

SEQ ID NO: 57844 - DNA, 515 bp, Glycine max
  Peptide Sequence Number=SeqID_149529
atgaatgatagcgatactgatggtgatgacgcacgtgagaagaaaggaacacactcatccgccaaacctaaaccccttttgcctcactcttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57845 - DNA, 1830 bp, Glycine max
  Peptide Sequence Number=SeqID_149530
atggctgagggttttgaggcttaccatgtgccacaacaaagcagaagagataagctgagggttgtggcgacacagaaccaacatggtctcgttgagccctcgtctttgcttcctttgtacgacccttcttcgtttatatcttctgatttgttgacaagcttccacaacggccaaaaacacaacttgggttgtggtatgaaggaagaacgtgcgaatttgatgatgggttttgcagcagcagcaggagggggaggagttatgaacaacggctcttcttcttcgtgttgttcttctaactcctcttctgtttcttacttggatcctgaatcgtctttgcctttgaaccaagccacaattcaggttattaacaatagcaacaacaacaacatgtttctctaccaagcacagaacctgagagagtttgatcagggttataataataataacaacaataatagtgaaatcatggtgtttaagcccgagcctttgtctttgtctctgtcatcacacaacaacggtgtgaatcttcagcgatatggatctgtggtttatggtgataaggttggtggggttggtggtggtggtggtggtggtgtagtgatttatggtggttctggtttgaatgaggtttcaaggtgcacagtgccaatggggccatttactggctatgcttctatattgaagggatcgaggttcttgaagcctgcgcagcaattattggaagagttatgtgatgttggtggggtttgtgctgagaagattgtggctgatgcatcattaatggagcctattcctccagagagttcaagtgaagatccattaggggatcatgggggtgatcagggtcgcaaaaaatctaggctcttaactatgcttgatgaggtttacaggaggtacaggcaatactatcagcagatgcaagcggtagtaacttcatttgagtatgtttctggcctgagcaatgcagctccctatgcaagtttggctataaaagctatgtccaaacattttagatgcttgaagaatgcaattactgatcagattcagtttgccaataaagctcattttcatatcagcaacaggaaagatgaatctccaaggtttggcaacagtgatagaggcccatatggccaaaggcctgggtttcttgagcaccaacctgtttggcggcctcaaagaggactccccgagcgcgctgtgactgtcctcagagcatggttgtttgagcactttctgcacccttatcccactgatactgacaagctaatgttggctaaacaaactggtctatctcgtagccaggtgtctaattggttcattaatgccagagtaaggctctggaagccaatggtggaagaaatacatatgctagaaacacggcaagctccaaagaatctgcagaaggaagaacattgcacgaacaagccaagtgatcatttgccttctgataactccattgtttctgagaatccatctacttccacagataaatttcaggaagctccttacaagcgtgccataaacgagcttcctaacataccagtcaggactcaggaacagctgaatcttccctgcacaagcaatcagccagggggtgttggagtgagcatgggtggcagtgcaagcaatagtgtgtcactcacactaggcctctatcaaaaccatggtattggtttggctgaacctttccccttgaatgcagcgcagcgatttggtgttgctcttgaaaccaacaatgaaggctacgttatgagtgattatgagtcacaaaataggcattttggaagagatgtcattggaggacaactgttgcatgactttgtaggctga

SEQ ID NO: 57846 - DNA, 255 bp, Glycine max
  Peptide Sequence Number=SeqID_149531
atgacgggagatgcatcgaaattcacccatatttctcccaagaaaagtggacatgtgacttatgacgacaacaataaaggtagaattcttggagttggaaaaataggtacgaattcatctacctccattgaaaatgttctacttgttgaaggtcttaagcacagtttgctaagtataaaaaacaaaaccatgatcaatgttttcttagtaaagatgatgagccttggttatggcatagaagaattgcccatataa

SEQ ID NO: 57847 - DNA, 114 bp, Glycine max
  Peptide Sequence Number=SeqID_149532
atggaggtcacttacctaagcttgatggaagaagggctcaagaacatttgccatggagttgcagcggaagataaaggagaagaggtgagaggaggcgccatccactgggaataa

SEQ ID NO: 57848 - DNA, 351 bp, Glycine max
  Peptide Sequence Number=SeqID_149533
atggaaccttcctcaatcaaaccaaatacttgtgaatgttactttcaagattacttcaacaaacattcaaaggttaagcattgcttcaagattaagattttgcctcaaaacaaagtatttccaagagatcaaggctctggtaatcgattaccaggcaattcagtcattgaagcatcccttgtggaagcaaatgatgacatcattgaaatcgttcctggagtggctcccactcatcctaagccagtgtctaatgttgatgaacaactctttctactcagtatgatacaacagatgaagataggccaagacgattcgaagcgatctatggaggcccagaatctatctttatag

SEQ ID NO: 57849 - DNA, 435 bp, Glycine max
  Peptide Sequence Number=SeqID_149534
atggaaatctttattcaatcaattgatcccggtgcatggaatgccattattaaaggtcctttcattcctactaaagaactgaatggtgaattaatacctaaagaatggaatgaaatgagagatgatgagaaaagaaaagtgcaagattatcaaaaagcaaaatatattttaacttctagtttatcttttgatgaactctttcgtactgcaacgtgcaaaagtgaaaaagaaatctggaatatgcttgaggtcattcgtgaaggcacaatggatcaaggccatattaaatctaagtgtcctatctaccttagaaaacatggtggtgaaaagaaagggaagaaggacagaaaacaaaagaaagcctacatagcatgggaagataatgcatcaacaacttccaactcttcaagtgatgaagaaattgctaacgtgtga

SEQ ID NO: 57850 - DNA, 255 bp, Glycine max
  Peptide Sequence Number=SeqID_149535
atggaattactccttttgagagttgggcttagggaagaggaaagaacaagtattgctaggttccttagtgaacttaatatgaaagtgagggacaaggttaagctccttccatataaagacctagatgacctagtccaactttgcataagggtagagcaacaacttaaaagtaaacctacttcaaaatcttatggcccagggaaacctcccttagcattgccatacctcttgagcataaggttattcctcaagtaa

SEQ ID NO: 57851 - DNA, 162 bp, Glycine max
  Peptide Sequence Number=SeqID_149536
atggtattttcctcaacttctcttcaccaagaacacctcaacacaacgagatcaattatagtagaatggagaaggaagaaagatgattggagacaccacttcaaggagaagatgagccaagaagaagctcaccaccataggaagccatggataagagcttga

SEQ ID NO: 57852 - DNA, 501 bp, Glycine max
  Peptide Sequence Number=SeqID_149537
atgaaacttctacaagacaaaatagttgcatccattcttgaggaagagactcatttctctgacttattatcacctgattcaccatcatcaagggaatccgccactcaattacctgaagtcatgaccatggcagaagagcatgaccagaggattacccttgaggattactcaacaagagaagccaagaggtggctccactcattcaagggtaacaatctgaaaacctgggaagaagttgttgaaaagttcctaaagaaatacttcccagagtccaagactgtggaagggaaagctgcaatatcttcatttcgtcaattccctgatgaatctctaagtgaagcattggagaggttcagaggttgtaccatctgtggtgaagctcatgaaacaggccaatgtattcccattgaagaaacactcaagaaattcattatatgggaaatcaacagtgacagggaatactcaaggacgattttcaggcttctagcaaggtccctataa

SEQ ID NO: 57853 - DNA, 337 bp, Glycine max
  Peptide Sequence Number=SeqID_149538
atgactaggggcaatccaggtgatttacaaccctttgatcctgaaatagatagaacctttcatagattagttagacatagtgtgcatcctggtcattctgtgcattgtgagcatttggagcattctgttgagggtgattctgattttgaacattccactactaatttttatactgagaacatggctcaacctccacctcgtgagaggaatcttaaggagatggctgcacctgatttcacttatgaaagcttgtgcattcaatatcttgatgagggtgttccatatgttctcaagactggactaatacatttgctgcgcaagtttcatggtcttgcag

SEQ ID NO: 57854 - DNA, 627 bp, Glycine max
  Peptide Sequence Number=SeqID_149539
atgaggatacgtaggagcaaaagccttgcttttgtcaaccaccccaccttttgttaccgtgacccaagagtctggtggcatacggagacacccaacggtaacccgcacacaccctttgctatcgagcgacacgagagtctggtagcatgcggagacaccttacggttatccgcacctcgtcattcggagaccccaagttcgattgacaagcagccaccaatgtggtcatttgtaccctttccgaagatgtcagcatcttccgacactaacatcgtcatctacaccctttgtcaaccaggggcaagcgagcccgttgacacgcagagactaacatcgtcttctgcacctttgtcatccagagacggcgagtccgatgacatgcgaagatacccaagtgagacggcgagtccgatgacatgcggagatacccaagtggttatccgtacaaaccaacttctgttaatctcgacccgtgaagtcaggtggcaggcggaaataccccaagtggttattcgtacaaacgcacttctgttaatcctgacccgtgaagttaggtgtcaggcggaaataccccaagtggttatccgtacacacacagttcttctaccccgacctgtgagaagccag

SEQ ID NO: 57855 - DNA, 270 bp, Glycine max
  Peptide Sequence Number=SeqID_149540
atggccaaaatacaaggcccaaaagaaggaaaaacctattctaatatttacaaagaatggacccagccttggctcatgggctcagaaatctaccctaaggttcatgagaaccctagggccttctttagcagctctagcccagtcctcttggagtcttctatgcaatacccttggcgggtaggattgcatcatcccctcccccttggaaaggatttgacctcaaatcccgaggttcttgatactctgggcttcctccctcgacacttgtaa

SEQ ID NO: 57856 - DNA, 297 bp, Glycine max
  Peptide Sequence Number=SeqID_149541
atgtctcggaacttcacgtattgtgcaacaaagggtgctaagtacctcgaagcggtcaaacaaaggttacatgccatgaaacaatggtccccggatgaatataggatttttatataccaaattgaagtggtctggcggcaagcaacgacggcttgtggtggccaccattggtcatgggtggtgaaggagaagatcgcacttagaaagctagtcttgctaagcgaaaatccacttttggcgctcagcgcgacctctcacgctgagcgagttgcctcctcgggttggaattgcacttag

SEQ ID NO: 57857 - DNA, 114 bp, Glycine max
  Peptide Sequence Number=SeqID_149542
atggaaatggctccgaagaagcttcttgctaaaagggataggaaggccaccgtaggggagggatccagtgcagccccgcaaggggagattgagtttgacggacaccgtttctga

SEQ ID NO: 57858 - DNA, 639 bp, Glycine max
  Peptide Sequence Number=SeqID_149543
atgtggctacatctagacgcttcatctaccagtcgctgcaagcagcatgcatggtctcccgtggctgagacgaaagggacgaatgtttgtttcacatcggggagtcacacgatatggaaacctgtcccgcggtggaagaattgcttcaacggctcatggactaggggcagcttgaagtgtccaacggagggagggaagaaccacagatttgcatgcagtcggaagaaaagaaggaaagggaccagatccacgcccatatacccccagacagcgcccaagccgacgccgtttgcatatcaaagcaataaggccgttccgtggaagtatacccctctcgtttttggagaaagagttgcaaccgaggttgactccatgtcagccaaggtgtccaacatcaccggcctcagtgacgtaacccgtagtggtcgggtgttcgctccccctcactcggcggaatttccctccaaagggaaagtgcccatggtccaagagcccatagacatagccaccccctcaaaagaagtggatcctccggtggtaaagggggctgaaaagaaagaaagtcttcaaggaaagacggtgactttggaagaggctcatgagttccttcgcctcatccaacaaagcgagttaaggtag

SEQ ID NO: 57859 - DNA, 276 bp, Glycine max
  Peptide Sequence Number=SeqID_149544
atggctccaaactcgaaggtggagagacccatgaacgaaaacgcaattcctgggctccgaaaaaggttgagaatggagaatttcactaagcaatctacgcatagctccaaactcgaaggtggaggacacatgaacgaaaatcgcaattcatggggctctcaaaaagggttgagaatggagaattgcactaagcaatcactacgcatgaagctccaaactcgaaggtggaggacgcatgaacgaaaacgcaattcatggggctccgaaaaagcttga

SEQ ID NO: 57860 - DNA, 294 bp, Glycine max
  Peptide Sequence Number=SeqID_149545
atggtcctaggcaaaccatggagtctaacaacttccttgaaaaagagttttgagatgtgggaagcatcatccaccttgtggcatgatataaagtgtgccatcttgctaaacctatccaccaccacaaagatagagtctacacctctttgggttctaggaagcccaaggacaatgatgcaatcctacctcgcaagggcattggatagaagactccaagtagaatgggccaaagatgcaagagaaggccctagggttcttatgagccttagggtagatttcgggcccatgggctaa

SEQ ID NO: 57861 - DNA, 469 bp, Glycine max
  Peptide Sequence Number=SeqID_149546
gcaccctttagacccagataattctaacagggccttgggttttccgggattgatcacgggtctctgccaatcgttcggggttcctgtcgcacccagtaaggtgatccaactgccgatcacccgcgctttcatagagaagtattgcacagctagacaggcacagggtggcgaccctcaggccccagatgcaccgccgccacctcctcaggctaacccaactggatcatttaacatggagcgacccatgactctatatcagcttagcctcagcctgcagagccagggttttgcttcttttccatgccctactccggatcagttcagggcagaggtcgcatggcccagagattgtcctgaggcccaggcaggggaggcacccgcagaggctcccgacgaggcagatgtggcccgcgaggacgaggagatgaccgatttgcttgatttcttaggagggagcggagccacatga

SEQ ID NO: 57862 - DNA, 348 bp, Glycine max
  Peptide Sequence Number=SeqID_149547
atggtgaaagttggaacctcttacgtgccgaggtcaacgtctcatatcccaaaattggccctggtccggccttacagggcctacacctggccatcaagcttattcgaatatccgtcacaggtatttattcgggcaagtgcgtcggggcgcgtttcccattcgggaaacctgtcggtgcgcaactgttgcggccaacgggcgatcggtgcgggctttgcgctattacgccagggcgaaagggcggagtgtcatactggcattaatgttgggtacactggcagggtgttcagtgaagtgcttcatgtggcaggagaaaaaggctgcaccggtgcgtcagtcgaattgtaa

SEQ ID NO: 57863 - DNA, 372 bp, Glycine max
  Peptide Sequence Number=SeqID_149548
atggggacgaggggttgcatcagatacaatcccgttcttgctataaggcaccttggctaccctatgagaggggcaccactagagaaagagctcgcacctgtcatttcacgaggtttcaataagaccaacatggagacacttcagaaggtccgcaaggcatgggaggttgtgcaaaagaaggacaaagaactcaggggcagtaacaatgggcccatcggtggctaccgtaagtggttgaaagcccacgtgcaaggtttggattggctcccgagtttgagaaccgctaaaagggaggaagttgaggcaccagaggaagacgaagaggtgcaggcccttaggacggaactcaagcaagctcaaacagtcaaataa

SEQ ID NO: 57864 - DNA, 501 bp, Glycine max
  Peptide Sequence Number=SeqID_149549
atggcttccatgatggaggccatgttgggaatgaggcaactcatggagaaaaacatgcccaccgttgccgctgtcagttcggctgccgaagcagacccaactttcctagctaccgcgcaccatcctcccccaaacgtagtaggacgagagaagagcacacaggggcacaacagcaacccccatttgggatacaatcgggtggcttacccttatggattgtcgcctaattacacgccgccaatcatgcacgattatgcgggccatgtctcttcccccttccttgaaagggagcctcctcaacagccccacgaggcccatgaagatcatcaagagcatgcccaaggggatgttgatttctatcccccgatccccgtcgaggggtcggcacccaacacattgcctcagcaaaacctcacagcacaaccaatattcttgtccgtagaaggaccacccccggcggccgaagaagaaggaaactcgatcacctcgaggagagattga

SEQ ID NO: 57865 - DNA, 693 bp, Glycine max
  Peptide Sequence Number=SeqID_149550
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccaatgagccggcgactcataggcagtggcttggtaagggaaaccaccggagccgtagcgaaagcgagtcttcacagggcaattgatgaagcttgggtgaaactaagtggaggtcccgaaccgactgatgttgaagaatcagcggatgagttgtggttaggggtgaaatgccactcgaacccagagctagctggttctccccgaaatgcgttgaggcgcagcagttga

SEQ ID NO: 57866 - DNA, 288 bp, Glycine max
  Peptide Sequence Number=SeqID_149551
atggtgaaagttggaacctcttacgtgccgatcaacgtctcattttcgccaaaagttggcccagggcttcccggtatcaacagggacaccaggatttatgtattctgcgaagtgatcatccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttaccagtcacgacgttgtaa

SEQ ID NO: 57867 - DNA, 105 bp, Glycine max
  Peptide Sequence Number=SeqID_149552
atgctcaatggaatgccccggaactcttccatgcaggcaggccttgtggctgatttagggacgacctttgtggttgattgggtggtgggtaatgagaagggctga

SEQ ID NO: 57868 - DNA, 408 bp, Glycine max
  Peptide Sequence Number=SeqID_149553
atggacgaagatcaatggatgcatgatagcataatgtctaaagaagttgatatgaatgaggaaaatgaaaaggaatctggtctgaatgaagaaaatggagaggaacccagtgtgcatcaacatgttgattgttctgatgccttcaatacttctcaggtgtttgttacccatgatgatgctttgcattgggctcaatgtgttgcatatgatattggttttgtggcggtgattatgaggtcagacacagatactagaattagaggaagaacctcatttgttttaattggttgtgaaatgagtgatcagtatagagccagaaagaaagatttagtacgaactattactagtagtagaaaacgtgggtactcctttaagctgcgagtgaaaccagtggtgggaggtgaatga

SEQ ID NO: 57869 - DNA, 468 bp, Glycine max
  Peptide Sequence Number=SeqID_149554
gagaggccaaaaggtggcttcaatcgtttaaggaacggtctgaaaacctgggatgaagttgttgaaaagttcctaaagaaatacttcccagagtccaagactacggaagggaaagctgcaatctcttcatttcatcagttccctgatgaatctctgagtgaagcattggagaggttcagagggggaaagataaaactgaagaccccggaagaagcaactgagctaattgagaacatgtcagccattgatcatgccattctacgagacaaaacccatcaacccacgaagaaaagcttgttagagctatcatcacatgacactttattggcacagaacaagttacaggttgtaccatctgtggtgaggctcatgaaacatgccaatgtattctcactgaacaaaacactcaagaaattcattatatgggaaatcaacagcaacaagggtatactcaaggaggatttttag

SEQ ID NO: 57870 - DNA, 333 bp, Glycine max
  Peptide Sequence Number=SeqID_149555
atggcggtgcagctaatccgtgatcgagtagagatggagtgcctagagggagcttgggagaccctcgaaggcaacacgaggtgccgattacggggcaccattcgattcacggctacttctttgggtgctattccagagaacctgcacggacgcttcgcgcacggtggagtggatactcccgactcctacccggatagtcgtctagtggagaacctgtatgtccaagtgatcgaggctaaatctgagcagactctacggaggatagtggccctaggggagatggctctggtcagcggaggctcttacatcatagtggacagctcttcggattag

SEQ ID NO: 57871 - DNA, 537 bp, Glycine max
  Peptide Sequence Number=SeqID_149556
atggcgcctaccaggcaccctctggacccggataagtccaacagggccctgggatttcctgccttgatcacaggactctgccagtcgttcggcgtccccatcgcacctagcaaggtgattcggccgcccatcacccgagcttttattgagaaatattgcacacagagacaagcccagggggatgctccgcaggccgcaggcgcgccgccacctcatcaggccagtccagccggatcgtttgatacggagcagtatttgcggcatttggttcgccagcaggcggccaaccaccaggcacatgtacagacccatgattgtctttatcagatgagtctcagcctgctgagccagggctttacttcttttccgtgccctactccggaccagttcagggcagaggtcgcatgggctggggattggcctaagacccaggcaggagaggcaccagcagaggctcccgacgaggcagatgaggcccgcgaggacgaggagatgaccgatttacttgatttcttaggaggaagcggggccacatga

SEQ ID NO: 57872 - DNA, 276 bp, Glycine max
  Peptide Sequence Number=SeqID_149557
atggctcccgatcggaaccagcttcagagtatgaccaagcgagaacatgagtccattaaagaatatgcccaaaggtggagagatctcactgcccaagtcgtcccagcccatgatggagagggagatgattacaattatgtagaaagacaccggcctgcaactgacccgcagctccgggtgttcactccccccgctcggcggagttcctccaagggaaacgctccatggcgcaagagccacagagtaatgcacggcgccccccctcgaaagaagtag

SEQ ID NO: 57873 - DNA, 486 bp, Glycine max
  Peptide Sequence Number=SeqID_149558
atgtataatactacaataacctatattggtctccactacagtgcacactggcaaatggtcgtcattttgcctaaggaaaatcttgttgtctggttttgttccttgcataataggccagacaactactttaaaggaataaataacaggtcattgttgtttttcaatacatttgcattggcattactcaacaaaatcaatattttaatgttccttgtattcaacaatgcattgaaaggacttgatgatactccacaacctaaatccaaggctggtgctaggtggattgttgttaaatgtaatagacaaaaaggaagcactgagtgtggctattacgtgatgcactggatgtccactataatcttaggaaatttcaggaataattgggaaatgtattttaatgatgttagactattggaagcagagagattgaaggcgtttcgcatccagtggacacaatattatctcaaagttagatatcaaacttag

SEQ ID NO: 57874 - DNA, 435 bp, Glycine max
  Peptide Sequence Number=SeqID_149559
atgccgccgcacaatacgtttcataaccactacatgcaattaaaaggggtatctcaaggcttttcatctctgttaatcgattacacagccttggctggtaatcgattaccagaggcctccacaaggttccagtccccttttctaagcctggtaatcgattacacccctgggcaatcgattaccagaggcttccttagcttcttgacctcgttttcaagcctggagctcgcctatttaggtacatcacaggttctcactgaccgactatgcccgggttgggtcgggattggtcaagcttggttttgggcaatagcacccaacctgacgtccccaaggtctcctgacccccgcgacatatctccaggtaccactttgtggtcaacaataaaagcaggaagtttcacccttcaacacttcctcatctcaagcttgtag

SEQ ID NO: 57875 - DNA, 798 bp, Glycine max
  Peptide Sequence Number=SeqID_149560
atggtgaaagttggaacctcttacgtgccgatcaacgtctcattttcgccaaaagttggcccagggcttcccggtatcaacaggtcgacaccaggagtttatttattcatggaaatgtgttatttccggtcacagcgtatttattcggcgcaataccgtgcgcctcggggtgatgctgccaagcttactgattccctagtctgttctcctgttcagctactgacgggatggtgtatccgctcacaattcggcacacaagcatacgagccggacatcagcgctggcaagtgtagcctggggtgcgacgctgcagctaactcccacaccgccgcgcttaatgctgccgctacagggcgcgctttcccattcgggaaaccatgtcaggctgcgcaactgcttaatgaatcggccaacgcgcgggcgatcgagtgcgggcctttcgctattacgccagcggcgctaaagggcggatgtgtgcatactggcgattactatgttggcactgataacgccagggtgttcccagtcagaagtgcgttcgtcagaaaaaaagcgaccggtgcgtcagtcagaatatgtgaatacagactcactataggttccgcgaattcctcgctcactgagctcgctaccgctcggtcgttcgactgcggcgagcgctcagaacatggccctacaacgggctgcggaattgtcctggaagccagaaataccacttattacagggacagtgagagggccgcggcaaagccgtttttccataggctccgcccccctgacaagcatcacgaaatctga

SEQ ID NO: 57876 - DNA, 827 bp, Glycine max
  Peptide Sequence Number=SeqID_149561
atggccaagttcgatccagaaatagtccttgagttttatgcccatggttggccaacagtggagggcgtgcgtgacatgagatcctggggccaggaatgtgagtatggccagaggaggaaccggtctgatgggttcgatgaggaggccatcgcccagctgctatgtataccggggcaggattttgcccggactgctgcagggaggcgagtgcgaatcatgcacaccaacatgaccaccctgacccagatatggatgacgttgctcctcagcaacatcctgcccagcgatcataattccgacctccccctgccgaagtgtcagctggtgtacgccatcctgacgcggatgagtgtccatgtggctcagttaatcgctgatgccatttatatttttgcaggtatggcgcctaccaggcatcctttggatccagataagtccaacagggccctgggatttccctcgctgatcacaggactctgccagtcattcggagtccccgttgcacctaccaaggctggccaggctggggcatttgacatggagcaatatttacggcatttggttcgccagcaggcggccaaccaccgagcacatgtacagacccatgattgtctgtaccagatgagcctcagcatgcagagccagggcttcgcttctttttcatgccctactccagaccagttcagggcagaggtcgcatggcccggagattggcccgaggcccaagcaggagaggcacccccagaagctcccggcggtggagaagaggcccacgaggacgaggagatggccgatttgcttgacttcttgggagggagtggagatac

SEQ ID NO: 57877 - DNA, 561 bp, Glycine max
  Peptide Sequence Number=SeqID_149562
aaaggttcaaatcagcagctctgaagatccgaaaggaaaatgccgagctgagagatataaatatggctactgcaagagcccttgaacaagaaaccaagagggctctcaaggaagatcatggccgagacaaattctgtggagctttgtggggtagcaacagcgagcttaagctccggagagaggaaagggaccaatcacaagtggacagtttgatcttgaaagatgagttgaagttttgctcaaggtccaaaagaaacctgtctcagcagatatgcgagacaaagacctacatgttagccatcatcatcaaataccaagaagaactaaatctagccacggcccacgagcatagagtggcggacgagtatgcccaagtgtacgcggaaaaggaggctagaggaagggtgatcgactcgttacatcaagaggcaaccatgtggatggaccgatttgctcttaccttaaatgggagtcaagaacttccccgattgctagccaaggccaaagcaatggcggacacctactccgcccccgaggagatccacggacttctcagctatt

SEQ ID NO: 57878 - DNA, 629 bp, Glycine max
  Peptide Sequence Number=SeqID_149563
atggtccccagaaaggaagaatggggccaaaacaagttccgatgggcgttgtggggtagcaacaacgagcttaagcttcaaagggtcgagagagaccagtcaagagttgaaggcattatattggaagacgagttgaaggcttgtcaaaggtcaaagagatgtttgtctgaccaattgagcaagacggaagaaaacatgtgggccatcattgaccaatataaggagaagctaagtctagcggcaacccatgaacagaggctagaggacgagtatgcaaaggtagaaccaagactgctagccaaagctaaggcgatggcggacgtgtactcggcccccgaggaagttcatgggctcctcgattattgtgcgagaacaaatgaaggccgatatggaggccttgaaggatcaagtagcttccatgatggaagccatgttaagcatgaagaggaagccatgttaagcatgaagagaataatggaaagcaacgcggccgcagttaccgccgccagcgccaccgccgaggcagatcctacccatccgtttgccacgaaccaagcgcaccaacccacctcggacatggtgggacaaaaaggagaggtgttgggcaacaccggtggtccacagatcgg

SEQ ID NO: 57879 - DNA, 54 bp, Glycine max
  Peptide Sequence Number=SeqID_149564
atgcagtggaagaatgcctcagattggtcaggagtgtcacacaggaccatctag

SEQ ID NO: 57880 - DNA, 423 bp, Glycine max
  Peptide Sequence Number=SeqID_149565
atgaagcacttcactgacaccctcatcagtgccaacataactctggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57881 - DNA, 342 bp, Glycine max
  Peptide Sequence Number=SeqID_149566
atgggggatcccatcagcagactctccttccctggtagaacgcattgtttgtcactcaaaaaagcatgtgctgctctaaacagtttggaatatttgtctcttgctaaagcatgtttgcatttttttagtggagaaaacaccgagactttttcaagtctcacaagttatccagaactacgtaggtctgagttccttattggaggatacgtaggagcaagagcatcgcttttgtcgaccataccgccttttgttgccatgactcaaaagctggtagcccgcggagacaccttacggttatccgcacctcgtcattcagtgaccccaagtgtgattgatgagtag

SEQ ID NO: 57882 - DNA, 387 bp, Glycine max
  Peptide Sequence Number=SeqID_149567
atggagagcaatgcggccaccgcggctgtcgctagcacggctgtcgaggcagacccagctctcccaactgctacgcaccatcccgttccaaacatggtgggacgagagagaagcacaccagggcatgtcaacaacccccatccggggtacaacaaaggtgcttacccctacggtttatcgcctaactacacaccaccagccatgcataaaggcgtgggtcacattactcccctcattatcgaaggggagcctcctcagcatcttgacggggtccacgagaatcctcgagagcacgctcaggaaggcatcgactcatactccccgtttcccgctaaggggctggtgcccaactcactacctcaacccaacatcatgggagagccttga

SEQ ID NO: 57883 - DNA, 282 bp, Glycine max
  Peptide Sequence Number=SeqID_149568
atgtatgacataattaaggaatatgccagatccccagtggagtcgccaactatcacaacctgctcttcgacgggggtgcgaaaaggcctctcgtatgggccaagggtgcgtcttccattgaaggaaaacgcatggagtcgccaccaacgtttattcaaggaaaatgtcggaaaaaccaaaatggaaaaggtcgaaggtttgcgtattttgaaaatgagggttcgggagttgtttacgcacgggaaaggtattagcaccccatgcgcccgtcacaagagatga

SEQ ID NO: 57884 - DNA, 301 bp, Glycine max
  Peptide Sequence Number=SeqID_149569
gggcaatccaggtgatttacaaccctttgatcctgaaatagatagaacctttcatagattagttaggcatagtgtgcatcctggtcattctgtgcattttgagcatcctaatcattttgagcattttgttgctggtgattctgaatgttctgattttgagcattcggctattaattttcatactgagaacatgactcaacctccacctcgtgagaggactcttagggagatggctgcacctgatttcacttatgaaagcttgtgcattcaatatcttgatgagggtgttccatattgttag

SEQ ID NO: 57885 - DNA, 327 bp, Glycine max
  Peptide Sequence Number=SeqID_149570
atgaggaatttcgcaaaagtttcaaccgttcttcgacgttcttcatccgttcttcatcgttcttcgatcttcaacgggctgtcgtcccttgtgacggacgtgtggggtgctaataccttccccgcgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcaagtcacgcgtcgccctcccgccgaagggtaggttgcgacagttggcgactccactggggactgtttag

SEQ ID NO: 57886 - DNA, 432 bp, Glycine max
  Peptide Sequence Number=SeqID_149571
atggcagtgcaattaatccatgatcgcgtggagatggagtgcctagagggagttagggagaccctcgaaggcaatgagaggtgccgattccgtggcacgattcgactcactgctacttcattggtacatccagaggaacccgcacgcacgcttcagcgaactgtggagtggatactacctacacctactccatatcgactagtggagccagtccaagtgatagaggtatcgtcctctgaagaagaccctgaggaggacccagagaagttacctcctgagcctgctgtggatgctcttgactttccagagggtgatgaggacccactccctgacgtggattctccagaggatgtcatgtcagcatctgaggtagactctacggaggagagtggccctggatggatagcgactagtggagactcatcatcatag

SEQ ID NO: 57887 - DNA, 342 bp, Glycine max
  Peptide Sequence Number=SeqID_149572
atggaaactggaaatttagttcctttggacttggagattgaagctacgttaagaaggaacggagccgagaggaaaagaaaattactacaagacaggacagtagcgtccattcttgaggaagaaactcatttttctaattttacatcatctgactcacaatcatcaagggaatctgcgacctatttactagaagtcgttcctttggcggatgaacaccagcaaagagttacccttgaggactattcaagtagtttagtgttccaattctttaccagcattgcacgtcctaaagtgcaagctcacaacataaactaccctcattctttgattcatttaatatag

SEQ ID NO: 57888 - DNA, 537 bp, Glycine max
  Peptide Sequence Number=SeqID_149573
atggtcccatgggcttcccgggacaacagggacgagccaggattgatgcttatttgcgaagtgattccgtcacctaggtgctccagtggcgtatcatggtctatcagctgtcccttcctgtcagctactgacggggatggtgtccgtcacaattccacacaagcataccagccggacatcagcgctggcaagtgtagcctggggtgccagacgctgacgctaaccacacccgccgcgcttaatgcttgccgctacagggcgcgtcccattcgccattcaggctgcgcaactgttcgggaagggccgatcgtgaattgttacgacttcctatgtggcagagaatggaaaagctcgcaccgcggtggcgtgccagcagaactagtggatcccccgggctacaggaatattcgatcggcattccaggtcgctcatgactcgtctacgctcggtcgtctcgactgcggcgagcggaaatggcttacgaacggggcggagatttcctggaagatgccaggaagatacttaacagggaagtga

SEQ ID NO: 57889 - DNA, 247 bp, Glycine max
  Peptide Sequence Number=SeqID_149574
atggctaagtttgacccagagatagtcctggagttttacgccattgcttggcccacagaggagggcgtgcgggacatgcggtcatgggtaaggggccaatggattccttttgatgcagacgccctcagccagttcctaggagacccgctagtgttagaggagggccaggagtgcgagtatagtcggagaaggaaccgagccgatggatttgacgaggaggccattgcccaattgttatgcatacggg

SEQ ID NO: 57890 - DNA, 654 bp, Glycine max
  Peptide Sequence Number=SeqID_149575
atgagaggccctctcgatgagtcaatctcttgctttctcataggggtggacccttgggtactagaacctattgcctttagaggactacacgtcctcgcctacagaggactgcacatcctcacctccagaggattacatgtcctcgccttcagaggactgcacgccctcgccatcagaggactacatatcctcgcctttagagggctacacgccttcaccttcagaggactacacgtcctcgccttcagagggctacacgccttcgccatcagaggcctgtacgccctcgccttcaagggactacacgtcctcgccttcagagggctacacgccctcgccttcagaaggttacacgccctcgccttcggaggactacacgtcttcaccttcagagggctgcacgccctcgcctttagagggctacatgcccttatcttcagagggctgcatgccctcgccttcaggggagtacacgtcctcgccttcagagggttgcacgccctcgccttcagaggctgcacgccctcgccttcagagggctacacgccctcgccttcagagggctacacgtcctcctcttcagaggactacacgtcctcaccttcagaggactggacgtcctcaccttcagaggactatacgtcctccccttga

SEQ ID NO: 57891 - DNA, 642 bp, Glycine max
  Peptide Sequence Number=SeqID_149576
atgaacaaagtcatcatcgcatctgctggagcaggtaaaagtacctttgtagtcagtgaagcattaaaggctgttacttcaggaaagcgtattctgattaccacgttcaccgaggcatgccgggatgaaataaatgtcaaaatcattaaagagaatggcaaatccggtgtaaagccttataaggtagcggggagacccatctactggggggagaaagatttcaggcagcactatttcagttctgattttatgctttactccgataaaatggccaaactttctcttcgctgtgatgagaagtcgaacggaaaagtcatcgctcggttgggatcgtgctttgatgaaatttatgtggatgaggttcaggatcttgctggttacgatcttgaaattcttcaaacactgttcaggtcacccattaaaatcacgctggtcggcgacccgcgtcaggccacttacagtaccgtcaataccgagaaaaatgcgaagtacaaaaaagctgccatcgtgaatttctttgatgacaaggcggcaggggtcacagttgatgataaaatgttgaatgagaactttcggtgctttcatgaaatcaatgattttgccaacaaactttatcctgcctttgccccttcagcctctaac

SEQ ID NO: 57892 - DNA, 1236 bp, Glycine max
  Peptide Sequence Number=SeqID_149577
atggcccgctatcaacccatcagtcaactcaccgggcgcgtgctgctgtttccgctcgcgctggtgctgtttgagttcgcgacttacatcgcccacgacatgattcagcccggcatgctgctggtcaccgccgagtttaacgtcggcccggaatgggtatccacctcactcactgcctatctgatgggcggcgtggtgctgcagtggctgctcggtccgctgtcggataaatatggccgacgtccggtgttgctgttcggcattctgttctttgccgttgcctgtgttctcaccacctgggtgagcaacatcgagcagttcgtcacgctgcgctttatccagggcatcagcctgtgcttcattggcgcagtaagctatgccgcagtgcaggaggcgtttgacgaggcgttagctgtgcgcatgatggcgctgatggctaacgtggcactgctggcaccgctggcgggtccgctggccggtgccgcctggctcacggtgggcgaatggcgcagcatgttctggctgtttgcggtttgcagcctgctggcgtttgtggtgctgtggcgcatcatgccggaaaccgccggcgatcgcagccactccattgcgttaccgaacctggcgcgcggctatggacggctggcacgcgataagcaggtgatgtacggctccttcgctatcggcctggtgttcatcccgattcttacctgggtggcgctgtcgccggtgattctgatgcatgaagagggcttatcccgcctgcagtatgcattactgcaattaccggtgtttctggcgatgattgccggtaacctgacgctgggtaaactggcgggacgcgtggccatcgagcaaccggtaaaatttgccgcctggccgattctgctcggcctgagcatcgcgctggtggcgaacctgctcaacagccacagttacctgctgctcaccgccggccttagcctgtatgcgtttggtgccgggatggtcaacgccgggctgtaccggttgacgctctattccagcagcgaaggcaaaggcagcatcgccgccatgctggggatgatcagcattctgacgctggcggcagggattgaagtggcaaaaagcggttatttcagcggcggtacgccgtggttcagcgcgatcaacttcgtcgccggcgtgttgtggtttggcctggtgacgctgttcctgcgcgagcgcaagcggcgcagtcgcctgacgagcgtagaataa

SEQ ID NO: 57893 - DNA, 1707 bp, Glycine max
  Peptide Sequence Number=SeqID_149578
atgaccgattacaccagaaatattgttaacaatgagtacgtaaatccgcctctgacgctaatccgcaatgcaactatactcagcatggctgagagtgctggtaaccatgaacgcggtgatattctcatcagcggatcaaccattaccgctgtggggcagaatctggatgcgcacggcgcgtacgtcattgatgccacgaatatgattgccatgccgggtatggtggattcccatcgtcacgcatgggaggggcagctgcgccgcatcaaccccaacgctacctgtctggacgactatagcaacgccactcacttctcttttgccaaatattatcgaccttctgacatctatgtgggtaacctcctgacggcactgggcgctatcgacgctggcatcacgacaatcattgataattcccacaacagccgcagcgctgcgcattctgacgccgccgttgaggcactccttgattcgggcattcgcgccatccatgcttccggcgcaccggtagctggcgaatgggataaagcgcactggccgggtaactggcagcgcctgcaggaaaaatattttaaagataacccggaaagtctcgtttccctgggcgttatggctcagctggagccagagctgtgggctgaagcacgcaggctcggactgcctattgtcactgaatttttcggtgctgagatggcctctgaacttgagtcactgcaccagaaaggcctgcttggcccggacaatatttttaatcactgcacggcactgcctgacgagggatgggaaattctgcgggaagccggtgtacgggtgaacgtctgcccgcgctctgactcgcattatggcatcgaaaacggaatgtttgctattgaggccgcacagcgtcacggcatcaatcccgggctgagcgtggataatgaaacgtcctacagcaccgacatgtttatggaaatgcgcgtggcgttttatctgcagcgtgtgatgggtatgcacaggcagcactgctgtgattcagaccgtacgctgactacgcttccggcagcacagcttcttaaatcggcaaccgtggatggggctttctgtgcaggactgcaggataagttgggcagcctgacgcctggtaaacaggctgatctggtactgattagcgcgacagatctcaacctttacccgaatggcaatgcgtttggtacggtggtgcatgcaaccgagcgcagtaatatcgatacagtcatgatcggtggacgtatcgtcaagcagaacggcaaagtgctgggtgtggacagcgagcgcctgcgcgcagccattgatgaatcacacaaccctgaacagccagcttgcaaaaggactcggaggcgactcggtcaccgccgcgttgttttccttttcggctggggcattcagcctcggaatttactcgctgctgcgcgggggattattcacctcacttgccgccattccttctcagcctgtgtggagtctggcaggcggactgataggtgcctgcgcgctgttcagctacgtggtgcttgcaccgaaaattggtttttcagccctgctcgggctggctattgtcgggcagttgctctcatctcagatgatcgaccattttggtctgctgggcgcgatcaggcggccggtttcaatactcaggctggcaggaatgctggtcatgctgaccgggctcgccgtcatgctttacggtga

SEQ ID NO: 57894 - DNA, 234 bp, Glycine max
  Peptide Sequence Number=SeqID_149579
atgtcaggtgggaatggaagagggaagattgcggccactcagaatcctactaaggacaaagcatctttcttgcatgaaaattttgttgaggaggagcctcagttgcttgttgtctttgttgtgactgctgctatattggaggaggaacatatggcttgcttggaccagcagcattctggagggagggacaggctgttgttgtgtggaggacttgcccatctcagatttggatga

SEQ ID NO: 57895 - DNA, 486 bp, Glycine max
  Peptide Sequence Number=SeqID_149580
atgtgggcttttctcaccggtcgtcagatcgactgggcccatttggttcggtaccgaatgcataaggcattacgggccaatgcacctctaccttatccacagttgataactttgtttctacgtcattttcaaattccgcttgatgatgagccattttttcaagtcaagcgttcctttgcaattggtgctggtgttgtgacttcctttggttaccgtaaggatcagaatggtcaatggctgaagaaagacgcactccctcctcaagatgagcgtactccttcacctcctcctcagcgtgaagattcagcactcctgaatgaagtccttaccgaattacgaggtcttcgttcttatgttggtgaacgtttcgactcattggatacacgctttgccggcatggatattcgcctcacacaagttgaagaagatgtctccttcatccgtacttgctttgatccaccaccaccgcctccatcatcctcttag

SEQ ID NO: 57896 - DNA, 432 bp, Glycine max
  Peptide Sequence Number=SeqID_149581
atgactgttgcagacagtattaagacatctctccctaataccgataatgctaaagagtttatggggttagtgggagagagctctcaaacagatgataagtctcttgctgggacattaatgagtatattgaccaccataaagtttgatggtttacgtactatgcatgaacatgtcattgagatgacaaacattgcatcaagacttaagaccttgggaatgactgtgaatgagaacttccttgttcagtttatgtttaactcattatcgtctaatatgttagttcaggaagagacagggcttaagaatcaaggaagtcactcagtctattatgtcagccaccaagggaatcaaggagctgaaaagaaatttatgaagaagcatgataaaggcaaaggatcattaaagatcaatgatgactctttgcaaatctag

SEQ ID NO: 57897 - DNA, 189 bp, Glycine max
  Peptide Sequence Number=SeqID_149582
atgccagctaactttgcggatctcgtcttcgcccgagaaaggattgaatccggactacgaaaaggcaagtcctccagccaccctaccccaagtggtatgacccgggtgccaagtgtgcgtaccatagtggagttcccggacacaacattgactcctgcctcccgttcaaatataaggtacgacacctaa

SEQ ID NO: 57898 - DNA, 243 bp, Glycine max
  Peptide Sequence Number=SeqID_149583
atgaatgaccaaactggacatccgaaagccacaggaagagtctttactcttaatggcattgaagcttcgaaatccaaagatctaatccaagagactaaggttgccatgtgtgaccttcctattgtcagagagtttcctgaagtgtttcctgaggatatatccggtttaccacctgagagagagatagagttttccattgacctgggtacccggtgctggacccatatccatagccacttatag

SEQ ID NO: 57899 - DNA, 657 bp, Glycine max
  Peptide Sequence Number=SeqID_149584
atgaagatctgcagaaagtgcgtgctgagcgcggccgtcgcggtagcgtatcgcgcggactgcagcggatcgatagcgtggaacatctggtgtctgttttcaccgcgtaatccgcgccacgtggcgacctttggtcacatgtttggtcgtctgtcgacggtgtttggcgtcaaagtcgaactgcgtaaacccgcggatgccgaaagctacggcaacgcgatttacatcgctaaccatcagaacaactacgacatgatcaccgccgccaatatcgtgcagccgaccacggtcacggtgggcaagaaaagcctgctgtggatcccgttcttcggccagctttactggctgaccggtaacctgctgatcgaccgcgataaccgcgccaaagcgcacggcaccatcggcgagctggtggcgcagttcaaaaagaagaaaatttccttctggatgttcccggaagggacgcgcagtcgcggacgcggtctgctgccgttcaagaccggtgcgttccatgcggcggtggcggcgggcgtgccgatcatcccggtggtggtctctaacacccacggcaaaatcaaactgaatcgctggaacaatggcttagtgatcgtggaaatgctgccgccagtggatactacgcagtttgaaaccacgtcg

SEQ ID NO: 57900 - DNA, 312 bp, Glycine max
  Peptide Sequence Number=SeqID_149585
atgctcagtgtgtcatcagctcgctcagtgagacgtttgtctcttcctacgctaagcgcacccagctcgctcagcggatattcactaactcgcgctaagcacaaaaatggcgctaagcgagccttcgaggacagaaagccctttttaaggctgaagttggaaaaatcaaagagcagaacagaggcgcaaaacagagcaaggaagccaaaaacctcagctttcaagaggatcttaggtttaggagtaatttctaggttcctagaggtggaagagacatccccaccactgtgtaatctgttattttcttcttaa

SEQ ID NO: 57901 - DNA, 459 bp, Glycine max
  Peptide Sequence Number=SeqID_149586
atggataatgaagagggcgtgcaagagcagatgaaggccgatttatcggccttaaaagatcaaatggcttctatcacggaggccatgctaaaactccagaaaactctagaggataatgccacgacgaccgcctccaatgcagttagggtagcggaaccggtgctacaacccataataaatttgggccgagataggaacccaacgatgttcggtcggaggtacagtccgcaagcttacccttatggcttgcctccagacttcactccccgtgccgctccggaagaggtgagccaagcccctaccttcgaggggcaacttcctccttatgccgattatcccctgcaagaagacgacgaaggagatgcccatctaggccctctgcttcccctcaaggatccagccccccatgaattaccccaaccaaacatagtccgacatgtcccgtcttcacccgcgccc

SEQ ID NO: 57902 - DNA, 736 bp, Glycine max
  Peptide Sequence Number=SeqID_149587
aaaagaagtagtgcaagaggttgaaaaaccagcgcgcgaaagcagagagtctggtcgtgatcgcaataagaatcgcaaccgccgtgatcgccagcgtgagcgtaaccaggagcgtggtgagcgcccagctaaagaggaaaacactcataacaaacagcgtcaggaacgccaggcacaagaaaaacctgcacagaaagacagacaagagcgtcaagccgcgcaagacacagctaaaacagatgtaaaccagccagcactgacgacgcaagctagcgagaacaaacaggaacgtggtgaacgcggtaaccgccgtaatcgtcacggacgccgtgatcgccgccagcgtgatgagtccagcccggcaacaacggcaaccgccaatgttactgctgatactgcaacagttgatgcagcgccagttgtcacggctgaaattgcacctgcagcccaagaagtagctaacgtgaagactgcggctaaaaccgttgacccagttgcacaagcgcctgtgacagagcctgtggcagagaaaaatgagagcaccaaggctgaaacaagtacagcaccaagcgaagagagctcaactgagaaaaaagcaccacgtagccgctcacgcaccagcaaatctagcaaaacgcgcgacaagcaagcagcagataaaactgaagcacctgcaatagaattggtggaaaccacctctgcacacagcttcagtggaagcaacgtcagagactga

SEQ ID NO: 57903 - DNA, 192 bp, Glycine max
  Peptide Sequence Number=SeqID_149588
atgttcaagatagaatcaagaacacttcaagattcaagaggaaagttgaagaacacttcaagattcaaaaggaaagttgatttcaagaatcaagaatcaagatcaagattcaagactcaaggttcaataatcaagagaaggcttaatcaagataagtatgaaaagattgatttggtaatcgattaccagtga

SEQ ID NO: 57904 - DNA, 459 bp, Glycine max
  Peptide Sequence Number=SeqID_149589
atggccacaatgatggaggccatgatgagcatgaagaagataatggaagccgatgtggttacagttgctgctaccagcactattgctaaggtgaacccgatgcccccatctggccttaaccaaatgaatcatccaacctcaggtatgacacatgaaattccccaccacaatctagccgacttcgagccttggcttggatatgccactgaagggcaagcagttggtggtatacccctgcaaaacactttggagggccctcaatatcacccccagctacacctcttgcattccacaacaagtaaaaaaccccatgctatggcagaaatgggaaagttggatcgtatagaggaatggctcaaggacattgaaggaggcgaagattatgcctttgctgacctagaagagttgttcctaatacccgaacatggtcattcccaagttcaaggtgccggactttga

SEQ ID NO: 57905 - DNA, 540 bp, Glycine max
  Peptide Sequence Number=SeqID_149590
atgactcaaaagctggtagcccgcggagacaccttacggttatccgcgcctcgtcatttagtgaccccaagtgtgattgatgagcagaggccaatatggtcatctgcgccctttccggagatgtcagcatcttccggtggagactttttcaagtctcacaagatacgtaggagcaagagccttgcttttgtcggccgccccacaagatctgtcatactgaccctgaggtcatgtgacatgcggagacaaaatttggtcattccgcacccctttgccattcagacacagtcgtgtccgatggtacgcagagacaaaatttggtcattctgcactcctttgtcatccagaggcggcgggcccgatgacacgcggagacaaaatttggtcattccgcacccctttgtcattcagacacagccgtgtccgatggcgacgcagagacaaaaattggtcattctgcactctttgtcatccagaagcggcgggcccgatgacatgcggagacaaaatttggtcattccgcacccctttgccatttag

SEQ ID NO: 57906 - DNA, 273 bp, Glycine max
  Peptide Sequence Number=SeqID_149591
atgttggccaatgatcgtgccattctgagtgtcgcaacctacccttcggcggaagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgtgcggggaagggtgtttccctttgctcctacgtattcctcaatttgggatgagaaaatcagacctacgtag

SEQ ID NO: 57907 - DNA, 598 bp, Glycine max
  Peptide Sequence Number=SeqID_149592
atgtccaaatctcgtggatttgggatgaccggccctctcgatgagtcgatctcttgctttctcataagggtggacccttgggtacttgtacctatcacctttagaggactacacgtcctcgccttgagaggactacatgtcctcgccatcagaggactacatgtcctcgccatcagaggacttcatgtcctcgccatcagagggctgcacgccctcacctccagaggactacctgtcctcgccttgagagggctacacgccctcaccttggggctgcacgccctcaccttcagaggactacacgtcctcgccatcagagggctgcacgccctcaccttcagaggactacaagtcctcgccttgagagggctacacgccctcaccttggggctacatgtcctcgccatcagagggctacatgtcctcgccatcaaaggagttcatgtcctcgccatcagagggctacacgccctcaccttggggctacatgtcctcgccttgagagggctacatgtcctcaccttcagagggctgcacgccgtcaccttcagaggactacacgtcctcgccttgagagggctacacgccctcaccttgg

SEQ ID NO: 57908 - DNA, 231 bp, Glycine max
  Peptide Sequence Number=SeqID_149593
atggagcttgcatcagtgtgtgtgtgtgtctttgtctctttatgtttgtatgtgtgtctgtctatgtgttgtgtgtgtctgtggctcagtgtgtttgtgtgtttgtctgtctctttatgtgtgtgtgacactggtagcaaaggatcattaaattgtaaacatcatcagccacatgatgagggaagcagtatcaaatcaatgctttacaagctttttggtggggagcaataa

SEQ ID NO: 57909 - DNA, 129 bp, Glycine max
  Peptide Sequence Number=SeqID_149594
atggataagagcttgaaggtagaagaagatgaggggagggagaaggagagaaggagcatgaaattttgtgcctcaaatgagcccactaatccaagatcaagtccaagattctccactaagtgtggttag

SEQ ID NO: 57910 - DNA, 219 bp, Glycine max
  Peptide Sequence Number=SeqID_149595
atggatggtcaacgcgcagagacgaattttgcgccctttatcattctggaacaagaagttgggtggaacaacaagttgggtggtcaacgcgtagagacgaattctgcgccctttatcattcaggagcaacaagtcgagtggaacaacaagttgggtggtaaacgggcagagacgaattttgtgccctttatcattcacgagcagcgagtcgagtggtaa

SEQ ID NO: 57911 - DNA, 380 bp, Glycine max
  Peptide Sequence Number=SeqID_149596
atgttcttttctatccagcctgaatccgagactttgattttgcaaactgcaactttgcctcccgttccaacaagtacaccacagccaccagagtttaaggttagggcccatcacaatccagttacaacttcaatagcttcaacagaggtgtctcataaggtatcttttagaaacaacgcaccttcatggaagcatcatattcttgaagcaaaaacacctttactccaaacgtcactaagagcccgcccacccaaagtgaaaacctcattagaattagagcaagaggagcttaagaagatccctaatgtcaaggcaagacctctaaataagaagatgaaaatcctccaagatcaaaacccgtggacaacaatatggggaag

SEQ ID NO: 57912 - DNA, 150 bp, Glycine max
  Peptide Sequence Number=SeqID_149597
atgaagggaagaaggcataaatatgggtttaacaacaataaacgtgagaaggcagagaaggtaaaggtggtggacgatgaaactggtgacaaacatcagctggatgaagtcctaaggagaaacatcttattagttgacatggtaacataa

SEQ ID NO: 57913 - DNA, 596 bp, Glycine max
  Peptide Sequence Number=SeqID_149598
atgaactggtcggcttcctggcggaattcctccagcaccacggccacgtcgttgcgggtcgacctgcttgaggctggccatggcggcgccgacctgctggacttcgcgggcggtgaggtacttgaagacctcggccgcggcgtcttcacccagcgacatcatcaggacggcgctgcgcgtcatgccgaccatcgcgacggcgcgcggatccttgttcgccatcgtgcgggcgcgttccaggttgtcctggtaacggtcggtttccttggcgcgggccagatcctgggcctcgcgctgggcttcgatgcgctcggcctcggccacttcaggatcgaccggcgggtacaggtagtcgcccaccgagcggcgcaccttgcggtacagccacagggccagcacgccacccaccagccaggccaggatggtcttgaacagcgagatcatttccggatcgcgccacatcggcaaggccggcgggccgtcgttgaactggctgttgaccaggttcagcgaatcgccacggctttcggaatagcccatcgcctcgcgcaccaggttggtgagcttgctcagttcctcgggtggcagggcctggg

SEQ ID NO: 57914 - DNA, 438 bp, Glycine max
  Peptide Sequence Number=SeqID_149599
atgggtgaagtagaggaggtgcaagagaaaatgaaggccgacacggagtccttgaaagagaaaatggccataatgatggaggccatgatgagcataaaggagataatggaggtcagtgcggcttaccgaacccagctaaagctgagtaaggtgaacccgatgcccccttctaatatcaaccaaatgaatcatccaacctcagatgtgatgggcaaagatttgggaagtatggacgaccccatgatgtgcaaattcaaaacgagcacaccttcccaccatatggcttgcctcccaactatacaccatccaatgtggcatacattcccaatgaggatgtcaataactccgctcccatactcattgaaagccgacaacctcatcatgcacatgtctcttaaaccgtgggggagacacatgagatgtcccaccacaatctag

SEQ ID NO: 57915 - DNA, 405 bp, Glycine max
  Peptide Sequence Number=SeqID_149600
atggctccaaagaaactctccacgaagaggtctagaagggacaccactggagaaggctccagtaccgcctcagagtttgatagtcattggtttcagagtgccgagcaccagcagcgcttcgaggccatcaagggatggtcattccacaaggagaggcgtgtccaactcagggaagacgagtaccctgacttccagggagagatagctcgcaggcattgggcacagctagtgacctccatggctaaattcgacccggagatagtcatagaattttatgccaatgcctggcccactgaggaggaggttcgagacatgcgctcatgggtgaggggtcactggatcccctttgatgcagatgccatcagccagttcttgggcgacccactgattttggaggaagactag

SEQ ID NO: 57916 - DNA, 479 bp, Glycine max
  Peptide Sequence Number=SeqID_149601
atgccgctggcgattcaggttcatcatgccgtttgtgatggcttccatgtcggcagaatgcttaatgaattacaacagtactgcgatgagtggcagggcggggctcaccaaaacttgtcctttcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57917 - DNA, 144 bp, Glycine max
  Peptide Sequence Number=SeqID_149602
atggagctagaacggctgatcaaaaggctctcagaaagtggcattgatgatgtaggatacgatgtatgcatgattcatgattttgagggggagttgtatgaatatgatcttgagggggagactgctgctgctgatgatgactga

SEQ ID NO: 57918 - DNA, 153 bp, Glycine max
  Peptide Sequence Number=SeqID_149603
atggatcttggagcttcaatgaggtcctctaatggtgattttccaccatggaatgcagcggaagacaaaggagaagaggtagcttccttgagaagctttcttaagaaaacttccttgagaaacttctttgagaaaacttccttgagaagctag

SEQ ID NO: 57919 - DNA, 817 bp, Glycine max
  Peptide Sequence Number=SeqID_149604
gacttcacgtcctctccttcagaggactacaacatcgcgcttcataggactatacgtcctagccatcagaggactacacctcctcgccttcatagggctacatgccctcaccatcagaggactacacatcctcaccttcagagggctacacgtcctcgcctttagagggctacacaccctcgaattcagaggactacacgtcctcgcctttaggttacacgccctcacctccagaggattacacgtcctcgccatcagaggactacatgtcctcccctttagagtattgcacgtcctcctctttagagggctacacgccctcgccttcagaggactacacgtcctccctttcagaggactacacgtcctcaccttcagaggactacacgtcctcgccttcagagggctacatgcccacaaaggattacacgtccttgccttcaaaggattacacctcctcgccatcagaggactacacatcctcacctttagagggcgacatgtcctagcctgcagagggctacatgccctcaacttcagaggactacacgtcctcaccttcagaggaggattacacgtcctcgccattagaggactacacgtcctctccttcagagggcttcatgccctcaccttcagaggacttcacgtcctcgccattataggactagacgtccttgccttcagaggactacatgtcctcgccttcagcgggctacacgtcctcatcagcagaggactacatgtcctcgccttcatagggctacatgccctaacctttagaggaattcatgacctcgccttcagaggactacat

SEQ ID NO: 57920 - DNA, 156 bp, Glycine max
  Peptide Sequence Number=SeqID_149605
atgggagaagcactcacaagtagaaattcaacaagaaacacttcccttgcaacaatatggaaggtgtttccggcatacatgagtttcatggcgtctctagctaagaggcgaaaatgcaaggaagatgtgttctttgtgaccttcatgccaccttga

SEQ ID NO: 57921 - DNA, 942 bp, Glycine max
  Peptide Sequence Number=SeqID_149606
atggatcaagttcagcatcaagccttcaacaaggtatatgggaagatctgggatctgacaatgatagaagtgtctgttgaagccatcgcatctctcactcaatactacgaccaatcactcagatgcttcacttttggggactttcagttagcaccaaccatagaggagtttgaagggatcttacgatgccgactaggagggaggaagccttacgttttttttggattctatccttctatggcaagaatagcaaaactggtcaagatctccaaacaagagctagaacgaatgaagcaaaataggaatggtgtggcaaggataccaaggaagcgcttggaggagaaggcggaagctctggccagccaaggagaatgggcatcattcatcaacgtatcagcttttgctagtgtttggaacggtactattcctgaatgtagacaggttggcagatctagcggtgatcaatgcctttcttgcttatcaccacaacaaggaaagcccggcatgacggaagcgtccactagttggttcccacggtggaaagaaggagggacaggagtgttatcctcatgtgagggattctcaattgtccccttgatggggacgaggggttgtattaattataatcccgtgctggccataagacagctaggctaccctatgagaggcgcaccgccagaggaaatcatcacgcctttcatcgcgcaaggtttcagtgaagctaatgcgaagatacttcagaaaatctgtaaagcatcgaatagagtgggaagaaaagataaggagcttaggggaagtagcaatggcgtcattggcggctatcacaagtggttgaagtctagaatgcaagggttaacttggctcccaaagctaaaaagtctaagtaggaaagatgctgaaattcttgaggaaagtgaaaaagtgcaagctttgaaagcatag

SEQ ID NO: 57922 - DNA, 522 bp, Glycine max
  Peptide Sequence Number=SeqID_149607
atggcagaaccatcaaaaaagagaaagggatcatcctccaccgccgctgctgctgcccatcgccaccacggaccatccgaagcacccacaacacctattcatccctctttgtcatctccaagatcatccacattgttttcatccgatgatcagcgtctacgatacctttctcaattttcttctagaatcatcttagaccctaagtacctagacatagatttctttaatgatgaaacacttgattgctatcaagtgtttcaaaattctggtctggttgatttcatgtcattaaaattgccacattatcctgaacttctaaaggtcttctacttcaatttaaaaattcaggaaggcattatttcctctgaggtgcatggtattcctatggtcattgatcagtcattgttcttttctttaactcatttacccagtcaaggtgcaccttttgagggcaccattgttgatgactggaaatttgattattcaagtcatgatactcgccgtatggtctgcaatgactag

SEQ ID NO: 57923 - DNA, 492 bp, Glycine max
  Peptide Sequence Number=SeqID_149608
atgtttagggatgcccgaaatgaaaataaaaggccatattggattggagatcgtgtttggaatgatttgttatcacattggaatgcacctgagtatcgttccaagtgtgcacatgccaaaaaaattaggcatctgaaaagggtgggtgtatgcaaacaggtggttctatcagcttgtaggatcatgccattcgcttgtgttggtgaatcccaactcactcccttagaccctgctggagaacaaagacttaggagtcggtgttgggttgcagctgcaagaccaaagcataagggatgcctttatggtactggagaccttgctcatacttacaaatgcggaaatgacagcttcatgcagcatatgcaaggatcttccaatcgcgctacagatgctacagagattaatcgcctgagggaggagttgcgtcaatcaaaagaggagatgcacatttttcagtcagtagtccttcagttcccacctccagaggtgtga

SEQ ID NO: 57924 - DNA, 68 bp, Glycine max
  Peptide Sequence Number=SeqID_149609
atggtcctttttggtaacctcgttcagcctcctatagtcgatgcatactctccaatttttggtaaccg

SEQ ID NO: 57925 - DNA, 486 bp, Glycine max
  Peptide Sequence Number=SeqID_149610
atggtgaaagttggaacctcttacgtgccgatcaacgtctcattttcgccaaaagtgtggcccagggcgcttgcccgcgtcaacagggacaccaggatttatttatttgcgaagtgctccagtggcgtatctggtttctatcagctgttccctcctgttcagctactgacgggtgtgttacgtcaatcggcaaaagcataccgaccggacatcagcgctggcaagtgtaaagcctggggtgcgaccgtgcctcgccattcggtgcgcaactgttcgggaagggacctgatcggtgcccttgctattaatgaatcggccaagcgcgaggggaggcggtttgcgtattgggcgctaagccggagtgtatactggcttactatgttggcactgatgagggtgtcagtgaatgtaatgactcactatgtggcagagaaaaaagctcgcacccggtggcggctcgctcagaatagtgatcccccgggctga

SEQ ID NO: 57926 - DNA, 267 bp, Glycine max
  Peptide Sequence Number=SeqID_149611
acggataaagccacttggcaacgctccagtttcagtttcaagggacagcttggagccggtgcagctgtagcatgcccgcctataccaatccggagcttcccaagatctgataacatcggcaggttggcactgccttcattaggtatcagtaccagtacaagtacggaccctatggcttgcccgatccggaacttcagctccccgtgccacccggaagtattgactaagcgcagagcccctactttcgaggggcaactcccaccttag

SEQ ID NO: 57927 - DNA, 449 bp, Glycine max
  Peptide Sequence Number=SeqID_149612
atggaggcccgaaacacatacatttcacatgagatgcggagagtgtacgattactcttcacgcggagagtgtacgattactcttcaagacgtctctgtattattagaattgttgggagtcagaccacaggaaggtgaacttcaaggtagtgtggtcaaattaagttggctggctcaccatttttcacaaataaatattcatgacggtaacatagaacaactacaaaggtttatccgtgcatggatcctcagattcataggaggtgttctatttgttgacaaaagcagaagtaaagtttccctaagagagatttgcagcgccaccgattacaaaattaaatcaatcggaagtgtgtgcatcttaatccaaatgtgggcatgggaacgctgcacgactttggctccaaagaggactcctcctgtaatagaaaataaaccactcggacacag

SEQ ID NO: 57928 - DNA, 492 bp, Glycine max
  Peptide Sequence Number=SeqID_149613
gtgagggcgtgcagccctacgaaggtgaggacatgcagtcctctgatggcgagggcgtgtagtcctatgatggcaaggacgtgcaatcctctgaaggtgagggcatgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctcttaaggcgaggacgtgtagtcctctgacggtgagggcgaggacatgtagtcctctggaggtaagggcgtgcagccctctgatggtgaggacgtgtagtcctctcaaggcgaggacgtgtagtcctctcaacggtgaggggcgtgcagccctctgctggcgaggacgtgtagtcctttcaaggggagggcgtgtagccctctga

SEQ ID NO: 57929 - DNA, 890 bp, Glycine max
  Peptide Sequence Number=SeqID_149614
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacttaaaaccctattactggaggatcttttctataggaaaaaatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57930 - DNA, 942 bp, Glycine max
  Peptide Sequence Number=SeqID_149615
acacaagacaccgtgtccgcttcaaagttatcgctcatgcgcgaaaaaggaagagtcgattgggaccaacatttggctgggataagaggcagcgcaatcaattggtttcctcgatggaaggaaggcaaggagggagttcttttctcgtgtggggactaccctaatgttccattgatagggactaggggttgtattaattataatcccgtactcgccataagacagctagggtaccccatgaggggagcgccaacggaagggagtctctcacctttccttgtgaaagatttaggcccgcaaggtcgtcagagacagactgaggctccgaaaggcgccttcatcggtggttatcaggagaacttcgaagcgtttccggaggttcaagatgaagaagcaagactcttgggccaaggaagaaacgttcaaattgttctctgggtttctacacacttccggaaagagtgcactgagttacaagaggaaaacgcggtcattcgcaaaagagcttggaatctgaagaaaccaaacagtaggcgccacaaggaggaacttgcgagagaacggcaaggagatatgggagcacaagagaagtggggcccgtttgcggatatactagctttgttgatttttggggttgtcctctttccgaacgtggacggtttggtggacttagccgcgattaatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttggtttcacatctattccaacaagacacagacacccgtgtccgcttcaaagttattgctcatgcgcgaaaaggagagtcgattgggaccacatttggctgggataggggcagcgcatcaatg

SEQ ID NO: 57931 - DNA, 750 bp, Glycine max
  Peptide Sequence Number=SeqID_149616
atgatgaagtcgttgattaaagtctccgtggccgcgctggcgctggccttctcgctttcctccactgcagcagacaaaaaactggtagtcgctaccgataccgccttcgttccgtttgaattcaaacagggcgacaagtatgtcggttttgatatcgacctgtgggacgccatcgctaaacagctgaagctggattacaccctgaagccaatggatttcagcggcatcattccggcgctgcaaaccaaaaacgtagatctggcgctggcgggtatcaccatcactgatgagcgtaaaaaagcgatcgacttctctgacggctactacaaaagcggcctgctggtgatggtcaaagccgataataacgacgtacaaagcgtgaaagatctcgacggcaaagtggttgcagtgaagagcggcaccggttctgttgattacgccaaagcgaatatcaaaaccaaagacctgcgtcagttcccgaacatcgataacgcctacatggaactcggcaccaaccgtgctgacgcggttctgcacgacacgcctaacatcctgtacttcatcaaaacggcgggcaacggcaagttcaaagcggtgggtgagtcactggaagcacagcagtacggtatcgccttcccgaaaggcagcgacgagctgcgcaccaaagttaacggcgcgctgaaaacgctgaaagagaacggtacttataacgaaatctacaaaaaatggttcggtaccgagcctaaataa

SEQ ID NO: 57932 - DNA, 878 bp, Glycine max
  Peptide Sequence Number=SeqID_149617
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgaattcggtgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57933 - DNA, 519 bp, Glycine max
  misc_feature (484)..(484): n is a, c, g, or t
  Peptide Sequence Number=SeqID_149618
atggcgactccgcgcatctttcctcctttggaaagcgcacccgtgagccttgccttcgctcgcccgcaaaaggacatgttgcgacacttgaggactggacgtaggcacgggaagtggccaaaccagtataaatcaacccgcaccaagaaaactggtcacatgacgtctgaggcagcaaaggaaattgctaacaagattgatgcgtttgaggagcaagcctcacagggttcctttgtcgcccatggacgtcatgatgtactaactactgccattgggcgaccagaacaccctggtcgtgtgcgtgttgcaggagccagtgtaaccatcaagcaatactttggattggcttcaaggacctcctacacgtcttcctccatggctcccaaagacctgcaccagttgaagcaacaaatcagggaccagctggaggattcgttcacagaaaaatttcagtcgcagatgcaatcacaaggactcgcactgnctcctaaacccgaggttggtcgttcagctactcgt

SEQ ID NO: 57934 - DNA, 165 bp, Glycine max
  Peptide Sequence Number=SeqID_149619
atggcgactaagatgaagcgatgcccatttgaagccttgggttcgatagccccaatcacgtctatgccccacattgagaatgactacaatgctgccaacatgttcaacggccatggcgtgtccattggcatgggtaccaaaggatccctcatgcacctccaatag

SEQ ID NO: 57935 - DNA, 543 bp, Glycine max
  Peptide Sequence Number=SeqID_149620
atgtaccctccactagaactgatccacaagagatgtaccctctcttgttctcagtcaacaacccaagtagatgtaccctctacttgtaccacaaaggatgtaccctccaatgtgttaagacaaagatctcaggcggttaaacctttgatactttgtgaatggggatacaaaataattctcagccgggagaagggagacacaaaagaattcatgcggttagtcctttgttcttttggaaaagggaaaagagtgatacaaaaagaattcaggcagttagtccttggcgaattctttttggcaaagggagaagagatgaaaagaatgaatagcacaagttttcaaggtttagaaaaccagaaaactttggaaagcttttggcacaaagaagaagaagaagttcaaagagattcaaggcttgtaaaggattttaatgaattgattggattgatagaaagattgattgaaaatgcaaaacaaagccttgcttttatagactcttcatgtctggtcaagaggaccattttgaagagttataacttttag

SEQ ID NO: 57936 - DNA, 213 bp, Glycine max
  Peptide Sequence Number=SeqID_149621
atggcttttgctttggctaatagacgggaggaggtcttgacttccattcaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 57937 - DNA, 324 bp, Glycine max
  Peptide Sequence Number=SeqID_149622
atgatgtttgaaattctggaaccgtgtagagttcttcgtttaggaacatcgtccaaaaaatatatgtttaaaataaaggaaaggaaattcccaatcaaagaggaagcaaaaaaggaaggaaaggaaattcccaatcaaagagtgggagaaagagaaaaaagaaaagaaaggaaattcccaatcaaagagtgggagaaagaaaaaagaaaagaaagaaaattcccaaccaaagaatgggagaaagtaaaaaagaaggaagctcctggtcaaagaaaccagaagcatttgaaatgcagagaggtctttggaccagacaatatctga

SEQ ID NO: 57938 - DNA, 210 bp, Glycine max
  Peptide Sequence Number=SeqID_149623
atgggtaaagcggaggaggtacaagagcagatggaggccgacatggaggccatgaaagagcaaatggccacaatgatggaggccaagatgatcatgaagaagataatggaagccaatgtggttacaattgccgctaccagcactgttgctaaggtgaacccgatgcccccatccggcatcaaccaaatgaatcatccaacctcagatatg

SEQ ID NO: 57939 - DNA, 327 bp, Glycine max
  Peptide Sequence Number=SeqID_149624
atggagaagagcacagtcgatacattgatagcaatttctccaaacacatggcatgcatcaaagtttattcatatttctctccaagataaatatgtgatttatggagacaacaaacgaaggcctcatttctccccaagaaaagtgaatatgcgatttatggagacaacaaacaaaggccacttgatcaacaaccgcaacaattataaatggaagttggaagttggaagtggaagttactcgaagttggaagttggaaatgaaagttattggaagttgaaagttgaaaatggaggttggaagttggaaggggaagttactaaaagttga

SEQ ID NO: 57940 - DNA, 444 bp, Glycine max
  Peptide Sequence Number=SeqID_149625
atgaccggaaggcttcttgccggttcattggcttttgaaagccgcatcctccattaccttattgttcgcatcctgcttcctagatcttcaaaccttgcccaggtttctgaagaatatctcattgtcatgtgggcctttcataaaggcgcttcagtcatagcatcctttggttatattaaggagcatgatggctcttgggtaaagaagggtactataaatgttggtgaagaaggacatgagggagaagattcatctcttcttttgaagattttggaaaggtttgatggtcttcaaacctttgttggtgagaggtttgatactttggaattgcaagtggatatgcgcttcaatgaaatggagtcaagaatgacaaaggttgaagaagatgtatcttacattcggtcaagcttcgatcttccaccaccgccgccaccatcatcttag

SEQ ID NO: 57941 - DNA, 120 bp, Glycine max
  Peptide Sequence Number=SeqID_149626
atgaagagatgcatgatgcgatcaaggaaaccagacatgggactatcagtgacaatgcatcaccaaaagaggaaaactctagatgaggcttcactgttagcaagcgagtcggggacctag

SEQ ID NO: 57942 - DNA, 357 bp, Glycine max
  Peptide Sequence Number=SeqID_149627
atgatcaaggaatccaaggaattggcatcaatgtcaatggatgctctctttggaaaattgcttgcatatgaacatgagctgattcaacaatctcatgcaaaagaaacagaaaagaaaagggattacactcaagagaatttgggcttgatggtgaagaagtttgggaaatttctcaaaaggtccaaagacagaaaattctctaaaccttcaaagaaggggaaagcaacaacaacacattcacatgctttgaatgcgggaagcaaggccacatcaaatctaattgtcccatctaccttaaaaaataacttgttgagaagaaaggaaagaaggatagaaaatagaaaaatgcctacatag

SEQ ID NO: 57943 - DNA, 1216 bp, Glycine max
  Peptide Sequence Number=SeqID_149628
atggctacctcaccaaaagaaacttcagctcctggttcaccctctgtgccatcatctccatcatccaccaaagcaccagcaaaccaggaacgacctgaattcaatatccagcccatacaaatgattcctggttcagcccctgttcctgaaaaactggttcccaaacgacaacagggtgtgaagatttctgaaaaccctagccttgcaacaagtcctagggaagtagacacggagatggacaagaagatccgcagtattgtgagtaacattctgaaaaatgcttctgtccctgatgctgatgaagatgttccaacatcttccatcccagatgttgctgttcctgatgctgagaaagatgttccaacatcttccacaccaaatactgaagccgtctcttcacccagcaaagaggaatcaacagagaaagaggaacaagccacagaggagacccctgcaccacgggcaccagaacctgctccaggtgacctcattgacctagaagaggtagaatctgatgaggaacccattgccaacaagttggcacctggcattgcggaaagactacaaagcagaaaaggaaaaacccccattaagaggtctggacgaatcaagactatggcccagaagaaaagcactccaatcactcctacctcatccagacgaagcaaagtcgcaattcctctcaagaagaggaaagaaatttcctcatctgattctgatgatgatgtcgaactagatgtctcgacatcaaagaggaccaagacatcagggaagaaggtgcctggtaatgtccctgatgcaccattggacaacatctcattccactccattggcaatgcagaaaggtggaaattcgtgtatcgacgcaggcttgctgtagaaagagaactgggaagagatgccttggattgcaaggagatcatggacctcatcaaggctgctggactgctgaagactgtcaccaagttgggagattgctatgaaagtctagtaagggaattcattgtcaacattccctctgacataacaaacaggaagagtgatgagtatcaaagagtgtttgtcagaggaaaatgtgttaaattctcccctgctgtgatcaacaaatacctgggcagaccaacagatggagtggtggatattactgtttctgagcatcaaattgccaaggaatcactgccaaacaaatccagcattggccaaagaaagggaagct

SEQ ID NO: 57944 - DNA, 303 bp, Glycine max
  Peptide Sequence Number=SeqID_149629
atgtccaccttatcacgtgccacaatccccaaatatgttcttaatttcttcttgtggggaccgttggccttccctgtagcaggatcaacatgcaccactggtctctcaacaccaggtggtctagtggacaacgatcgtaggcatgaggctttgcatgtctgcttcacggcagacgtcgaagccgatgcgtccgaagtaggaggaggaggaggaggaggagaaggaggagaaggaggaggaggaggaggaggaggaggaggagtagtggaggcaggacttcatccatgtttggacagcatttga

SEQ ID NO: 57945 - DNA, 906 bp, Glycine max
  Peptide Sequence Number=SeqID_149630
atggcccagaagaagagcactccaatcactcctacctcatccagacgaagcaaagtcgcgattccttccaagaagaggaaagaaatttcctcatctgaccctgatgaggatgtcgaactagatgtctcgacatcaaagagggccaagacatcagggaagaaggtgcctgaaaatgtccctgatgccccattggacaacatctcattccactccattggcaatgcagaaaggtggaaatttgtgtatcaacgcagacttgcggttgaaagagaactgggaagaaatgccttggattgcaaggagaccatggaactcatcaaggctgctggactactgaagacagtcaccaaattgggagactgttatgaaggcctagtcagggaatttattgtcaacattccctctgacataactaacagaaagagtgatgagtatcaaaaggtgtttgtcagaggaaagtgtgttagattctcccctgctgtgattaacaagattggagctgcaaactgggttcccaccaatcatacttccactgttgccaccagagagaatctccctctatccctgcattacaaactggttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 57946 - DNA, 114 bp, Glycine max
  Peptide Sequence Number=SeqID_149631
atgacccctactcatgatgctctgctgtattacaatgggaggtggaacatgccacgccaaaatgagtttgttgatttgatcaagcaagttgcgcctcatgggattcccccttag

SEQ ID NO: 57947 - DNA, 429 bp, Glycine max
  Peptide Sequence Number=SeqID_149632
atgagtcatcattcatctagtgttaatggcgagggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaacatcttatggctctcactcttatctaaagaaagaccaaggtcaaggcatcttaggggtgacaccttctaagcccaaagatgataaggctagtatgcaagagaaaactagctctataaagtgttttaaatgtcttggaagaggacacattacttctcaatgccccaccacaaaaaccatgattatgagggtgtcgcaacctacccttcggcgggagggcgacgcgtga

SEQ ID NO: 57948 - DNA, 948 bp, Glycine max
  Peptide Sequence Number=SeqID_149633
caaggtatacaggaagatctgggatttggtgatgatagaagtatccattggagatattgcatctctaacccaatactatgaccaatcactcagatgcttcacttttggggactttcagctagcaccaaccatagaggagttcgaagggatcttaggatgcccgataggaggaaggaagccataccttttttctggggtaaggggaatcccaagcaagtgcttggaggagaagacggaaactctggctagccaaggagagtgggcatcattcattgacgtattagcactgctagtgtttgggacaatactattttcgaatgtagatgggctggtggatctagcaacaatcgacgcttttcttgcttatcaccacaacaaggaaagcccggtcattgttgttttagcagatatgtatgatacgctcgacttaagatgcgagaagagcaatgcgaggattgtctgttgtacgcttgctatttatgtatggttggtatcccatgtctttaatcatgaaagtagatctgtctgccccctacaaggtcatcgcatgtgctcgggaaaggacaaagcaaattgggaagaactcttggcaggcatgacaagggcgtccattagttggttcccacagtggaaagaaggaggggaaaaaatacacttgagttactctatgagaggtgtgccatcggaggagaccatcgcgcctttcatcgcgcgaggtttcaatgaagctaatgccaagacacttcagaggatatgtaaggcatgtgtcgcaacctaccattcggtgggagggcgacgcgtgactcgcgggatgcgtgttccacgaaaggaatacgcgtggagtcgccaccaacgtttatttgaggaaaacgtcggaaaaaccggaaaagacgtgatctacgaacttttaagtgaaaggttcaggagttgtatttacgcacggggaag

SEQ ID NO: 57949 - DNA, 647 bp, Glycine max
  Peptide Sequence Number=SeqID_149634
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgttttctgccatgtggcacttttgctatgttgccttggtcttctttccagttgaccgcttcttcggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgttgcgccttatccggtaactatcgtcttgagtccaacccg

SEQ ID NO: 57950 - DNA, 201 bp, Glycine max
  Peptide Sequence Number=SeqID_149635
atggagaaatctgaaaagaaaaattttagtgaaaagaaaatgaagaaagcgtacatcacatgggatgacaatgatatggaatcttctgaagattcagaaaatgaagagataaacctctgtctaatgggtaaaagttatgaaagcgatgaagagatgcatttgctgattggcataaagagtcaatcaaacttgcaaagttag

SEQ ID NO: 57951 - DNA, 252 bp, Glycine max
  Peptide Sequence Number=SeqID_149636
atgcagaagaagaaggagaaaaggaaaagtgaagccaaggcactgcagaattatgactgtggatcatttcttatgccacttctcttggtatttactgtagaagcaaagcttcatgatgaatcaagattgattcaaagatgttttgatgataacaaagatgatgacaaaggtaatgacaaaaagctcaaaggtcaatcaaagaatgagttcaagatattcaagaggaaagttgaagaacacttcaagatttaa

SEQ ID NO: 57952 - DNA, 311 bp, Glycine max
  Peptide Sequence Number=SeqID_149637
attgccttatgcattctgaagctgaagcactagaacatacgaagaaaagagatacaggacatcaaagtgtgtcattggagaataagacaggagattcaactgtgttgaagataggagattcagctaaagttgtgataaaacaagacatgaagggaagaaagcataaatatgggtttaaaaacaataaacgagagaagacagagaagaaaagggtggtggatgatgaaactggcgacaaacatgagctgtatgaagtcctaaggataccatctaaaagaaaataccgatgcctcaatcagagaaaaaaatag

SEQ ID NO: 57953 - DNA, 252 bp, Glycine max
  Peptide Sequence Number=SeqID_149638
atgggtgactcagacaaatgcggactgaaaagagtttatgagggatccacagcggttcacaacatccctttgttgcatggccaagtgaaggttgatattgaggagattaaagatgtagatgctcttgttcctgtactcactgacgagttgtgtctcaaacaaagcttccagataggtcggatcctaaggcatctgactgagacaagtatgcaagtggggaatttcgatgtgtatggattccttgagccataa

SEQ ID NO: 57954 - DNA, 174 bp, Glycine max
  Peptide Sequence Number=SeqID_149639
atgtctcatcatcaaagaaagctatgtctagaaaatagagtagatgatcatggagatgacaaggaaggaggaactggtattgtgggtgcttcagatggtccgtggcatcgatggccaacagcggcagtggtggtggaagagccctttcgctttttcatcgattcatccatttga

SEQ ID NO: 57955 - DNA, 558 bp, Glycine max
  Peptide Sequence Number=SeqID_149640
atgatctttggcctagtctctcgcatggatatgaacataggagtgcttatctctggccagatgacttctatagcccaatctaacacttctagacttgggtttctagctctgatcaccgcattatgtagagctagaggggttgtctctgatatcctcacttttgagcgcctaagcccggtcattaacttggcctacattaggaagaactgttggaaccccaaggatctaacagtttctatccgaggggttaggagggcgagggctaggccaactgagttcccttccacttctgcagctcctactccagcatccacgtcagcaactccttttgtcccagcccagacaaattctcagcgctttgaagccatgcttcagagcattcatcagggacaaattattctattacaaattttacaggtggtggcacctccaagatctattccctcagtcgagcagttcagagagatggtagcctggcctgggactcagccttcttttcaaagggaagatgaaggtcccacagctcaggtaccatacctttacctcaacacgcaatag

SEQ ID NO: 57956 - DNA, 135 bp, Glycine max
  Peptide Sequence Number=SeqID_149641
caaagtgagggaggagcttgccacccagctcgcccaggcgagctaggttgcttcctccagaaggcaccgccttctagggaacttcctggaaggcccaagtgggcctggttgctatttgcaccccctggttactaa

SEQ ID NO: 57957 - DNA, 282 bp, Glycine max
  Peptide Sequence Number=SeqID_149642
atgacaataacagaaaacgtcaatagcaaactaacagaaaacagtaatgtcaatatcaaaagtgcggtgacctcggtcacgtggctccgcttcctcccaagaaaccaagtgtcgcaacatgcccttttgcgggcgagcgaggcgaggctcacgggtgcgctttccgaaggaggaaagatgcgcggagttgccaccaacatttatttgtggaaaacgtcgggaaaactgaaggaaaccggtcaaaatgaaaattctaagttcgggagttgtatttacgtttga

SEQ ID NO: 57958 - DNA, 291 bp, Glycine max
  Peptide Sequence Number=SeqID_149643
atgggtgaagtagaggagatgcaaaagcagatgaaggccgacatggaggccatgaaagagcaaatggccacaatgatggaggccatgatgagcatgaagaagataatggatgccaatgcggttgcagttgccgctaccagcgctgttgctaaggtgaactcgatgcccccatctggcctcaaccaaatgaatcatccaacctcagctatggttggcaaagatttgggaagtacgccttcccaacatatggcttgcctcccaactatacaccacccaatatggtgtacgtga

SEQ ID NO: 57959 - DNA, 546 bp, Glycine max
  Peptide Sequence Number=SeqID_149644
atgaccctttcatcatggcagaacaagctaaacagatattttatgttcaagacccttgtgatgaaaggtggtcagtggttctacacgggaaaacaattggtgttaatgccgatggctactccatccagctctcctcctcttcatcctcctccttctcttcctactgaagcagcatcacattcgccgtctaccttgaagtggacaagaaaagccacacggctaagatcattggcgactagaccagctggggcaggcagaccggtggtccacgtcgatcctacgaccgggatggccgtcggtccccacaagaagaaattaagaacatatttggggattgtcgctcgtgataaggctgaatttgatatccctgaagcatctgacgttaggacaaaaaagaaaatacttcagactatggtggagcggtggagacagtttaagtctactttgacgtcaaaatgggtacttgcaatcgacaaggacagtgtcgatgacactgtttgtgaaaaatatggcattagcaaggagaaatgggcccaatgttgttag

SEQ ID NO: 57960 - DNA, 252 bp, Glycine max
  Peptide Sequence Number=SeqID_149645
atgcaacagggacaaccatacatccccatagttgggttccctgaccccaactacggtttgaaagcggtaaaccaaaataaactcccctcacctatcatgagctctccgtcagctcctctctgcgttgctcagagacctctctcattcacgttcatcggtccaaacacagtgttctatataccaaatcgaagggtttttcaaaggaagtgtaaaaacattctgttacggtacccaagacacaagagatactaa

SEQ ID NO: 57961 - DNA, 441 bp, Glycine max
  Peptide Sequence Number=SeqID_149646
atggtgaaaagttggaacctcttacgtgccgatcaacgtctcattttcgtcaaaagttggcccagggcttcccggtatcaacagggacaccaggatttatttattgtgcgaagtgatcttccgtcacaggtgctccagtggcttctgtttctatcagctgtccgtcctgttcagctactgacggggtggtgcgtaacggcaaaagcaccaccggacatcagcgctggcaagtgtagcggtcacgctgcgcgtaaccaccacacccgccgcgcttattgcgcgggtgcagggggcgtcccattccccattcaggacgctcaaggggttggaagaaaaatggggaagggcgtgttcgctattagggcacccgccgaaagggggatgtggcgcaagtccaaaaagttggggggggccagggttttcccagtcacgacgttgtaa

SEQ ID NO: 57962 - DNA, 54 bp, Glycine max
  Peptide Sequence Number=SeqID_149647
atggccgaccagcaggcaaccaaatccaaagccaaaggtagaaagataccttag

SEQ ID NO: 57963 - DNA, 177 bp, Glycine max
  Peptide Sequence Number=SeqID_149648
atgcctacatcttcggtaaagggtgcagatgaccatgttggcctccgcttatcaatcacactcgaggctaccagctcttgggtcatggtaacagaaagcagtgtggtcgacaaaagcgaggcttttgctcctacgtatcctccaatgaggaactcagacctacgtagttctggataa

SEQ ID NO: 57964 - DNA, 363 bp, Glycine max
  Peptide Sequence Number=SeqID_149649
atgaaagttctacagcccaggcacctcaacaacatgagccagaaccagaaaatgatcactcatctgaagccaccatctttggagctgttgattgtaaaaaaaaaaagattagagacgagatccaatgaggctgctcatcatggaccactgccagcgttagctgatgcaccatttccaagagcggatccatcttcacctcagcatgcaacagactcttccattccgatcttagagatacatgagggccagaccatactagttcttcctttagacacttctcctccagttactccagtatggtatctaacagatgagaagaatgttcagatacaggacaatcaggaccagtcacaggaattttaa

SEQ ID NO: 57965 - DNA, 201 bp, Glycine max
  Peptide Sequence Number=SeqID_149650
atgcagatgagggcacacacggcctacctacgtcaaatcacaaagcaaacggagaagaatgcaatgtgcagtgaccttggtcatgtgactccgctccctcgcaagaaaccgagcaggtcagtcatatcctcatccatacgggattcatccgccttacccggggatcctgcagggtcctcccctgcctgggcatcgggctag

SEQ ID NO: 57966 - DNA, 216 bp, Glycine max
  Peptide Sequence Number=SeqID_149651
atgtctgttaaagttcatccaatagctttcttgtgcttcttgagcactagcaacaacttctccttttcttcagcagcaaaggaggcagagatgatcactggaaattttccttgtactcaaatgggaggaaatagggtaggagaagaagaggaaggtcctcagcctgtacctcataaagcaagtcagaagtatatgtacttcccgcaacatggttag

SEQ ID NO: 57967 - DNA, 713 bp, Glycine max
  Peptide Sequence Number=SeqID_149652
atggcgattggctgtcagaagcacgctaaaacggaaagctaccgggaatacctgcgctatgtcaccaccgccgatgagcagtttattgaagcgcccggcattcgcggcatggtgatgctggtatttacccttccgggcttcgaccgcgtattcaaggtgatcaaagataaattcgcgccgcagaaagagatgaccgcggcacacgttcgtgcctgctaccagctggtgaaggagcacgatcgcgtcgggcgcatggcggatactcaggagttcgaaaactttgtgctggataagcagcagatcgatccggcgctcatgacccttttactgcaggaagcctcgggtaaaatcaccgatcttggcgacaaaatcgtaataagccatctctatattgaacgtcgcatggtgccgctgaatatctggctggagcagtccgaaggccaggcgctgcgtgatgccattgaagagtatggcaatgcgattcgccagcttgccgcggccaatattttccccggcgatatgttgtttaagaacttcggcgtcacgcgtcacggacgcgtggtgttctacgattacgacgaaatttgctacatgacagaagtgaatttccgcgatatcccaccgccccgttatccggaagatgagctttccggcgagccgtggtacagcgtctcaccgggcgatgtctttcctgaagagtttcgccactggct

SEQ ID NO: 57968 - DNA, 444 bp, Glycine max
  Peptide Sequence Number=SeqID_149653
atgccgctcagccccgtgatattggtcaccttggctgacaacgagctgatgtcggtggcctcttctttcctttcacttggaggtgcatacctccacaggactgcgtggctgtttcagtatgggaaaggaacaggtttaactaccgaggggtatcggggctttggtgaagctgggtccttggtgaaatatatcaccaaaggcttggacctgcgcggcctatccgactctacggcattaactgctcccccctccatgattggcgagcgggtttgttttcatgttgggccgatcctcttgaaacgtcagccatctggcgtctatcaaatgttggaccttgtatttaagggccaggcatttttcggtggagtggcccggggttttcccatggtgcgcacaagttgtgtcagggtcataccactatggggagtttggagctacgcgtag

SEQ ID NO: 57969 - DNA, 765 bp, Glycine max
  Peptide Sequence Number=SeqID_149654
ctcgatggcgtaaagatccttgttgatcctgtattcagtggaaaagcctcccctatccctggaagtgttacggcttataaaggaagtgatatttatacggtagcagacctgcctgaaatcgactacctacttttatcgcatgatcattatgatcatctggattacgaaaccataaaagaactgcaaaaaaagacaaaacatgtagtctgtggtttagggaacggagctcattttgaacgctggggatatacacccgatcagattatagaaaaagactggtacgaatccgtaaacgtaaagccaggatttaccatatttacggaatctacacatcatgattccggaagaggattcagaagcggacaggcattatggctttctttcctgatccagacaccttctatgaaagtgtactacagcggagacggaggtcgtgatgatagattcaaatccataggctcaaaatacggaaaaattgattgggccattatggaatgcgggcaatataataaagcatggcaatcggtacatgagcttccggaagaagttgctttgggaacaaaagagctgggtgcccaaaatttattacccgtgcataattctaaatttaccctggccaaccacccctggaaagaacctttggaaaaaatcactgctctttcaaagaaccaatcttatcgattagcaacccctatgattggtgaattagttcatttagacaaaacagatcagaagtttaacgaatggtggaaaaatgttcaatga

SEQ ID NO: 57970 - DNA, 407 bp, Glycine max
  Peptide Sequence Number=SeqID_149655
atgggatcgagtcaggcaccttcgcttaaaaaaaggttttatcaagtcaaggtcaagagcctaggaatcaccagtctaaaagagttagggcagttgatgggtcagctccagcgacaagcctttcgcaaagcttacgctaaaatctgggacctagccatggcggaggtctccacagaggtcgttgcctccctcgcccagtattatgaccgaccattgagatcgtctttgtgtcaaactggcctgcgcttccgtgactgcaaccacattgtggagatcgtgtttatgaagatcatctttgccacttatccattgaggtcgaagaaaagtaggaaaggaaagagtcccgaaaagggtactcccagggcgttattgttgtttctccttctgcctgagttcgtgtttgtcgc

SEQ ID NO: 57971 - DNA, 105 bp, Glycine max
  Peptide Sequence Number=SeqID_149656
atgactcctatggttcctaagtggtggttctttcttgttggaggtttgaaaacaaaaagctatctaggcggtttgacaatggaaggtaaaggaaataagctatga

SEQ ID NO: 57972 - DNA, 912 bp, Glycine max
  Peptide Sequence Number=SeqID_149657
gcccaggtcggtcaggccctggatgttcgagtgcccgcgcagcgcgttcatgccgccgccggcgatgccgatgttgcccagcagcagctgcaccatggcgccggtgcggatgatctgcgaaccgatcgagtgctgcgtccagcccagcgcgtacaggatggtggcggcccggtcggtggtggcggtggacgccagcatctcgcagaccttcaggaacttgtcgcgcggcgtgccgcagacgcgttcgaccatctcttcggtatagcgcgagtagtgcttcttgagcagctggtagaccgaacgcggatgcgccagcgtcgggtcggtcttgacgtagccgtcatcgccgcgctcgtagtcccaactggccttgtcgtaggtccgcttgtcggcgttgtagccggagtacaggcccgcgtcgaacgcgaagtcctcgcgcacgatgtaggaaaagtcggtgtagttgcgcacgtactcgtgctggatcttgtcgtgatccaacaggtacttgatgacgccacccaggaagatgatgtcggtgccggtgcgtatgggcgcgtagaagtccgccacggatgccgagcgcgtgaagcgcggatccacgacgatcagcttcgccttgttatgggctttcgcttccgtgacccatttgaacccgcacgggtgggcctcggcggcattgccgcccatgatcagtactacgtccgcgttcttgatgtcgacccaatggttcgtcatcgctccacggccaaacgtcggggcaagacctgccaccgtcgggccatgtcagacacgggcttggttgtcgaacgccagcatccccatgctgcgcacggtcttgtgcgtgatgtagccgacctcgttgctgcttgccgaggcggccagcatgccggtggtcagccaccgggttga

SEQ ID NO: 57973 - DNA, 703 bp, Glycine max
  Peptide Sequence Number=SeqID_149658
atggagttcttctcaaatgagaattttgaatgcttccaagcatttgaaaactccaatcttattccattcatgtctctgaaattaccagtctattctgaattagtcaaagctttctattctaatttaaaaatccatgaaggcaccctaatttctgaagtttatgggataaagaaggtcattgaccaatccctattttataacttaacaaaattgcctagtgaaggtgtaccttttgagggtgcactgattgatgaatggaaattcgatttctctgtgcatgatgcccgccggttggtttgcaccaaccaagtggatatgaccggaaggcttcttgccggttcattggctttcgaaagctgcatcctctattaccttattgttcgcatcttactccctagatcttcaaaccttgctcaggtttctgaagaagatctcattgtcatgtgggcctttcataaaggtttacaaattgattgggcacaccttgttagatatcgcatgcataaggcattgcgattgaatgccccattgccttatcctcatcttgttaccctttttcttcaacacttcaacatccctcttgattctgaaccttatgttccaatcaagagatcattccttataggcgcttcagtcatagcatcctttggttatataaaggagcatgatggctcttgggtgaagaagggtgctagaaacgttg

SEQ ID NO: 57974 - DNA, 303 bp, Glycine max
  Peptide Sequence Number=SeqID_149659
atgggtgaagtagaggggataaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagtacgggcagcccccataatgtacaaattcaaaacaagcacgccttcccgccatatgggcttgcctctcaactatacgccacccaaagtggcgtacactcccaataa

SEQ ID NO: 57975 - DNA, 357 bp, Glycine max
  Peptide Sequence Number=SeqID_149660
ctgataccgctcgccgcagccgtacgaccgagcgcagcgagtcagtgagcgaggaagcggaagagcgcccaatacgcaaaccgcctctccccgcgcgttggccgattcataaatgcagctggcacgacaggtttcccgactggaaagcgggcacggataacaatttcacacaggaaacagctatgaccatgtttattgaattcgagctcggtaccacatggataccttcatttaaaacatcattcaacacttcattcataacttcacctatggtttcattcacactggggacactttcattcacaggttcaactgccacactaatgggttcaatcaacttctcaccgatagctaaag

SEQ ID NO: 57976 - DNA, 345 bp, Glycine max
  Peptide Sequence Number=SeqID_149661
atggacgaagatcaatggatatatgatagtataatgtctgaaaaaattggtatggatgatgaaaatgaacaagaatgtggtgtgaatgaacaacatgttgattgttcggatgcattcaatacttctcaggtgtttgctacccgagatgatattttgcagtgggctcgatcagttgctcatgaaaacagatttgtggaggtgattatgaggtatgacacaaacactggagtgattagtataggtctaggaagaaaaattttgttagaagagatactgggagtaggaaatgtgagtgtcccttcaagtttcgtgggaaaccagtggttggatgacaaggttggatag

SEQ ID NO: 57977 - DNA, 390 bp, Glycine max
  Peptide Sequence Number=SeqID_149662
atggagggatttggcggctcaggtggcaccccctatggtggaaagagaaatgattaccatgatggtagacactctgctggtgttctactacgagaagttgggaagttcgactatgtcgcccctgccagcacaagcaacaaaagattcagaatggccggggcaaaaagaaaagaaagggatgctcatgcccaaaggtcatctgccccatcacaaagagcccctgctcaagccttggttcctgcaaggcctcgtcccgccggtgatttcaatcatggcacaagttccaatccagggaggaaccctctagtgaagaagcttctggagtttgtgccaattccgatgtcatacggggacttgttgccatccctaatcgctaaccagttggcagtg

SEQ ID NO: 57978 - DNA, 806 bp, Glycine max
  Peptide Sequence Number=SeqID_149663
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggctattgttctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57979 - DNA, 779 bp, Glycine max
  Peptide Sequence Number=SeqID_149664
atggcacaacctccaccccgtgagaggactctaaggggaatggctgcacctgatttcacctacgaaagcttgtgcatccaataccctgatgaggatgtcccatatgttcttaaaactggactgattcatttgcttccaaagtttcatggccttgcagagggagtggcaaaggactggctgtattaccttactccaaggtccatcacgagctgggatgaccttaagagagtattcttagaaaaaattttccctgcttccaggaccacagccatcaggaaggatatctcaggactcagtaatatggagagaagtatgatagatgctgccagtggtggagcccttggagacatgactcctgctgaagccagaaatttaattgagaagatggcctccaactcccaacagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcaaaaatctgtacctgtcacaagggtttgtggtttgtgctcctctgctgaccaccatacagacctttgcccttccatgcagcaacctggagcaattgagcagcctgaagcttatgctgcaaatatttacaatagacctcctcaacctcaacagcaaaatcaaccacagcagagcaattatgacctttccagcaacagatacaaccctggatggaggaatcaccctaacctcagatg

SEQ ID NO: 57980 - DNA, 105 bp, Glycine max
  Peptide Sequence Number=SeqID_149665
atggctcgcacccatattccagtggaagcagagatacatctaacaacagctttcaaaattgccccatgtgtggcatctcttgtcaatgtcaggacttacatgtga

SEQ ID NO: 57981 - DNA, 102 bp, Glycine max
  Peptide Sequence Number=SeqID_149666
atgggtgtgggtgtgggtgtgggtgtggatgaggatgggggtgagggtgagggtacactggaggtgggagagatgggtacttgtaatttgaaaggtccttaa

SEQ ID NO: 57982 - DNA, 474 bp, Glycine max
  misc_feature (13)..(13): n is a, c, g, or t
  Peptide Sequence Number=SeqID_149667
atggcatggaagnctgtttgtggggataaaatcagattttggaaagataggtggttgggggaggaaagcactctgcaacagaaatactctcagctcttttcgattagtaagcagcagaatgattttatctccaccatgggtagcttctcacagaatatttggagatgggatttgaaatggaggagacatctcttcgagcatgaggagggtgtagctgtggcttttatggaagacatcactgcttatactcttcagaatcacttgaaagataagttgctgtggaaagctgatcctagtgggctatactctactagatacccccaaaggcggccatcttcacctggaggctcatcaaagataggctccctactagagctaatctgcatagaagaaatgtggagttgcaggatcttacctgccccctctgtcacagaagaaatcagaatagatggtgtggatggtggattgccttaa

SEQ ID NO: 57983 - DNA, 2260 bp, Glycine max
  Peptide Sequence Number=SeqID_149668
cagagcctggggtacgtggacaatggttacaacacggggctgaatgccaactggcgctatgacatgtggctggaaaatgcgccgataaagaatccgttcctcggcttgcgttgcatcaactggtatgccggttgcaatatggataccagcttgattctgccgcagaccaccgacgaaaagggattttacggcgccgtggtcacgcccggcggcgcaaaatggatgcacggcatgatgtcgccgagcttctatcagtatctgaagcagatggcggcgggtgacgctttcagcatgcagatcaacggttgccaaacgtcggtggcttacgacgccgcggccggcggccgctgccaggatcaggccagcggcagctggtacaagcgcaccgtcacgcacagcaaggcggcgcacctgcgctttatcaataccaacgccgtatcggaggtgttcgtcaacagcgatggggtgccgatcatcggcgagggcaatgccgattgcaagaaccagactatcggcgcccgctctggcatcatgtgcaagatggtcagctatgatttgcagaccgacggcagcgtcagcaatacctcgattcatgttttcccggcgattaaccatgcggcgctgtcatccgcggtgaacgccgccgacctgcagttcagtctgaacggcaacacctggaaaaacacgtcgggcaccggcagctactatacctttaacgagctgaagagcagcaacgccgtctatgtgttcttctccagtaatttcttcaaacagatggttgcgctggggatttccgacagcggcacccgcgatctgattaatttccgttttcagaacaccacctcgccggagtcgggatggtatgagttttccacctcaaaccagctgattatcaagccgcgcgatttcagcatcagcattatttccgatgattacgacaacagcccacatcgtgaaggttatgtcggcccggcggagccggcgctggagttcggctacctggtgactaccagcggcaaaaccgccgccgatcaggtgagggtgatggcgaccgggccgactcaggcgatcaacggggtgaactattgcctcttttcttccgcggataacagtacccaggtgccgtttcccgccaccctcggcatcaccaccagcaccaacggccagcagagcttcgccgccggctgcgatggccagtggcacgacatgaccaatgcgctctggagcagcaccccgtggaatgatatttccggtgaagtgggggtgctgaacaagacccgcgtgacctttagcattccgatgaataatccgatctcgctgagaaccgtcgacggcaacggttggtacggcgacgtcagcgccgccgggcagagcgtgaaacttatgctgatagggttgctgtgtttgtccttcccctttaccgccgctgcaatcaatgtcggcaccctgacgtttgccatggatcaggatcgctcattcaccgccaagcgggtgttgaataacaaccgcagcgcgcgcctgtatcaggtgagcattcgcgccatcgatcggccgggagagcgcgaggtgcgcagccggccggcggacggcgagctgctgttcgcaccgcgccagctgactctgcaggccgggcaggcggagtactacaagtttttctaccgcgggccgcaggataatcgcgagcgttattaccgggtgtcatttcgcgaagtgccgacccgattgttcgagccggggccgcgtcggggcgccggcgtcaacctgggagccgatcgtggtgatggacaccattctggtggtgcgtccgcgtcaggaaaactttgcctatcggcttcgatacccagcgcggtacgctcaccaacaccggcaacacctacttcaagttcctgctcaagccgggctgcaaacagcacggatgaagagggcgtccccgaatacctgcgccccggcgatacgctgacccatgccgatattcggctgaaggggcagaaattcattatctataacgacaagtttattagcctgaatatcgctatcgtgcagctgcagaatgcgtcgcacgatcatcaggcccagtccgccggaagggcgccgggcgccgctcaggacagacgggcgcacgaacagatcggcgcgcagcgtctgcggaataccggggccgctgtcgctgacctgcaccatcacccgatcgtcctgccgccacagccgcacgccgatgtcgccgctcgggcggcgtatggcgaatggcgttgtccagcag

SEQ ID NO: 57984 - DNA, 814 bp, Glycine max
  Peptide Sequence Number=SeqID_149669
cattaaactcccatacttccatgggaaggacaatgaagaggcttacttagattgggaaataagggtagagcaaaaacttaaaagaaagtctactttaaaatcttatggctatgattcttatccaaagaaataccaaggtctaggcatcttaggggcaacaccttctaagcccaatgatgataaggggaagacaatagaaaagcaaccccctaaggctagtatgcaagaaaagactagctccataaagtgctttaaatgtcttggaagaggacacattacttctcaatgctccaccaagaaaaccatgattatgaggagccaagacatttatagtagccaagatgaggctactacttcaccttcctctagtgaaagtgaagaagcaaaaggggaagaatctagtgaagaaatctacccccaagaagaaggaaaacctttaatggttaaggaggagtgtaaggagacacttgttcgcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaaagctttgggtggtgcaacactcatttgtaaaatcactcgtgcacccaacatcttcatgatttgtgtacatagggactcattagggagtcccatgaaccctaagagaataaaggtcattcctgaatggcctgctccaccatgtgtgttgaggaaaaaagcccagagtttcaagaacctcgggatttga

SEQ ID NO: 57985 - DNA, 318 bp, Glycine max
  Peptide Sequence Number=SeqID_149670
atgaggacgcgtagctctctaaaggcgacggcgtgcagccctctgaagttcaggacgtgccgccttttgaaggcgagggagtgtagtcctataatggcgaggacgtgcagtcctctaaaggcgaggacgtgtagtcctctaaaggcgaggacgtgtagtcctctaaaggcgaggacgtgtagtcctctgaaggtgagggcgtgtagccctacaaaggtgaaggcgaggacgtgtagtcctctgatggcaaggacatgtagccctctgaagaagataggtactagtacccaagggtccacctttatgagaaaacaagag

SEQ ID NO: 57986 - DNA, 105 bp, Glycine max
  Peptide Sequence Number=SeqID_149671
ataacccttgggtatctccgcatgtcaccccgattctcacaggtcggggtaacagatttgggtgtgtgtgcggataacccttgggtatctccgcatgccacctga

SEQ ID NO: 57987 - DNA, 275 bp, Glycine max
  Peptide Sequence Number=SeqID_149672
cacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacagacattcactggggaagcagaagtccttttgaaggaagctattcaagaacagatggaactctttttactacaggaacag

SEQ ID NO: 57988 - DNA, 291 bp, Glycine max
  Peptide Sequence Number=SeqID_149673
atgaagatgaatccgtggccacgtcatggactcctcatcatttcttgcactgaattgttgggagttggaagccattttctcaatcaaattcctagcctcaacagtggtcctagatgcagggaagaatttctccaagaacgccctcttaaggtcatcccaactggtaatggacctgggagcaagggggtctctcatcgtggaacagacaatatgaaactccttaagatgcttatgaggatcttcacctgcaagaccatgaacttgggcagcaaatgtatagtccagtcttga

SEQ ID NO: 57989 - DNA, 1188 bp, Glycine max
  Peptide Sequence Number=SeqID_149674
atggccaatcaaggagattgggtttcgtttatggatgtgttagctttgctaatttttggggtcgtcctctttccaaacgtagatggtttggtggacctagcagcaatcgacgctttccttgcataccaccatagcaaggaaagtccggtggtagctgtcttggcagatttatttgacacatttaatcgaaggtgcgaaaagagtagcgcatggatcatctgttgcttgcccgccctctgtgtttggttggtttcacacctgttccagcaagacacgaggcatccatgtccgctccagagccatcgctcgtgtactgaaaagagaagaatagattggggccagcttttggctgggataggaggtagaacaatcaattggttcccccgatggaaggaaggaaatgagggagtccttttctcatgtggagggtacccaaacattccgctgataggaacgaggggttgtattaactacaatcccgcgctcgctataagacaactagggtaccccatgaggggagcaccgatggaagaaagcatgtctcctttccttgtgagggatttcggcgcgcaaaatttcaaggctatacaaagaatccataaggcatgggaaaccccgttaaggaaagatcaagaacttaggggcattcgtaatgacatcattgggtaccatgaatggctgaaagttcatatacgaggtttagattggctcgccaagttaaaagtcgtcagcgaagagagttttgaagcaccggaagaggacaaagaagtccaagctctcaaaagcgagttaggaaaggcgaaacttgccaaaaagaagttcaagttggccgctacacacatccggaaggagtgtgccggattacgggaagagaatgcaactaccgcaagagcccttgaacaagagaccaagagggctcgcaaggaagagtatggccgtaacaaatttcgcggagctctgtggggtagcaacaatgaactcaagctgcgaaaggaagagagggaccaatcgcgagcacatagcatggttttgaaggaggagttagttgcctgttcaaggtccaaaagaagcttgtctcagcgtttatgcgagacggagaccaacatgctagctatcattgccaagtaccaagaagagttaggtctagccacggcccacgagcataggatcgcggacgagtatgcccaa

SEQ ID NO: 57990 - DNA, 114 bp, Glycine max
  Peptide Sequence Number=SeqID_149675
atgaaccgtgttgaggaaaaaagcccagagtttcaagaacctcgggatttgaggtcaaatccttttcaagggggagggaatgatgcaatcctaccccgcaagggcattggatag

SEQ ID NO: 57991 - DNA, 177 bp, Glycine max
  Peptide Sequence Number=SeqID_149676
atggggttgaatcaatttagatttttcaacatggttcatgacatcttggtcaaggtgaaactggaagtaacaaggacatcaacagtcctaaatgtgtttggcagtaaacaaagcagtgataggaaaatgcaaggatcacgcatgaaaacaaaaggtatgcagtttggagaacaaaaa

SEQ ID NO: 57992 - DNA, 267 bp, Glycine max
  Peptide Sequence Number=SeqID_149677
atgactgaagcacgtcaaaagggggtacggaaaaatgaattgaaaagctcggtttggggtacttactggttgaagactgaagaaaacgaagaacgaacgatgaatgtcgaagagcctcggaaacattacggaaacgttacggaagcgcctcggcttagattttcttcacggaaacaattttcttcagcaattttaagagaatacgaagtgccaagaaggctgaacccccttccttcttcattccgccccctatttatagcaaaatag

SEQ ID NO: 57993 - DNA, 207 bp, Glycine max
  Peptide Sequence Number=SeqID_149678
atggcccatgctactcaggagccaaaatttggaatcggcgtcacaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 57994 - DNA, 417 bp, Glycine max
  Peptide Sequence Number=SeqID_149679
gagtatgtcatggatgtctctagttgattgtccttcagagcagcagtttgatgagtgcctgaagaaggttgaatctgctcattgggctttaaaaagagtgttacataatagccttggagacttatgcaatatctgggatgccatgaacaacatgatgatgctacaacacatggaaattaaagcatcatttgaaacaagtacatatgtggttggacatgtgtttaaaaaaaccttatacaagaggcttcttggaatgatttcaagaaccgcgcatggtctttcttgtgcttatgagctatctaaatatggtgttggttgcatcctactggattcaatccatatgttctggaggagactcattttttcagaccaagggttatctgagcccgaaataagcatcaaggaagagatggaaac

SEQ ID NO: 57995 - DNA, 713 bp, Glycine max
  Peptide Sequence Number=SeqID_149680
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtgggaatgttcaattttggacttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57996 - DNA, 126 bp, Glycine max
  Peptide Sequence Number=SeqID_149681
atggaggagaagcttgcttgtgaaacttctatggaggctggatctttgagcttcactaaggtagtttccttgagaaacttccttgagaagctagagcttagctacagacacccctctaataactaa

SEQ ID NO: 57997 - DNA, 562 bp, Glycine max
  Peptide Sequence Number=SeqID_149682
tccccaaaattctgacaaattgtcttcacaaactgtgcagaatccaagaaatgtgagtgccatcaccttaaggtctggcaaccaaattcaagtgcctccaccagtagcaacacctgcacctgaacttgtcaagcttcattctacacctgaaaaagaggatgagatagtttcacaaaagagaaagcttcctaacaaaaattttcatgcaggtggaccttcttctagtaattctgacttacaacggcctcttatccctcttccattcccacctagagcgattccaaacaaaaaaatgaaagaagcggaaaaggagatcttggagaccttcaggaaagtagaggtgaacataccaagatatgccaagtttctaaaggagatgtgcacccacaaaaggaagctcaaaggaaatgaaaggattagtatggatagaaatgtgtcagcattgataggtaaatctgttcctcacattcctgagaaatgtaaggacccagatgtggtgatccatttggcaaatagaagtgtctcttaccccactggtttcatagaggatgtgctggttcgg

SEQ ID NO: 57998 - DNA, 2385 bp, Glycine max
  Peptide Sequence Number=SeqID_149683
ggaaacgggcattatgcaaagttaagtaacagaagcaagcctttgcaatcttccggtttacaccctgatgtctctgtgctggaattcctgcctgattgtagagtaaacacggaaaatttccttcttatgatgcaggcgccgcagttcgcgcaacaggtgctggagtggtaccaacgctttggccgtaaaactctgccgtggcagctggagaaaacgccctataaggtgtggctctccgaagtgatgctgcagcagacgcaggttgccaccgttattccctatttcgaacgctttatggcgcgcttccccacggttgccgacctggccgccgcgccgcttgatgaagtgctgcatctgtggaccggcctcggctattacgcacgggcgcgtaacctgcacaaggcggctaaacaggtggttgagctgcacggcggcgtattcccgccccattttgatgatgtcgcggcgctgccgggcgtcggccgctccacggcgggcgcgattctgtcgctgtcgctcggcctgcatttcccgatcctcgacggcaacgtaaaacgcgtgctggcgcgctgctatgcagtgagcggctggccgggtaaaaaagaggtggagaagcgactgtggcagatcagtgaagacgtcacgccagcggaaggcgtcagccagttcaatcaggcaatgatggatctcggcgcgttagtgcgtactcgcttccgctcgaaatgcgacatttgcccgctgaatagcggctgcgcggcctatgcacaaggcaactgggccgattatcccggcaagaagccgaaagtcacgctgccagagcgcagcggctggttcctgatgctgcagcacggcgacgaggtgtttctggaacagcgtccgccggtgggtttgtggggcggcctgttctgcttcccgcagttcaccagtgagcaagcgctgactgactggctggcggcgcgcggcatccacgcgaagccgcagcagcttaccgcgttccgccacaccttcagccatttccacttagatattgtgcctatgtggctggcgtggccttcctccgggtcgctgatggatgaagccggcgctgcgccatccccggcagcttcaactgcgaaccagtttgaccgaagaggaagagtaatgagccgcaccattttttgtacttatctgcaacgcgacgctgaaggccaggactttcagctctatcctggcgaactgggtaagcgcatctacaatgagatttccaaagaagcctggcagcagtggatgtctaagcagaccatgttgatcaacgagaagaagctcaacatgatgaacccggaagatcgcaaagtgctggagaaggagatggtgaatttcctgttcgaaggcaaagatgtgcacattgaagagtgggttaaggacaccaacggttttgacattctgatggggcaatttgccgccaacatcgagaatatctggggaatcaatgaggttctgatcgccggacccaaggactacgtcaaatacagcgataactattacacccgcagtcacatcaacttcgacagcggtagcatcaccattgagaccatttccggcaccgatccgatggccagcctgcgtcaggccatcatcaccacgctgttgattggtgacgatccgggcaacgtcgatctctactccgacgccaacgatattcagatcagtaaagagccgctgctgtacggccaggtgctggataacaccggtcagccgatccgctggcagggacgcgccggtaactttgccgattacctgatccagaacaaactgcagaaacgcacctccgggctgcatgttatctggtcggtgaccattccgatggtgcctaaccacctcgacaaacgtgcgcacaaatatctgccgctggtgcgcaaagccgccgaacagtatggcgttgatgcctcgctgattctggcgatcatgcagaccgaatcgagctttaacccctatgcggtaagcaacgccgatgcgctgggtctgatgcaggtggtgcagcatactgccggggtcgatgtgttccgcatgaaaggcaaatggggtaaaccgagccgcagctatctgctcgatccggccaataacattgatgccggtaccgcatatctgtcgctgctgcagaagagctatctcggcgggattcaggatccgctgtcgcgccgttacgcagtgatcaccgcttataacggcggggcgggcagcgtgctgcgcgtgttctccagcgataaagaccgcgccttcgccaccatcaacggcatgtcaccgagccaggtgtatcagacgctgaccaccaaccatccgtcggccgagtcgcgccgctatctgtacaaagtgagccaggcacagcgcagctaccaccgttattga

SEQ ID NO: 57999 - DNA, 1074 bp, Glycine max
  Peptide Sequence Number=SeqID_149684
acttcgcagattcacaagaaagataaccatattcgcggccagaaacgcttctgcccacacaagcggctgaacaacgcgtttatgctgcacgcctcaaccagcccgttctatccgctgttcgctgcgctggatatcaacgccagaatgcatcagggcgaagcggggcgcagcatgtggcacgactgcgtcacgctgggcattgaggcacgcaaagcgatccttgagcgctgcagcctgattcagcccttcctgccggagcaggtacacggcaagccatggcaggcggcagaaaccgccaccatcgccgctgatccggcgtatttcagctttgaaccgggcgcgaagtggcacggttttgccggttacgatgccggacagtatctggtcgatccgtgcaagctgctgctcaccacgccaggcatcgatgccaccagcggcgaatacacccgctttggcattccggccaccattctcgccaactatctgcgcgagaacggtatcgtgccggagaagtgcgatctcaactcaatcctgttcctgctgaccccagcggaaacgccggaaaaaatggcgcatctggtggcgatgctggagcagtttgaacagcacgtgcgggaagatgcgttgctggccgaagtgctgccgagcgtgtatcgcaggcacgttgagcgctatcagggctacacgctgcgtcgcctctgccaggagatgcacgatttgtacgtcagctacgacgtcaaggatctgcagcgcgacatgttccgccaggcgtgtttcccgaaagtcgaggtcaatccgcaggatgcgcatcaggcgtatattcgcggtgacgttgagctggtgccgatcgccagcgccgaagggcgcattgccgccgagggggcgctgccgtatccgccgggtgtgctgtgcgtggtgccaggcgaaacctggggcggggcagtgcagcgctatttcctcgcgctggaagcgggtatcaatctgctgccgggcttttcaccggagttgcagggggtttacaccgaggaggatgacagcgggcacaagcggttagtggcgaacatgatgttgtag

SEQ ID NO: 58000 - DNA, 681 bp, Glycine max
  Peptide Sequence Number=SeqID_149685
atggcattgaccaggccggcagcgcgaattgcgccgtcagcgccggtctgcgcaccagccgcctgggtgcgtaagccgccgtgcgccatgataaacagcactttcaccggcagcggccgctgcggtagctgcgcacgctgtttgttgactttgtcgatcaacgcgcgggccgcctgttcacgctgcagcgcgttgccaatggtggcgattttgtccgtgatggcatcgaggcggttatccccactgacctccaccaccgttaccccggcgtccgccacctgctgcaacaccagcgatggtttagccagcgcgctggccaccgacatccggcagcctggtggccgccgccggatgctggctggtgctgtcgcgcgccaccagctgcgcctgcgcatccagcgcgtagacgatctgcgttacatcgcccccgatagtaatgatgcgctgcgtcgcccacgccggcagcgtcagcagagcaagcagtgtcaggatcagcgctttcatgcggcggctcctgtcggcgtcagcgccatcacctgctcgcgccagcgtgcctgttccggcgtgccctcgctgcgctggccgtacagctgggcaatctgcgtgccatcggcagcaaacagctccagactggtgacgaagccatcgccgcccggcttgcgcgtcacccagctctcgtga

SEQ ID NO: 58001 - DNA, 1809 bp, Glycine max
  Peptide Sequence Number=SeqID_149686
atggcgacctcaagccggagagaaacgttgccaaacccgactcaccaccgcgctccacaacgcgtgcgcaatgaattacgcttccgtcacatcaccgtcgccagcaaaacgcgggtggccgatgccttctggcgcatcgtctttagcggcagcgatctggcgggtttccactcgccctcttttgacgaccacatcaaagtgtttttcccggatacgccgggcggtgcgctggcgctgccacacatgaccgacgaaggcatcgtctggcctgacggcgtgcgtccggcggcgcgcgactatacgccgctggcctttaacggcagcgattcgctgacgctggatttttacatccacgacggcggcgtcgccagcagctgggcgagtgccgctcagccgggcgatcgcattgcgatgggcggcccgcgcggctcatgcgtcgtgccggtggattatgcctgtcagatttatgtctgtgatgagaccggtctgccggcgtttaagcgccgctatcaggaaatgcaggcacagcagattcatctgctggcctgtgttgatgagccagtcggccgcgcgtatcttggcgacctgccggacgtcacggtgagctggctcggcagcggcaagatgcagactgaggcgctgacgccgctgctggacccgattatgctgcctgctgatgactacttcatctggctgaccggcgaaggcgcggcggtgaaacagctgagcgattattttactcagcaacgtgcggcgcacagcgacctggcaccagactactatcaacctccctcaactgaccccgggaaggcgatgaaaccgcagcgggatgttcctgagcacgccgatgcggcacagcgtgccagctgtgccggcgcacgcagaaagcggcgcgaaaggatgctggatgccagtgatattcgcctgctgatgctgcactttctggccagcggcgcggcgcacggttatgagctgatcaaatcggtggaagagttgtcgaaaggcgaatattcccccagccccggcattatttatcccaacctgacgctgctggaagagatggacgccattcgcgtggtggatgcccaggccacgcgcaaagcctacgcgctcaacgatgcgggccgcgcgctgctggcggaaaatggcgaaaacgtggcgcattccacaggtggagcaggcgatccatacgcttcgctatacgctcaatcatcggttatcgcaggagcagatttcaccggccacggtggagattgtcgtggcggcgctgcaggacgcggcagagaagatcgccaacagctaagcgcgttacggtttcttcttgtccacgtgccccacttcgcgattcggccagcagacatcgcgcacccgctgcttcagtgctgccgcatcgggaaagccgccttcctgtttgcgttcccaaattacctgaccatcaatgctgatctcgaacacgccgccgctgccgggctggagcgtgactgcgctgagatcgccggcgaaggtatgcagcagctcctgcgccatccacgccgaacgcagcagccagttacattgggtacagtagtgaatggttactgccggtttatctgccatactatccctcctgcatccctgcggcaccgcggccagttatatacggcagctgtgcactcaagcgcgcatgacactgtgccacagggaactgttcagcagcgtctgtgtaaagtcgctgttcttgcttcagccattcacgcagcctgcagctatgccgccagcgacagcagtacgctggcgcgttccgcagagaacaacagcagcaatgaaccg

SEQ ID NO: 58002 - DNA, 870 bp, Glycine max
  Peptide Sequence Number=SeqID_149687
atggtgcaggcgaaagtggcggagttcttcggtaaagagccacgtaaagacgtgaacccggacgaagcggtcgctgtgggtgctgcggtacagggcggcgtgctggccggtgaagtaaaagacgttctgctgctggacgtgaccccgctgtcgctgggtatcgaaaccatgggtggcgtgatgacgtcgctgatcagcaagaacaccacgatcccaaccaagcacagccaggtgttctcgactgctgaagacaaccagtctgccgtgaccattcacgtgctgcagggcgagcgtaagcgttcagcggataacaaatcgctgggccagtttaacctcgacggtattcagccagcgccgcgcggtatgccacagatcgaagtgaccttcgacatcgatgctgacggtattctgcacgtgtctgcgaaggacaaaaacagcggtaaagagcagaagatcaccatcaaagcttcttctggcctgaacgaggaagagatcgaaaaaatggttcgtgacgcggaagctaacgccgagtcagaccgtaaattcgaagagctggtgcagacgcgtaaccagggcgaccagattgcgcacagcacgcgtaagcagctggacgaagccggtgacaaactgtcagcggaagacaaagcaccgatcgagtctgccctgaacgagctgaacaccgcgctgaaaggcgaagataaagcagaaatcgaagccaaaatgcaggcgctgatggaagtgtccagcaagctgatggaactggcgcagcaacaggctcaggccggcgcagcggatgccggcgacgcttcggcgaagaaagatgacgacgttgtcgacgctgaattcgaagaagtgaaagataaaaaataa

SEQ ID NO: 58003 - DNA, 350 bp, Glycine max
  Peptide Sequence Number=SeqID_149688
atggccccaaagaaactcccttctaaaagagctaggaagactgttacaggagaaggatctagtacaactccacctgtagaaatcgacatccttctgagtgaccacaactctgatctcacactgcccaaaagccagctggtctacagcattatgacgcagatcagtgtccacgtggcacaactcatcttagatttcatccatcaatttgtaggcattgcacctcctaggaacccagtggacccagaaaattccaacaaagcactgggatttcctatattgattacaggtctctgccaattctacagagtaacggtcacgccgatgaagctcatccggcctcccattaatag

SEQ ID NO: 58004 - DNA, 251 bp, Glycine max
  Peptide Sequence Number=SeqID_149689
gcccacttgggccctctggaatattcctccagaaggcggttgcttctggaggaagcaaccctgctcgcctgggcgagctgggcggcaaccacctcccctattttgctataaataggggaggaagtgaagaagaaaaggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 58005 - DNA, 483 bp, Glycine max
  Peptide Sequence Number=SeqID_149690
atgcaagagaaggccctaggaagcccaatccaattaaattttagagggggaggtgagcatttgcttgctacaccccattgtcacatcatatccggtgaggaggctcgagctgagaccgtacgtgctcatggggcatacgtgcgactgtcatggctccgtgaggtgtatgagagtagatgccaggcccgacgttggattgtagcgacgcgtgcttacctcctccacctggtgggttgtactctttttgctaataagagtgcaacccatgttcatgtggtgcatccggaggcgtttcgagacctaggtcagactgggggctatgcctggggagttgccgcgctagttcacatttctggatatatgagcactttcgcagtgttcatcagtgcatcactgataatgcgtatgctgagactaccctttgtgcctcgaggtacttacgatgaaggcgcacatgaaggggatccagggagcgccgtatag

SEQ ID NO: 58006 - DNA, 558 bp, Glycine max
  Peptide Sequence Number=SeqID_149691
atgactacacgtcctcaccatcagagggctgcacgcccttacctccagaggactacatgtcctcgccttgagagggctacacgccctcaccttggaggactagacgtcctcgccttgagaggactacacgtcctcaccatcagagggctgcacgccttaccttcaacttcagaggactacatgtcctcgcctgagagggtcatcgtcctcacctttagggtacatgttaccctcaccgtcagagggctacacgccctcacctttgagaggactacacgtcctcaccatcagaggactacatgttccccattttcaaaggggggcatgccctcaccttcagaggattacatgtcctcgccatcagagtgctacgccctcaccaacagagggctagttaccctcaccttgagaggactacacgtcctcgccttgagaggactacacgtcctcaccatcagagggctgcgcgccctcacctccagaggactacatgtcctcgccttaagagagggctacacgtcctcgccgtcaaagggtcatgtgccttcacctttgtag

SEQ ID NO: 58007 - DNA, 864 bp, Glycine max
  Peptide Sequence Number=SeqID_149692
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtcaaaaatataaagaaataacctttcctattctttccccggatcccactactaagagagatgttcatttcttaaaatatcctatatacgtaggtgggaacaggggaaggggtcagatttatcttgacgggagcaagagtaataataatgtgtataatgctacagcagcgggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 58008 - DNA, 598 bp, Glycine max
  Peptide Sequence Number=SeqID_149693
agctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggcgtagaggaaccacaccaatccatcccgaacttggtggttaaactctactgcggtgacgatactgtaggggaggctggggagaggaaatgttcccattttttaggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 58009 - DNA, 276 bp, Glycine max
  Peptide Sequence Number=SeqID_149694
atgagcgttcacgtggctcagctgattgctcacgccatctatttgtttacaggtatgccacccatcaggcaccctctagacccggataagtctaacacggccctggggtttccagcattgatcacgggcctctgccagtcattcggggttccagtcacccctagtaaggtgatccgaccgccgatcacctgggctttcattgagaagtattgcacgcctagacaggcgcaaggggatgcacctcaggacgcagacgcaccaccgccacctcattag

SEQ ID NO: 58010 - DNA, 1057 bp, Glycine max
  Peptide Sequence Number=SeqID_149695
gatccccccaaatgtggatgggttggtggacctagcagcgatcgacgcttttcttgcctatcataaccacaaggaaagcccggttgtcgctatgctagccgacttatatgacaccttcgaccgaagatgtgaaaagagcaatacaaggattgtttgctgtactccagctctttatgtatggttagtttcgcacctttttcgtcaagaggtgaggcatgcttgcccactagaaagccaccgttcatgcacagagaaagaaggggcaaattgggaccgactcttagcaagcaaagaaggagcatctgtcaactggttccctcaatggaaggaaggaagaaccggagttcttatttcatgcggaggatttccaaatgttcccttgatggggacgaggggttgcatcagctacaatcccgttcttgctataagacaacttggctaccctatgagaggggcgccactagaggatgagctcatgcttgtcatttcacgaggtttcaataagaccaacgtggagacacttcagaaggtccgcaaggcatgggaggtgttgcaaaagaaggacaaggaactcaggggcaaaccactaaaaggagaggaagttgaggcaccggaggaaaacgaagaagtgcagcccttagggtggaactcgagcaagcccaaacagtcaaagaaaggggctctatggggctgcaacagcgagcttaagctccggagagaggaaagagaccaatcacgagtacatggcatggtcttaaaggaggagttagctgcttgcccaagatccaagaagagtttggcccaacacttagaagccacagagcaaagcatgctagctataatagggcagtacaaagaagagttcaaccagtctttgacccatgagcaaaagctagtagaggactttgcacaagcatacgccgagaaggaagcaagagggagggtgattgatgcattgcatcaagaaacgaccatgtggatggataggttcgccttgaccttaaatggaagtcaagacctcccacgactactagccaaagcaagggccattgccgaa

SEQ ID NO: 58011 - DNA, 814 bp, Glycine max
  Peptide Sequence Number=SeqID_149696
atggccccgaggaagcttgcctcaaagaggtccaggaaggataaggcggccgaagggactagttccgctcctgagtatgacggtcaccgctttaggtgcgctgtacaccagcagcgcttcgaggccatcaagggatggtcgtttctcctggaacgacgtgtccagctcagagatgacgagtatacggatttgcaggaggagatagggcaccggcggtggacatcactggttactcccatggccaagttcgatccagaaatatggatcccgttcgatgcagatgctattggccagctcctgggatatccgttagtgttagaagagggccaggagtgcgagtatggccagaggaggaaccggtctgatgggttcgatgaggaggccatcgcccagctgctatgtataccggggcaagattttgcccagactgttgcagggaggcgagtgcgaatcatgcgcaccaacatgaccaccctgacccagatatggatgacgttgctcctcagcaacatcctgcccagcgaccataattccgacctccccctaccaaagtgtcagctggtgtacgccatcctgacgcggatgagcgtccatgtggctcagttgatcgctgatgccatctatatttttgcaggtatggtgcctaccaggcaccctttggacccagataagtccaacagggccctgggatttccctcgctgatcacaggactctgccagtcattcggagtccccgttgcacctaccaaggtgattcggccgcccatcaaccgggcttttattgagaaatactgtacccagagacaggctcagg

SEQ ID NO: 58012 - DNA, 372 bp, Glycine max
  Peptide Sequence Number=SeqID_149697
atgtccaaatcttgtggatttgggatgaccggccctctcgatgagtcgatctcttgctttctcataagggtggacccttgggtacttgtacctatcaccttgagaggactacatgtcctcgccatcagaggacctcatgtcctcgccttgagagggctgcacgccctcacctccagaggactacatgtcctcgccttgagagggctacacgccctcaccttgggtacttgtacctatcaccttgagaggactacatgtcctcgccatcagaggactgcatgtcctcaacttcagagggcttcacgccctcgccatcagaggactacacgtcctcgccttgagagggctacacgccctcatcttgggtactag

SEQ ID NO: 58013 - DNA, 1004 bp, Glycine max
  Peptide Sequence Number=SeqID_149698
atggcacaacctccacctcgtgagagaactctaagggaaatggctgcacctgatttcacctatgaaagcttgtgcatccaataccctgatgaggatgtcccatatgttcttaaaactggactgattcatttgcttccaaagtttcatggccttgcagagggagtggcaaaggactggctgtattaccttgctccaaggaccacagccatcaggaaggatatctcaggtattagacaactcagtggagagagccttaatatggagagaagtatgatagatgctgccagtggtgaagcccttggagacatgactcctactgaagccagaaatttaattgagaagatggcctccaactcccagcagtttagcgccagaaatgatgccatagtcattagaggagtgcatgaggtagctacaaacccatatgcatcatctgaaactaagaagcttgaaggcaaactggatgcgttggtcaacttggtaacccagctggccttgaatcagaaatatgtacctgtcgcaagggtttgtggtttgtgctcctctgctgaccaccatacagacctttgcccttccatgcagcaacctggagcaattgagcagcctaaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaaca

SEQ ID NO: 58014 - DNA, 216 bp, Glycine max
  misc_feature (120)..(120): n is a, c, g, or t
  Peptide Sequence Number=SeqID_149699
atggcgaatcagccagtcggccatttcgcgctcttcggcgaggatggtctcaattgcgggtatcgaagcggtgtcgctccggcttttttcgccgctgccagcagggagggaacatgccgncgatggattgccccagcgccgccattttgctcatcgagtcttttaagaccgaacgagaaatatcattacggtcgaggatttcctccagcaatgtga

SEQ ID NO: 58015 - DNA, 225 bp, Glycine max
  Peptide Sequence Number=SeqID_149700
atgactaaagcacgtcaaaaaggagtacggaaagtaaaggaaatgagggctgaacgaaattcctcttcacttctccccctatttataagaaaatgggagagaagcttgccacccagctcgcccaggcgagcaaggtggcttcctccagaagcaaccgccttctggaggaatcttctggagggcccaagtgggcctggttgctatttgcacccccatttttactaa

SEQ ID NO: 58016 - DNA, 345 bp, Glycine max
  Peptide Sequence Number=SeqID_149701
atggcgaggacgtgtagtcctctaaagggcaggatgtctagtcctctcaaggtgatggcatggacgtgtagttctctgaaggtgagggcgtgcagccctatgatggctaggacgtgcggccctctgatcgggggtcatgtggtccattctaaaggcgaggatgttagtcctctaaaggtgagagcgtgcagccctctgatggcaaggacgtgtagtcctctgaaggtgagggcgtgcaaccctttgattgtgaagacgtgtagtcctttaaaggtgagggcgtgcaggcctctgatggcaaggacgtgtagtcctataaaggcgaggatgtctagtcctctgaag

SEQ ID NO: 58017 - DNA, 566 bp, Glycine max
  Peptide Sequence Number=SeqID_149702
atggcaattctgatcgccaatacttcaacaacatttcatagggatgaaagactcgggaatacgcatgatatgcatggaaaattgaaacaggtttatgatcccaacatgaggaaaatgcaaggatcatgcatgagtaaacatgaagacaaaaatggaacatatgtccattacgatgccatgaagagatgcttatgcgttaagaaggtgatatggaccttccaacttcccgtgataaaagacgagaccaacatacaacgcatgcgtgatgacatgatgcagatgcgcaaaagcgcaatagtgggatgtatcacccccttcgaaaaacatattgtggcagtagggactaccaacaacaatatgttatcaaagataaaaactctagatgagggttcactgttatcaagaaagtcggagacccagcatgaccacaaattcacctccactccttatattcccatgaacccgagtgtagggcctagtatctcaatgtgcgtcttccaagaaaggaaaatgcgtggagtcgccaccaacgtttatttgaggaaaacgtcggaaaaaccggaaag

SEQ ID NO: 58018 - DNA, 300 bp, Glycine max
  Peptide Sequence Number=SeqID_149703
atggagaaaggctacacacttcactttgaaggaggtgtatgcaaaatcttagacaacaaaaataaaagattgttacatgagaagaactcgaagcatgatgagcaaagatcttctaagcataaaggagatacaatgaagtgtgtgaaaggatgtccttccagtcaaagtttaaatttcagccccaaaacaagcggagcatggagagcgaaagatctattggagctgatacatacggacttgtggaccagaacgccatcacatgagaacaagtacttcatactcttcattgatcttctctag

SEQ ID NO: 58019 - DNA, 492 bp, Glycine max
  Peptide Sequence Number=SeqID_149704
ggcctgggatttcccgcactgaacacaggactctgccagtcgttcagagtccccgtggcacctaccaaggtgattcggccgcccatcacccgggcttttattgagaagtactgcacccagagacaggctcagggtgatgctccgcaggtcgtagacgcgccgccacctcatcaggctggccaggctggatcgtttgatacggagcggtatttgcggcatttggttcgccagcaggcagccaaccaccgggcacatgtacagacccatgattgtctttaccagctaagcctcagcatgcagagtcagggcttcacttctttttcatgccctactccagaccagttcagggcagaggtcgcatggcccggggattggcccgaggcccaagcaggagaggcgcccccagaggctcccggcgatggagaggaggcccacgaggacgaggagatggccaatttgcttgacttcttgggaaggagtggagctacatga

SEQ ID NO: 58020 - DNA, 444 bp, Glycine max
  Peptide Sequence Number=SeqID_149705
atgcgacttaggactgcatctggagacgtggtccctatcaacttggaaatcgaagccacttgtcggcgtaacaacgctgcaagaagaagaagggaacaggacaccgaaggaagcagtcacacatcacctcctctctctccacatcacgctgaaatggacggggaacaggcacgaagagtcaccctagaagacttctccaacaccgccactcctcagttcttcacaagtattgcaagaccggaggtgcaagccgcaaatatctcctacccgcattcccttatccagctgattcaagggaatctcttccatggtcttccaagcgaagatccttatgctcaccttgcctcatacattgaaatatgcaacaccgtaaagatcgctggagtcccagaagatgcggagaggcaaaacgatggttgcactccttcaaaggcaacagcttaa

SEQ ID NO: 58021 - DNA, 492 bp, Glycine max
  misc_feature (14)..(14): n is a, c, g, or t
  Peptide Sequence Number=SeqID_149706
tacgcgcaacatcnaccgagcttctcggctcacaccgggaacgcctctagttcagcacctgtgcagcctaaggcacccacccagagggaagctccccaagttccaactctgaacacaactcgcccggccgacctattgtcgtccctcatcgccaaccatttggtcgtggtaactcccggaaaggtcctccaaccccctttcccaaagtggtatgaccctaacgcaacttgcaagtaccatggggaggatcggcccaatgtgagaaccaactcgctcgccaatcatggagggggagcggttaacgcggttgagtccgataggccgcgccggtctaaacctttaagggatgtggcaacccctaggaggtttatctttgaggccctacaaaagggaggtgtgattcctcatagtgggctgaaggaagggaagaacaacatatatgaatgcagtccgcggatgggagcggtgttgcgaagcccaaacccttggtga

SEQ ID NO: 58022 - DNA, 600 bp, Glycine max
  Peptide Sequence Number=SeqID_149707
atggcttcaaactgccaacaattcagtgcaaaaaatgatgctattgtccttagaggagtccatgaggtggccacagattcatcttcatctactgaaaataaaaagcttgagggaaaacttgatgccttggttaacctagtaactcagcttgccatgaataaaaaatctgcacttgttgcaagagtctatggtctatgttcttctgcagatcaccatacatatctttgtcattctttgcagcaatctggagtcaatgagcaacctgaagcttatgctgcaaacatttttaatagaccccatcgacaacaaaaccaacaacagcagaataattatgatctttcaagcaacagatataatccacgttggagaaatcatccaaatttgagatgggcaagtcctccacaacaacaacagcctgtccctcctttccagaatgctgctggtccaagcaagccatatgttcctcctccaatacagcagcaacaacaacaaagacaacaagcaactgaggctcctcctcaaccttccttagaagagttagtgaggcaaatgataatccagaatatgcaatttcagcaagagacaagagcctccatttag

SEQ ID NO: 58023 - DNA, 189 bp, Glycine max
  Peptide Sequence Number=SeqID_149708
atgtcgatcttcccctgcgaaagtatcggttggtctatgccgtcacgacatagggattgtgcccgcaagacacccagcggacccggagaagcccaacagggccatggggtttccagctctggttacgggcatctgttagtcatacagggtgcccgttccccccagcaaggtcatgtcgtcataacatag

SEQ ID NO: 58024 - DNA, 456 bp, Glycine max
  Peptide Sequence Number=SeqID_149709
atggccaagttcgacccagaaatagtcctcgaattttatgtcaatgcttggccaacagaggagggcgtgcgtgacatgaggtcctgggtgaggggtcagtggatcccgtttgatgcagatgctatcggccagctcctgggatatccgttagtgctggaagagggccaggagtgcgagtatggccagaggaggaaccggtctgatgggttcgatgaggaggccatcgcccagttgctatgtataccaaggcaagatttagcccggactgctgccggaagacgggtgcggatcatgcgcaccaatatgaccaccctgactcagatatggatgactttgctgctcagcaatatcctgccccggggggggggtaattccgacctcccccctgccgaagtgtcagctggtgtacgccatcctgacgcggatgagcatccatgtggctcagttaatcgctga

SEQ ID NO: 58025 - DNA, 504 bp, Glycine max
  Peptide Sequence Number=SeqID_149710
atggcatcattcagccagatgcagtcccagattcagtcccagatgcaatctcagggacttgcactgcctccagagcctctggttggtccctcaggtgctcgagtaaacacaaaggggagttgtgttgatccctctggaaatgatccagaggcgggtgactcagataggtgcggcttgtacatcgcagcagatcctgcccgcctggttgccctagggagagtttatgagggatccagtgttgttcataacactcctttgttgcctggccaagtaaaggtgagtgtggtggaggttacaaatgcagatgctccagttcctgtacctactgatgaggtttccttagtagggcaggcacttcacaccttccttgcttggccgacacatctggtcaagtctttatcacagcaggtagctgtgtctctggcaaaaccacctccaaaacccgatccggaggtcgatgattcgatttatctgatgacattgaccatcccagagcttttctag

SEQ ID NO: 58026 - DNA, 288 bp, Glycine max
  Peptide Sequence Number=SeqID_149711
acacttgttagcactgtcacacctcttgggcttgagattattgctcaactaaaagagttgttggatgagggtttggttcgtaagagcttaaatccttgtgctttgttggtgcccaaaatagatattatgaggcatcaaatccctatgataggtggtgttgagggaagaagcccagagtttcaagaacctctggatttgagaagactccaagaagattgggtcagagatgcaagagaagaccttaggattctcatgagccataggatagatttcgggcacataggctaa

SEQ ID NO: 58027 - DNA, 207 bp, Glycine max
  Peptide Sequence Number=SeqID_149712
ggccctgggatttcccgccttgatcacaggactctgccagtcgttcggcgtccccgtcgcacctagcaaggtgattcggccgcccatcacccaagcttttattgagaagtactgcacgcaaagacaggtccagggtgatgcaccacaggccgcgggcgcgccgccaccacatcaggctggtccagccggatcatttgacacggagca

SEQ ID NO: 58028 - DNA, 315 bp, Glycine max
  Peptide Sequence Number=SeqID_149713
atgaagaaaagagatacaggccatcaaagtgtgtcattggagaataagacaggagattcaactgtgttgaagataggagattccgctaaagttgtgataaaacaagacatgaagggaagaagacataaatatgggtttaacaacaataaacgtgagaagccagagaagatcatgggttctccacctgccttccctcctcctcctccttctcctcctcattctcctcctcctcctgctccttcggacgcatcaggttcaccgtctaccgtgaagcgaacacgcaaagccctccgtctacgatcattgtctacttga

SEQ ID NO: 58029 - DNA, 204 bp, Glycine max
  Peptide Sequence Number=SeqID_149714
atgccaaaagatagggggacttgtcttgatttcagggattgtcatcatcaaaaagggggagattgtagacaaatgatcaagctgaatgttttgatgatgccaaaggttcacatgcgcctcaaagctttattagagacaaagaaattaaagatattcaagatgaatgatcaagacaagtctctagtcttagaaagggtatattaa

SEQ ID NO: 58030 - DNA, 836 bp, Glycine max
  Peptide Sequence Number=SeqID_149715
ccattgtcccgttacccacttcagagattcagtatgtcagggacgccgtgaactcattcattggatggcccagacatctagtgaaacctttatcttatgattctgaccttaatgtgcggaagccagttgaacatagtagtgatgcaaagcttgcaggtgaatccgatccattgggagagttgatgaagatattgttttatgtgtaccagaatccagtggaagtgccgtgggaggctcaccaatttggacttcctgagattggggcaaaattttacatcacacatgcagatctagcagaaataatatcaggtgacaagtgtttaaacatagcgatactacaattgtggaccatatttatgaatgagtgcggtagaagcaaagctgatcagtcactatatggcttgctggagcctcaatctatacaaaatgctaaggaaagacgtcaacaatgccaacaatacattgaaacatgggtcaaggaatcacaaaggcagttgtatttaggagcttacttgcatcaggcacattggcaactatttgttctccacccaagggaaaacacggtcgtttggttttgttctctgaggaagaagcctgatattaacatgaaaggcgcaattaacagcaaaaatggttgtcatatatatgctattttattaactagtgcaatgaagacaataaccagttcttttgaaggcatgtctaatcaaggtgcacctcggtgggttgaacccaagagtaatgttcaaagtggagggtttgagtgcggatattatgtcatgcattggatgtggtgcatcgtgactgccgatttgaaggatgactggcacaagtga

SEQ ID NO: 58031 - DNA, 223 bp, Glycine max
  Peptide Sequence Number=SeqID_149716
tgagaaaagctgtgatttggttggtgttttggcagagttttctgcctatgctctgtttttcttggctgtgatagcttgtgcgaggattgatggggacccggtgttgagagaaacgaggatatgggctacgtgggagtacgtgagcttagatggaggtggacaacaggggatgagtggtacttggagatatgtcgcgggggtcaggagaccttggggacgtcag

SEQ ID NO: 58032 - DNA, 372 bp, Glycine max
  Peptide Sequence Number=SeqID_149717
atgaaacccccagatgtccaagaggatcacatatttctgaaggcttttcctcattcattagagggagtggcaaaggactggctgtattaccttgctccaaggtccatcacgagctgggatgaccttaagagagtattcttagaaaaatttttccctgcttccaggaccacaaccatcaggaggatatctcagagaagtatgatagatgctgccagtggtggagcccttggagacatgactcctgctgaagccagaaatttaattgagaagatggcctccaactcccagcagtttagcgccagaaatgatgctgtcgcaacctacccttcggcgggagggcgacgcgtgactcgcgggatgcgtcttccatga

SEQ ID NO: 58033 - DNA, 405 bp, Glycine max
  Peptide Sequence Number=SeqID_149718
atggtgggttacacaccttcaagttttatagatttggtctttgccagcgaaaggatcgaagtgggtctgaaaagaggaaaatttaatcatcctgctttgatgaatgagaaaactggggcaaatgaagagggtgaggatgagggagaaacccatgctgtgactgccattcctatacggccaagtttcccaccaacccaacaatgtcattacttagccaataacaacccttctccttacccaccacccagttatccacaaaggccatccctaaatcaaccacaaaacccaccttctacacaaccaatgctaaacaccacctttagcataaatcaaaacaccaaccaaggaaggaattttgtagcaaaagcctgtagaattcaccccaattctggtgtcctatgctaa

SEQ ID NO: 58034 - DNA, 678 bp, Glycine max
  misc_feature (678)..(678): n is a, c, g, or t
  Peptide Sequence Number=SeqID_149719
atgcatgaacatcctctgattcttctagtgaagaagaacttgcaggatgactctttaatcattgaagaaactgaggtaaattctaaatttgaaaaagttttggaagcctttaatgaaatgcatgaggaaacacaaaggcttgctatttcgaactataagctaagaagcgatctaaaatggcatatcactaaattggcttcaacacaaagtgagcttgttaaattgaagcatgaaagtgaaaaacttgtttcaagttataaagccattggttgtgtttgtgtttctaattctcttaatatggatgattacaaatctttgccaaatgagtttgaaaagtttaaaaaggattactatgaagaacttataaagttacaaactgagttttcctatcttaaatatcttttcaggaaaatgaacaaagaaaagaatgatcttagtcactttctcagtgtgcaaaagcatactaccagtaagactggtttggggtataacaagcaaactaaattttttaagaaaactaagtttgcatcctccaaaaaggtgaacccaaacagagtatccaaaaagaaaaacataatgtatcctaagcttgatgcaaagacttatcattgttgcatgaaaagagggcacacatcctgcaaatgttatgttaggagatttgatgttctgagagcctan

SEQ ID NO: 58035 - DNA, 307 bp, Glycine max
  Peptide Sequence Number=SeqID_149720
atgggttttccggcattcatcacgggtctctgccagtcgttcggggttcctttcacacctagtaaggtgattcgaccgccgatcacctgggctttcatagagaagtactgcacagctagacaggcacagggtggctacctgcaggccccagacgcaccgccgccacctcctcaggctgatccagctgggtcatttggcacggagcggtatttacggcatttggttcgccagcaggtggccaaccacagggcgcacgtgcagacccatgactctctctaccagcttagcctcagcctgcagagccagg

SEQ ID NO: 58036 - DNA, 375 bp, Glycine max
  Peptide Sequence Number=SeqID_149721
atgaattgcattttcattcatgtgtcctccaccttcgagtttggagccatgcgtagtgattgcttagtgaaattctccattctcaatctttttcgaagccccatgaattgtgttttcgttcatgtgtcctccaccttcgactttggagccatgcgtagtgattgcttagtgaaattctccattctcaacctttttcggagccccgtgaattgcgttttcgttcatgtgtcctccaccttcgagtttggagctatgcgtagtgattgcttagtgcaattctccattctcaatctttttcggagccccatgaattgcgttttcgcgctcatgtgtcctccctttacgagtggggagctatgcgtagagatcgcttag

SEQ ID NO: 58037 - DNA, 518 bp, Glycine max
  misc_feature (479)..(479): n is a, c, g, or t
  Peptide Sequence Number=SeqID_149722
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgntgcgccttatccggtaactatcgtcttgagtccaacccg

SEQ ID NO: 58038 - DNA, 303 bp, Glycine max
  Peptide Sequence Number=SeqID_149723
atgcttttggacaagaatgatattcaagaaactcattatgaggttctccatgtcaaggaacatgcaaattatgaagaaattcgtgctggttaccgaagtgttgtactcagcttacatcctgataggctattgaagacgtccaagacatccagcaatttgagcttaaggaaggatgtcttggctgctgacgttgccgaagatttgagcttacaggatatgatgattgaagatgatggagaagcattggaactgttttatcaatgcagatgtggcgattacttctctgtagactcttggaattga

SEQ ID NO: 58039 - DNA, 516 bp, Glycine max
  Peptide Sequence Number=SeqID_149724
atggaccaacccacattgagagtacatatagagcaaagagttctaaatagatcggtcttgatcaatcttcggtttgagaacagtgcaatgaacttcaccccctttggaaacaatagtaaactcatcacatttgctaaatgcttaggcaaacttgtatgcttaggagcatgccttgagcacaaacctgtaggtgaagtggccagagacaacattggtagtgtgcatgtggatgaatgtgaggaggtttggaaaaagcttcagttttcgttaggggcagaggatcaaacacttggtgagcatttgtatatggaaatgtcacgagatggtgcaaagacacatggtgctgtgttggcatgtacagatggagcagttcttcccgtcagtcaagtgtttgatgcaattagagagcttgggaatgaaggagttgagcaatgggatcctctagttcttacttctgcctcactcttgagtatttatcccgctcctttgatgattgcatttctgcgtgcgctttaa

SEQ ID NO: 58040 - DNA, 198 bp, Glycine max
  Peptide Sequence Number=SeqID_149725
atggggggaggaggttgcatgacagctcgcccagcagatgacaaaggagaatataatagtctcggtcgaaagacatggaagtcttcaacaaaaggggcagatgaccataatttgtctctgcgtgccaacggactcgcttgtctctggatggcaaaggaagcggatgaccataatttgtctccgcgttccttttactaa

SEQ ID NO: 58041 - DNA, 216 bp, Glycine max
  Peptide Sequence Number=SeqID_149726
atggcgctagttctgatggcgccttcaagctggacgaggcacgtggccaaggaagcgccattcccagcagcgttttcgcttttgctgagctggctttggaagcgccagcagcagtggcgactgcagtgcaggaaaagctgcagccctagctttagcattttggtgactttggaaatttctgtggttggtgttgatgaacgcatgaagtttgaataa

SEQ ID NO: 58042 - DNA, 138 bp, Glycine max
  Peptide Sequence Number=SeqID_149727
atgccgcagtataaaaatttacctgacactagaggtacgataattggtaatgaagatatcgatagtattaggtggcctggttttgcatggagacgtctcaagcgcaggggaattgatgatgtggtgatgagaaaatga

SEQ ID NO: 58043 - DNA, 300 bp, Glycine max
  Peptide Sequence Number=SeqID_149728
atgtgggacttcacctcacacttgtactccaagaatctctccctcaagtgtaagtctcatccacatgctagcttcccccttgaggtgaagccattatcctccacgagtattccatggtggccattaaagttcatatgctctagatacttgcacagctgctccacccaccagatacgctgtctggacccaccgctaggaagactgtcgatacaagggatccacaggccaaggatccatcaccgccatcttactcatttgagttggtcaccaaatcaaatcatcaactctgataccaattga

SEQ ID NO: 58044 - DNA, 471 bp, Glycine max
  Peptide Sequence Number=SeqID_149729
atgtctgggacatccaaggttttgcctgctctccactctatcaaatcgttgcctcccaagttcaagattatcactggtaatccgacttctgatctaatggaaaatcatggagatgctaagctgagaagcagtgatgtgattggatcaggtagtccagaaaatgatgttttgatagcggaggttgctgaggaagcttgggaccgtgctggtgacatgggtgtttacgatgaggactcggtgtacaacaaaaaatgtgtgtcattagaagacaggccatcaattgctgatgaagacttagaatctattcctctgccttcccatcaatttcaatctcctctagggaacacaggtggagtgatacgacaccttatgcttcgaagaaggttattatttatattgtttattatttttttatatggtcccttacaattgcgttcagagcttcagagtactcataactttgtgaattag

SEQ ID NO: 58045 - DNA, 237 bp, Glycine max
  Peptide Sequence Number=SeqID_149730
atgatcaaggtgaccaaccctagatacctaagtgaagaattagggtacacgtcgtgggcacgctccttatctcccacagctcattcccatacttcatgctcatcgccatcgaagccgacaacctcatccaaggcttcctccttttcctcttcattccattcattatcttctcctacctcttcatctctgaatcccccagcatctagatccttatctttatctccttctccggcctaa

SEQ ID NO: 58046 - DNA, 126 bp, Glycine max
  Peptide Sequence Number=SeqID_149731
atgcctcatgctcagaatgcagaagaagaagaagaagaagaagaagaagaagaagaagaagaagaagaagaagaagaagaagaagaagaagaagaagaagcaatcaatttaacaatgttcttttaa

SEQ ID NO: 58047 - DNA, 186 bp, Glycine max
  Peptide Sequence Number=SeqID_149732
atgggatcaaaacataaaaacaaggtagagaaagccggagaaggagataaagataaggatctagatgctgggggattcagagatgaagaggtaggagaagataatgaatggaatgaagaggaaaaggaggaagccttggatgaggttgtcggcttcgatggcgatgagcatgaagtatgggaatga

SEQ ID NO: 58048 - DNA, 511 bp, Glycine max
  Peptide Sequence Number=SeqID_149733
aaccaagccagacctcaacaaaactttcaaggaagctgccaagtctatagagatggctcaggttcaaatcagccttatggctagagaccacaaaattctggtatccatcgcaaacaagaagaacactgatgcttctattaaaaatctagaagttcaagttggacaactggcaaaagaactatctaaacatggaagtggatctttctccgcaacaacacaggataatactggaaaaaagaataaagaaggatctgaagaagaaaacaacaaaaatgatgaagtgggtacatcctttgtggtacaagtagagggtacatctacttgggttgttgtaactgagaacaagagagggttcatctcttgtggatcaattcaagtggagggtacatccacttggttgttcaaagagaacaagggagggtacatcccttgtggatcttttcttgtaaaggcttttacaaggttgaaaagaaatctcaaggaccgcaggtcgcttggggactggatgtag

SEQ ID NO: 58049 - DNA, 76 bp, Glycine max
  Peptide Sequence Number=SeqID_149734
caaaggaatccatttatgaagaagatcatagacctacaagctccaatggagcttacatcacctttgaacttgaggg

SEQ ID NO: 58050 - DNA, 830 bp, Glycine max
  Peptide Sequence Number=SeqID_149735
catttccagacttaagggaatccgaagtaggtgcgtctgaagcacatatcatggttgaagatcaaccacggagagtgactcttgaggactattctagctccatcgtgccgcaatttttcacaagcattgcgcggtcggaggtccaagctcacaacatcacatatcctcattccttgatccagttgattcaaggaaatttgttttatggattgtcgaatgaatacccttacgcacacctggctacatacatagaaatctgcaacacaatgaaaattgcaagtgtgtcagaagatgcacttaaagacttgggaagaggttgtagagaaatttctgaagaggttgtagagaaatttctgaagaagtacttcctagaatcaaagacagctgaaggcaagtccaagcagttattggatgcttctgctagagtaaaaattaagttgaagactcctgaagaagcaatagaactcatagagaatatggctgctagtgatcatgctattctgcatgatagaactcatgtacccacaaagagaagcctgctagagctttcttcacaagatgcactgttggaggttgcagcatatgtggaggagcacatgaatctggttgttgcattcccttggatgatgctacaaaggaagtctcatcctgggaatcaattcaacaaagaccaaggagtaccatccaataggcctcagaatcaaggacctagcctttatgagaggaccaccaagctggaagagactttggctcagttcatgcaaatagctgacaattcttctagaggttttggggccaatactgagaaaaatcccaaggaagaatgcaag

SEQ ID NO: 58051 - DNA, 627 bp, Glycine max
  Peptide Sequence Number=SeqID_149736
atgtgttctatgcaagattcgttggaggaccagacctcacagggttcctttgtcacccatggacgtcaagatgtactaactgctgtcattgggcaaccagaacaccctggtcatggactcacattgcctcccgagcctgaggttggtccttcagttggtcgtgttagcacaaaggagagttgtgttgatccctcagggaacgatccagacacaggtgacttaaacaaatgtgggttgtacatcaaagaaaatcctccctgtctggttgccctaggaagagtttatgagggatccacaactgttcacaacattcctttgttgcatgatcaagtcaaggttggtgttgaggaggttagagatacagatgctccgattcttgtacccactgaagagggagctgtgggaccagcaaaacctgcagataggccggagcatgatgtcgatgatcccctatatttcatgacattgaccatcccacagctttttttgaagccattgcaggttacatgggatgctaccgtgtttggggtgtttaatgaagacttccccttgtacataaagtatgaagatctatctgaaatagtacatggtggtcaatgtctcagcatctctgtcatacagttgtag

SEQ ID NO: 58052 - DNA, 246 bp, Glycine max
  Peptide Sequence Number=SeqID_149737
atgcctttcctggctgcattaaaaccccctattggagccgaagcaatagaatcagctttgcctgaaggatttaatgagagaacaaagggaagaggggtggtacatggggattgggttcagcagctattgatcttgagtcacccatctgtgggttgctttgtgactcattgtgggtctgggtcaattcaactgatagattcaattcaacttcagactcaccatggtagggaaataaaaccttcatga

SEQ ID NO: 58053 - DNA, 441 bp, Glycine max
  Peptide Sequence Number=SeqID_149738
gcagaatttgaaatcccggaagcttctaacagtaggacaaagaagaaagttcttcaaaatgtgggcgagcggtggaggcagtttaaatctgatttgaccaggaaatgggcacttgcagccgacaaggacggtgtggatgacactatctgtgaaaaatacggaagcactgagggtgtcattaaccctccatctcccatcagacgacacgcgaagtggaagatggcccgcaccaagaaaactgggcaaatgacgtctgaggccacaaagaaaattgttgagaagattgattctttggaggagcagacgtcacaaggttcgtttgtcccccatggacgtcaggatctcttgactgctgccattgggcgaccaaaacaccctggccgtgtgcgtgctgctggagccgatgtcaccatcaagcaatacttcggattggctccatga

SEQ ID NO: 58054 - DNA, 1191 bp, Glycine max
  Peptide Sequence Number=SeqID_149739
atgtctatcacaaagctcaaccttcatagatcagaacgtggatatgatgaagatattggaaaaagatcatgggttgttgatgaaccacaaaggctggccccatcaagcataatcattcaagtatgctggtttgttgctgtttcgggttggtctggtagtgacttggctctcctgtatgatgttgttgatatcaatacccccttgttgaagaccaaccttgtcctcaaggagctgaaatggttgaacaatggggtgattatcggtgttggaagtaggaagtggggaggtgtcattgggaatgggcctgtggtgaagtttcagaagacaaacatgaaaaacgggtttaacataaacccagttgccgacgcccgtgaagtaaggagtgaatcgatggcttccattgttgaagaaccttggaggtataatggaagtgaaggcgaggggggaaaagggtcgaggtatgttcctttagagtacctgtcaacgacgaccatgattgttgtgaagccattggaaactggagctcctgatatgtggagttcgcctgacacgcttgtcggggttactccattaaaagggaattgggaatggataacagtaattgcagagttggtgtctcggggatcctggataaagcgtctgcgaccacattggaagaaccacccctatattgtatggtataatcatacccaagcagcttggagagctttttgtagttgtgggaacaactgtttgctgaagaaagctatggggtgggagttctgcaataggactgtacccaaagctgtgctagaggcgtttgatttcatgataaatggaatgaaccctgtgaggcctaggaaacctctcaaatcagagggtgatgccgaagttggccaatcaagcatggcctgtattttagctgggtttggggctactccaagtgatgatacaatatggccaagtctgtttcgagatgttccaagtaggaaggaaaagaatgggggcgttacacaacccaaagggcaaaaccttgaactcataatgttcgtgatgtatgcggaacatgattttatgaatgtcggcatcattgattcgaagttgatgaaaaccttgacggaggaagttgttgtggttctcagaaattatcatcaaattgatgaagaagatggtccagggaagggtgtgtatggaggtcagagggaggtgtag

SEQ ID NO: 58055 - DNA, 843 bp, Glycine max
  Peptide Sequence Number=SeqID_149740
atgacagagactaaatgccccaagtattctacttgcctctacgcaaatgagcattttgataacttcataaagaattgccctataagtagtatctcgaaggcagtttccaagaggatgaggaccaaatatgtttttcatggtcacctggaaggtggacggggtgttacaaagcccaaacggagatcgagctttgagaaccaggaggcgtcgccaagttcatccagtaactcgtctatggtgggaatgggaaaacggttctgtaatggtgttccgggcgtgataatcaacgcaaaatctccaagacccatcgtgtttcttaaccaagagtacagaattaggaaggagatgaatggtgtgattggttggccgcgaagggggcaaggtggttggtgtctgaaagagaagagggtggctggggtggaacgggtaaaagtggaggaggtggggttacgggttggggatatggtgatggtggaagaggggaaggttgatgggttcggccccggaaattccgacattggtcaagaagcttttcttcctaaagtcgagccaaggttacggcctggaccagtagggttccgatgggatcatcatagtgggacggggcaaaacaagcctcaagggcctaaaggaatcctggccatgaagagatttggccattccgggggttcgttccatcaaatcgtggaacttccaacttcactcgcggaagatgtgatgaggaatgggactggttcacagatgaagaagaaggtggagaagagtgtggtggggattgctgttgttgttgagtggtttccagggtggtcattcgctggagtagctcgtccaatttggaggtga

SEQ ID NO: 58056 - DNA, 1185 bp, Glycine max
  Peptide Sequence Number=SeqID_149741
atggatgcaccttcgtctcaggatactcttgcaccaccacatccattgcccactctagttgcttctaaggcaacaggcgcaatggcccaagtgccaaaaaaggtagcaccaaagaagcaacaaccttcgtccactacaaaatgcctaagggcacttaatgagactaagagtgacgaagatgggttggtgtttagaaaaaagaaagttgcaccacctttggatgagaccactgcgcctcaaatgaataaggttaaaccaaatccacaggttattcacttcaagaaaaagaagaaaactgagtccactactggcatggacaatgagattcaacaccaagcacctctatcccccatccaccttgatcgcttccaacatcaaggacaacctaccatcgaacccaacctcactgttgaagacaccacaaggtacttcactatggaggctaagaagacggtcactctgaaactagacactaagttcgaccagaatgacgccatgcttttttacttcaaagacatgtatgaaaactcacgtctcatgtccatatcaaattacgaaaaggaagacacattcaatcatatgcgtatggtgcaaatcttgcgtccaacaaatatctacagattcaatgattggaaaatgtgtcctaaatctgcaatgcaaagagttgttgtcattgcttgggcaaggcatcctatactcaaagaacatccattctctccatatcataaaccttgggaaaagcttaattgccagcttatggagatgcaaaaagaggcagaagccaagaaacaacaggaaaagctcaaatctaaagagctattcaacaacctacatgttcatcttggaccccatgtcaatgttgttgaacctccgctagttgaagtcacttcccaatccatacctgaaaatgtgctcacaactatcaacacttctggtactccacgagagataacacctttgattgtcgttgcttcaaatgagtcatctctcaggtctttcaatgactcaatcctcttcaacgtgaaccttttaatgcaacaaaggctacctccaactgtccaacctcctcctctaccacctactactcctgcacctgcacccattgaaaatcatgtgcctgtgcctccaccttcaccaccaaagtcaccatcttccattcctcaacctctgtccactactggatga

SEQ ID NO: 58057 - DNA, 384 bp, Glycine max
  Peptide Sequence Number=SeqID_149742
atggctacgaaaccggtcttcatagtagaaatgaagattgtgcccataccggagaagtgcgtgagaagcttatccgcgaggaggtccaacggtcagcgaggagttcccgacagcgatgagttgcatcatcgtcacacagatgttgatgtgcttgctgggcccgggaagggtgagaagcacaccgttgaggatgacaaaggcctcctcgaggttgccaaagatggagaagaagcttgcattgagagacatcatggtccgcaacagcgcgcacaacaacaaggacgtcaaggtggcgcaccaccgcgtcctaaaggatgtcgaggaactggtcagggtgaagcgctcgatgagcttgcgagcttcgaagggggagagcttgagggg

SEQ ID NO: 58058 - DNA, 729 bp, Glycine max
  Peptide Sequence Number=SeqID_149743
atggatatttcagactcaagactcttaagagtttacgagtttacttcagtcccgcgagtcaactcggaagcaaactcgcaaactcggagcagactcggtggactcggatttgcttcgagcttgctcgtgcattttttctttctccctcaaagcctcacactgtcacacaatcaccccataggagagttggaggagttgttcagagcctcagaggatgaccttattctgcggtggtccacgacagtagcagacaaccatgttcatttggaagctgcgagtcctaactcccatgaggtccacgacgagcacaacccatcaagcagaagcaaaaatgctccaggaaataggactaatattgggtggaagcatgagacagatgttttagggaatggtaaaaaagttaagtacaactactgctcaaagatcaacaatgggggaattttcatattcaagcatcatcttgctgggactagatgggattctgaaccttgtgcttcagtgcttgaagaagttaagatgcttatgatgaacgttgttgcagaggttgctaatgcatcagagaagagaaaaaagttgaacagtattcatgaagaaggtactgagggagtggaagtggagtcaaatagtagtcaaagtggaatacaacggaaatggatgcttggtttcaaaggaagaggaaagcaaaatttgtttaggctagtggtggtgagggagttcaagcaactttaa

SEQ ID NO: 58059 - DNA, 219 bp, Glycine max
  Peptide Sequence Number=SeqID_149744
atggacatagactatgctataaggaaagatgaaccacctgcaatcactaatgaatgtagcccagctgttgttgcactatatgagcggtgggagcgatccaaccggctcaacgtgatttcattaagaccaaaatctcggccgggatacatagatctttcgactaacatgaaaaagtccgagacttgcttaaggccattgatgaccggttcatcacattag

SEQ ID NO: 58060 - DNA, 372 bp, Glycine max
  Peptide Sequence Number=SeqID_149745
atgggagattgcttagaggatatgatttgtgatcttggacaagagtcttttcaacaaacacatgcccctatgtatgatacattgcaaactgattcaaagaagcctttgtggaaagaacaatgtcacaatcttgggagattgataagtgtagaagcaaagcttcatggtgaatcaaaaggtgattcaaagaacaattcaagagttcaagataagaatcaagaagaattcaaggctcaagaagaaagtttagagtcaagaatcaagattcaaggttcaagatctcaagaatcaagattcaagactcaagattcaagaatcaagagaaggcttaatcaagataagtatgaaaagttttcctccaaaactgagtag

SEQ ID NO: 58061 - DNA, 900 bp, Glycine max
  Peptide Sequence Number=SeqID_149746
atggaaaatgcaaaagagaagataaaatgcaactttaataacatcatgaaaagctatgatcttgtttggaaaattattgatgagaggtgggatcatcagcttcacaggcctttgcatgtagctgcatattatcttaatcctcatctgcattatgaacctactttcagacatgatgaccctcagttaaaagtaaacaaaatagaaaaaagtattgctcttccatttgatgagattgagtctgatgatgaatggataactgaaaagggatataatgatgaggatgagcaacctcaagctgaaggtgatggtggcaatgttgaattagtgggagatgttggaggaagttcaaatgatctagttgtagacgcttttgatctagataatttaattttggtgaacctaatgatgatgcacaatctgaggaagaccttgatgatgatggagatgcttcattcttcacattgcagtaatatctttatcaatgaaagatgtgacacttctaatgatatcatcagtttcaccaacaatgtcaccctaaatattatcattgagctccacattttcctcaactgcaggctcaagctcagtaaccggctccatgtgctcattagtaacaccctcatcagctacatcaactccaatattagtctttctaacctcagtctcctcgggctcttcaacatcacattagttccatccttgcgaaatggggttgttccaaatatccccaaacccccctggctatgcatttcagctgttttgggtgaaaaaaattatttccatgaagaaaatccaagccgaagcgcttccgtaacgcttccgagacgtttccgtgagcaaatcggtgaaggttttccgtcgttcttcaccattcttcgttcgttcttcgttcttcaacgg

SEQ ID NO: 58062 - DNA, 1434 bp, Glycine max
  Peptide Sequence Number=SeqID_149747
atgtccatcatagagctcaaccaatttgtatccgaatgtgggtttgaggataggggcgtgagtttgttactgaacgtggcagagataagggttgaacgtggggaacctatttatgtgctagacggagttcctatttctgtcaaggatgagataaattgtttgccatatccaacaacaggtagtgatgatgcctactgcgttaagcgtctaagactatttggcgccataattgttcggaaaaccaatatgcatgaactaggatctagaaccagtgggataaattcacatgatgggcctactagaaacccatatgatactaacaagattgcaggaggttcttctagtggatctgcttctctcgtgtctgtcggactgtgtcctattgcccttggtgttgattggggaggatctgtaacgatgtcagctgctctttgtggtgttgttggtctaaataacgaaactctaatgatttgggttccaacaaatccaagaggtgcagaaagattacctcctaggatagttatttggagagaaaaaggatcatccatcgacaatgtaaaaagttttacacaatcatctaatcacaacccatcatatatggatttaacctttaagccaaagtaccttgtgactttcactgttgggtacgagcagaaaaagaatatcgttgtagctgtgaaaaaggccaagataaatcttccccgactgagcttgacaaagtccatatctgacatcaagttagccaaatataggaagctgaagaaaagcagggaagttgcagatgccattgtgaaaaataaccaagacttggttttgaggtacaaggcggtcatcaatgatggcctcaagctggatcttggccacacactttctcttgaaaagactagagagaaccataatgcaaatgattttttgaggtctgacttttcaaactctaatcacgctgtgcagtcccttgaacacgtgaccattgttatggaacaaatgttgcgcctgcttcatacctgtgccttacctctagaagatgtagacttcataaattatgatgggaagacaatgaacaagctgttgctggagttgtccaaggaggtgactcagtttgggagggtctttgagtgtataatggaaacatatttaagcttgagggaacatctagacaggatgtttgattcagcaaaagctttagcttttgagaatgttccaactcgagataatattaaggaagctattttcaaaaccctgattaggaatcgaatgtttgaaaattcccacattcgactttctctaacacaaggaaagaagttgtgcaatcagcattacatggttgaggctaccaggttgtgctggatgaggctaccaggttttattgttattgacttggaaaattgtgcaatcaacattacatggatgacgctgccaggttatgttggatga

SEQ ID NO: 58063 - DNA, 282 bp, Glycine max
  Peptide Sequence Number=SeqID_149748
atgaagatgatgtcgatggaaggaagatacggagggatgtgtatgatggctatggctacgctggtggcaagttttttttttgtgcaatcaaaattggagtgtccaatatttggaaccttgctactgttcatattgaagggaaacaattttactcaccggcttatcacaaatgcaaagttcaaagaattgcctctctttgttcctctacatgattttgaagatcaaatagctaaagctaaaaagagcacaagtgtacctccagccattagtgatcaaacatga

SEQ ID NO: 58064 - DNA, 162 bp, Glycine max
  Peptide Sequence Number=SeqID_149749
atggtggaacaagctacacaagtattttatgttcaagatccttgtgatgaaagatgcagttacatggctacaccgtctagtttacctccttcccctcctgagtcaatagcaccttcttcactgtctatgtcaaagaagacaagaaaagcaacacaactttga

SEQ ID NO: 58065 - DNA, 114 bp, Glycine max
  Peptide Sequence Number=SeqID_149750
atgaggtccttctatggtgattttcaccatggagatgcagcggaagataaaggagaagaggtgagaggaggcatggacactttggaaagagcaaaatgctttccaattgattga

SEQ ID NO: 58066 - DNA, 2139 bp, Glycine max
  Peptide Sequence Number=SeqID_149751
atggctgatgtggttgatcaagacagtaacatagtgtttttccatggtgtgtcacagtatgtcacagacggtgagaccttggtgtccaacagtggagtttttgagcttggttttttcagcccgggaaaatccacaaagcgttacctggggatttggtataaaaatattactagtgatagagctgtttgggttttaaaccgggaaaaccctatcaatgattcctcaggcatcttaacattgagcaccacaggcaatcttgagctcagacaaaatgactccgttgtttggtctgctaactataaagaagaagcacagaatccagtagcagagctcttagacactggaaattttgtggtaagaaatgagggagacacagatccagaaacgtactcgtggcaaagctttgactatccttcagatacacttttgcccggaatgaagttgggatgggacctcagaaccggtctggaacgcaaactaacgtcttggaagagtcctgatgatccatctgctggagatttctcttggggtctaatgctccataattatcctgagttttatctgatgattggaacacacaagtactaccgcactggaccatggaatggacttcatttcagtggatcatcaaaccgaactctaaatccgctgtatgagttcaagtatgtcactacaaatgatctcatttacgcctccaataaggttgagatgttctactcgtttagcctcatcaagaatagttctatcgtcatgatagtcaacataaatgaaaccatgtctgacatccgaacccaagtatggtcggaggtcaggcaaaagttgctgatttatgaaactaccccaagagattactgtgatgtgtatgcagtctgtggagcctacgcgaattgcaggattacagacgcgcctgcttgcaattgtttagaaggattcaaaccaaagtcaccacaagaatggagctcaatggattggagccaaggatgtgtccgacctaaaccattaagctgccaagaaatcgactacatggatcactttgttaaatatgtaggacttaaggtaccagatactacatatacttggctggatgagaatattaatttagaggaatgcagacttaaatgcttgaataattgctcttgcatggcctttgctaattcagacataagaggaggaggtagtggttgtgtcctttggtttggcgatctaattgacatcagacagtatccaactggcgagcaagatctatatatccggatgcctgctaaggagtccatcaaccaagaagaacatggacacaacagcgtgaagataataattgctacaacaattgctggaatcagtgggatactttcattttgcatttttgtcatatacagagtccgaaggagcattgctggtaaactgttcacccatattcctgccactaaagtcatgacagttcctttctatatatatgggttggagaatttaaggccagataacttcaagacaaaagagaacatcgagagacagctaaaagatctggatctgccattgtttgatctgctaacaatcactactgccacttacaatttctcgtcaaatagtaaaattggacatggtggttttggacctgtatacaagggaaaattagccgatggacaacaaattgctgtgaagagactttcaagcagttctgggcaaggaataacggatggatacatggccccagagtatgctgttgatgggctattttcaatcaaatctgacgtttttagctttggtattttgttgttggagattatatgtggtaacaaaaatagagctctctgtcatggaaaccagacacttaaccttgttggttatgcatggacactttggaaagagcaaaatgttttacagttgattgactcaagcataaaggactcgtgtgtcattccagaagtactgcgatgcatccatgttagtctcttgtgtgtgcaacaatacccagaggataggccatctatgaccttggtaattcaaatgttagggagtgagacggacctgattgagccaaaagagcctggtttctttccaaggaggttttcagatgaaggaaatttaagcacaattcctaatcatatgtcttcgaatgaagaattaaccattacccgttaa

SEQ ID NO: 58067 - DNA, 1092 bp, Glycine max
  Peptide Sequence Number=SeqID_149752
atggaagaaataaatcaagatgaaaaagagaaaataagggaagaagaaagaaggaaaatactaaaagagtcacatcttggacctcactcccataggagagaaaaggaaagaaggcctcaagaggctaacattaacctcccatacttccatgggaaggacaatgtagaggctaagttagattgggaaataagggtagaacaacaacttaaaaggaagtctacttcaaaatcttatggctttcactcttatccaaagaaagaccaagggcaaggcatcttaggggtgacaccttctaagcccaaagatgataaggggaagacaatagaaaagcaaccccttaaggctagtatgcaagagaagcctagctccataaagcaacaagaagctgcacttgttactgaggatgttgagcatgtggatcatgctgctgaagaggaacatcctgaattgaagttgtcctcccatgtaaggaaggtaaagaaatttggtaggccttctcctgagattgaaggcttagtggttgtcacaggattaagtcctttgatcacatgttcgttggacattggtgaacggggacttgtgtctacttttgcagagaggtggcataaggaaactagtagtttccagctgtcggtaggagaggatactatcaccctagatgatgtgacattgttgctacatttgaccattacaggtgcctttcataactttgaggctcttcatgtggacgatgtcgtcttcctgttagttgaattgcttggagttccgaagaggcaagagatgagacgatataataccacaacccaaaacccacatactggaagctacatggggggagctgctgtactggtccatctatatgacaatttgaatgatgcatcaaagagcaatgtctggcaacttcattttcctttagttgcttatgctattgctgctggagattatgatgagaggaaaccacatgcttgtcattggaagtctaggaaagcatttccagtgtcgatgtatcttaagcgtctagatagattgatgtctgatgccatgtgttggattccctatggtgaccaccatgcattagagagtttcaactaa

SEQ ID NO: 58068 - DNA, 459 bp, Glycine max
  Peptide Sequence Number=SeqID_149753
gaacatgagatggaactccaacgtcttaatcaaaatgaagaaactgacaaaaagaaaagaagtatagcacttaaagcctcttcatcaatgcaagaaggaaatgaagaagatgaatcagaagatgaagaagacttctcactctttgtgaagaagtttcaaaaatttgtcaagaagagaagaattgagaggcgtcaaaacttcaacaatggaagaaaatctcaagaagactctcaaattcttagatgctacaaatacaatcaacttggtcacatcaaatcaaattgtccctcaaatgaggaatggcctgataaaagtgacaagaaaaggtatgaagaaagaaggaccaagaaggtctacattgcatgggatggcaatgactcatcaaacggttcagagaaggagatcaaccttcttaccaaagactatgagagtgatgagaacatctctcaagaaaattaa

SEQ ID NO: 58069 - DNA, 373 bp, Glycine max
  Peptide Sequence Number=SeqID_149754
atggcattccgagactcaggaaacgcagattccttccaccattcctcttcctcattgttctcatccgaagaacaacagatacaatacacaaatcttttctcttctcgttccattattgatccaaaattcattaatatggatttcttttccaatgagagttttgaatgcattcagacatttgaaaactccaatctcattcctttcatgtctttaaaagtgcctgtttacactgaattggttaaagccttctattctaacctagaaattcaagaaggcactttgatttctgaagtttatggaattaaaatggtcattgaccaatccctattctatgacttgacccaattatccagtgaaggtgtaccatttgaag

SEQ ID NO: 58070 - DNA, 849 bp, Glycine max
  Peptide Sequence Number=SeqID_149755
gtcgactctagaggatcccacaaagggctacatgccctcaccttcagagggctgcacgcccttgcctttagaggactacacgtcctcgccttcagaggtttacatgtcctcgcctttagaggactacacgtcctcaccttcagagggctgcacgccctcaccatcagaggactacacgtcctcgcctttgtagggctacaagccctcaccttcagaggactacacgtcctcacctttaaagggctacatgccctcaacttcagagggctgcacgcccttgcctttagaggactacatgtcctcgccttcagaaggctacacgtcctcaccttcaggggacaacacgtccttgccttcagagggctacgcgtcctcgccttcagaaggttacacaccctcaccttcagagggctacacgccctcaccttcaaaggattacacgtcctcaccatcagagggctgcatgccctcgccttcagaaggttgcatgtcctcgccgttagagaactgcatgtgctcgccttcaaaggtcgacacgtcctcgacttcagagggctacacgccctcgcctttagagggctacacgtcctcattttcattctggggccacccccagatattggagggcgaccaactgtgcgagcacaaccagagagggaggctatcgcgcaactactatgcataccggggcaagatttcacccgtgccgctgcacagaagcgagtacagatcgtgcgcaccaacatgaccactcttacacagatatggatgacattgctacttagcaacattctgcccagcgaccacaatgtcgatctccccctgcggaagtatcaattgggaccgtga

SEQ ID NO: 58071 - DNA, 987 bp, Glycine max
  Peptide Sequence Number=SeqID_149756
atggagaagtggaagcaactttatcttgcaattaagagggagctagatgaacccactcaaagaacatatgatggggatggtctatactggaaagcagaggaaaatgacatccaaatggaaaagcagaagaaggagttgcaagaaaaggaagaaaccatcaaggcctcgaatactagtgactttgtgcctgcttctggcaatagattgtctcacagggatgataaggttgattgtctcatagtaaaatgggatgatgaactagtcaacattcccacatatggagaggctaaatggagggctaatggtgaggaaagacaagtggttatggagagaacgaatgagacaaacagtgtcacagtcaccatttcaggcttggttgagttggatattcattttttccaattggacagaacttgcaccaaggttcacaattaccagttgccaacagattattctttttctcatttggagacacagttgtggtttgagaaaagtattgataattttgaaggagttttgggtcaaacttataggccagggtatgttagccctgtcaagagaggggttcctatgccaatcatggcaagcaattacccttatgaagcaaaagatggaacttgtgatgcatcaatggtgaatgaacctgcagtgtcaattgatggccatgagaatgtccccgtgaacaatgaggccgcattgctcaaagctgttgcccatcaacctggagtatttacgggaaactgtggcactgctctggatcatgcggtagcaattgtgggctatggaacaactcaagatgaaaccaaatattggatagtgaagaactcatggggatccgaatggggagaaaagggttacattagaatgaaaaggagcatatctgtcaacaaaggtctttgtggcatagcaattgaagcttcgtatccaatcaaaaagtcctctagcaaaccaagggaacattcatcatatcctaaagacgagctttaa

SEQ ID NO: 58072 - DNA, 258 bp, Glycine max
  Peptide Sequence Number=SeqID_149757
atggatttatcagtccttgcaccagagatttccttttcctctttgtctgattcacttgtttcttgggcagaaacaacatgggtagtgaacatgacatctttcacagaagacaaatttgacattcttaagcacaacaatctgaattctgccaaagcaataaagggagttttggtcattcaaattggggtcaatgaacaagttctgtacatgcattggagtagagctgcatccataatattggataattgtgcattgtaa

SEQ ID NO: 58073 - DNA, 651 bp, Glycine max
  Peptide Sequence Number=SeqID_149758
atgtggttaaaccggttggacgtgttgacaaggtgcaatataggtgttggagaggatccattgggaaaattgatgaggatcttgtatgatgtttacatgaagctaattcagctgccatgggatgggacaaaatatgggcttccaaatgtggaagcgtcctttttcatcacacatgctgatctaactgaaatattatcaggtgacaagtgtttaaacacatctgtactacaactgtggatgatgtttatggatgactatagtacaagcagaggtaatggttcagtgtatggtttccttgagcctcagtgtatacacaatgctaaggataaatgtcaacaatgtcaagattacattgaaacatgggtcaaggagtcacaacgacaactgtacttaggagcatacttgaatcattcaatgaaggcaataactagtactttcaaagatgatataggagaaattgtcattgagatgatatatgaacaacttcggcagcaacacaattgcggttgcgagctgcaatttagaaccatgatttgcattatagatgctaaacatgtgcttgctttaacatctgtgattattttctttttatatgaggggttacaaacggtttttgaagaaaacaactctagagacatcggactaccttaa

SEQ ID NO: 58074 - DNA, 198 bp, Glycine max
  Peptide Sequence Number=SeqID_149759
atggtttttgtctgtactaagtatctaagagtgtggccgtcatatcccaggatcattatgagttgtggctgctttggactctcaactctcaagaggaaaatgaatccttctcgtactcctaatgagattgatggtgaggggctgaggagaggatcttcatcctctctgaatgatatattgaatattggttcaacttga

SEQ ID NO: 58075 - DNA, 351 bp, Glycine max
  Peptide Sequence Number=SeqID_149760
atgtttttcgctgaaggtcttgacttgggtctttttgacccattcaaggacatgagggacagtgaattgcttgatgaggaagaaataactgccccggaaaagaatgtcggcaaggaggaaaatgttaggcgagcattcactaagcacgacactcagtggctaagcgcgaggaagatgccagaagaagatgagctgtcaggttcactgagcgcactgctccagttcatcaagcgcatcaattcagctcatctgctaagcgagagaagcgcactaagccaaaatccagttatgcacgctaagcgatctagatttatgctaagcgcgcgagcacggaccaacccacctatttaa

SEQ ID NO: 58076 - DNA, 138 bp, Glycine max
  Peptide Sequence Number=SeqID_149761
atgggaatttccatagcaaatgattccatgaacgtcctccagtctatgagtgacggggtgagcttggtgtcaaaaggtggaaagttcgaatttggttttttcagtccaggtgatcgaggccgtacccgaatcaaataa

SEQ ID NO: 58077 - DNA, 351 bp, Glycine max
  Peptide Sequence Number=SeqID_149762
atggaggaagctgttcaatctagaagcactgaggtcgtgattgaccctctatctccaatcagacgacatgtgaagtggaagatggcccacaccaagaaaactaggcagatgatgtttgagtcaacaaaggaaattgctatgaagattgatctcttgactgctgccattggacgaccagaacaccttggttgtgtgcgtgctgctggagccggtgtgaccatcaaacaatactttggatcggctccacgaacctcccacacttcttcctctatgactcccgaagaactagaacagctgactcaacaaatcagggaccaactggaggagtcgatcacagaaaaagtgacttag

SEQ ID NO: 58078 - DNA, 492 bp, Glycine max
  Peptide Sequence Number=SeqID_149763
atgacagaagataatggtaagaaaggcaatgttctaaaaaatgaaacattgaagaatgtgaggtttgtaaggtcatcagcagactcggttaggaatattgggtcacttggaaacaatcatctcactgaggtaaaggaaaatggtgttaatggagatggccaaaagaatggagcaaacattcaaaccagtgacagaaaacatgcaaaggtttatccaacggaagcgagaaatggaattttagacaacaagattgactacctggaaaataagataaagatggttgaaggagagttaagagaagcagctactattgaggctgctttatattcagtagttgctgaccatatggccttgacaacaggactaattgcattggagagcaaaacattttcatctttcaccttggcagtggtacttctaacaatcaaggataagctattccaagataaggctactgctggaaacactcacttaaggtggagaggactttga

SEQ ID NO: 58079 - DNA, 144 bp, Glycine max
  Peptide Sequence Number=SeqID_149764
atgatggtcctgtgcaaatccagaagaaggcatcaaagggcaataattgccatttctgtgggaaatctggacacttccagaaggattgctcaaagcgtaagtcttgttcgaaaagaaaggaattccttacgatccaaactataa

SEQ ID NO: 58080 - DNA, 381 bp, Glycine max
  Peptide Sequence Number=SeqID_149765
atgggaggaactaaaaggattttagtgataattcccaaggtggtcatatctctcttgacggtttctagaggtatcaaacggattgcgcaacaatgtttcttttttacttccggaatgttgcggaactttacgaattacctaacgatgggggttaagtacctcgaggctgtcaagcgaaggttgcatgccaccaaacaatggtccccggacgaaattagggtacctttgacatcaattcgagggcgaattcttcccaagaaggagggtatgataaaggactatctaaggagaaagagtttggcttgggtgggctcaacatggatagaccaatcattagaacaaggagtaagagatttcaataagagtttggcgagagactaa

SEQ ID NO: 58081 - DNA, 285 bp, Glycine max
  Peptide Sequence Number=SeqID_149766
atgaaggttgttatagctaaatgtgcagtgtgtataaaaataatagtgatcatagatgagatgtatgagagtgcagaaaagtggtgcaagaaggggttcaagaacttgacaggaacccaactgatgcacagaagatgcaataattttcagaaaattagatctgctgatactgcaaagaaggcacgggatactctagagaaatcctatgcaggggatagcaaactcaagaaggtgaagttgcagaccttgagaaggcagtatgaacttctacaaatgagtgattaa

SEQ ID NO: 58082 - DNA, 282 bp, Glycine max
  Peptide Sequence Number=SeqID_149767
atgttcactactcatattaagctaactacacaagaggaggttgcactggagcttcatgctagtctgggggttccggtttatgttaaccatggattaagtgttgattttgtcttgaaaagtacaagtttcgatagaatgcaaggagctatgaaacctttgttgtggatgagacaagtgttactggctctatgtagagattgtaggccttggatcttctttatcaatgaagtcctttgcttcttgaagatcaatgatagcagaacggagaaggagaaaaggtga

SEQ ID NO: 58083 - DNA, 180 bp, Glycine max
  Peptide Sequence Number=SeqID_149768
atggtctcagcaagggcacttcctactttcttgtggagaagatcaaattgttggagttataaagttccatccagacaattcaaatcctacgaagcacggacaccccatccccttgtcgtgtccgggtgtccgacacgtgtccgtgtccgtgtccaacacgacaccgacactgacaagtaa

SEQ ID NO: 58084 - DNA, 324 bp, Glycine max
  Peptide Sequence Number=SeqID_149769
atggaggataacaaagaaagaatgtggattggtttttcgagtcttaaatgtggaagcaatgacttccaagattattttgatgatgccaaagaatcaagagttaagcaagttccaaagaatcagacttcaagaatcaagtctcaaagaatcaagattcaagaacaattaagtttcaagattcaagattcaaaaacaatcaagatcaagattcaagactcaagattcaagattcaagagaagttgatttcaagattcaagagaagaaatcgagaagcaacagtcaagacttcacaagggaagtatttttcaaaaatccaagcatag

SEQ ID NO: 58085 - DNA, 231 bp, Glycine max
  Peptide Sequence Number=SeqID_149770
atgtgtcctctgttatcaagcgcggagcctctggtgactggtgtcgcaacctgcccttcggcgggagggcgacgcgtgactcgcgggatgcgtgttccacgaaaggaatacgcgcggagtcgccaccaacgtttatttgaggaaaacgtcggaaaaaccggaaaagacgtgatctacgaacttttaagtgaaaggctcgggagttgtatttacgcacagggaaggtattag

SEQ ID NO: 58086 - DNA, 740 bp, Glycine max
  Peptide Sequence Number=SeqID_149771
atgccacgctcgctaaacaccaccgataccgatctgaccgctgacaatctactgcgcctgcccgctgagttcggctgcccggtatgggtctatgacgcgcagattatccgccaccagattgcccaacttagccagtttgacgtggtgcgttttgcgcagaaggcctgctccaatattcatattctgcgtctgatgcgcgagcagggcgtgaaggtggattcggtgtcgcttggcgagatcgaacgcgcgctggcggcaggttacgatcccgtgcagcatccggacgatatcgtctttaccgccgatctgatcgatcgtgcgacccttgagcgggtgaaagcattacagatcccagtgaatgccggatctgtggatatgcttagccaactgggcgaagtctcgccgggtcaccgcgtctggctacgcgtcaacccgggatttggtcatggccacagccagaagaccaacaccggcggcgaaaacagcaaacacggtatctggttcagccagctgccgcaggcgctggaggtgattcgccgccattcgctgcagctggtcggcatccatatgcatatcggctccggcgttgattacggtcatcttgagcaagtatgcggcgcgatggtgcgccaggtggtggagtttggtcaggatctgcaggcgatctccgccggcggcggtttatcgatcccgtatcatgaaggcgaagaggcgatcgataccgatcactactttggcct

SEQ ID NO: 58087 - DNA, 1173 bp, Glycine max
  Peptide Sequence Number=SeqID_149772
atggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggaagatctatttgacacatttgaccgaaggtgcgagaagagtagcgcacggatcatgtgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaagatacccaaacattccgctgacaactagggtaccccatgaggggagcaccgacggaagaaagcatgtctcatttccttatgagggatctcggcgcacaaaattcaagactatacaaagaatccataaagcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacgagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagg

SEQ ID NO: 58088 - DNA, 255 bp, Glycine max
  Peptide Sequence Number=SeqID_149773
atgggtgaggctttagtcctcactttagttttaaaccttgtgggcagaatcgtcttaggccacggtcagaagtcgagacaagttgacggctggaaatcaaccaaggtacttagggacggatgcaaatgggggatagggtcacgatcaaccgatcgttgtcccttcctggcgctggacaagcagagaacttcgctggaaggcagcccagtatcctttgaattcacagtatttattactattgtttgttttaaataa

SEQ ID NO: 58089 - DNA, 156 bp, Glycine max
  Peptide Sequence Number=SeqID_149774
atgactctaagacaacatggattaagcctaggatcttcttcatcaatggattcctttgcttcttggaggagaaatggcagcggaatggagaaggaagagagagaggagacgccacttcaaggagaagatgagtctagaagaagctcaccaccatag

SEQ ID NO: 58090 - DNA, 601 bp, Glycine max
  Peptide Sequence Number=SeqID_149775
gtcgactctagaggatcccctgatttgggaggatattcaggcggaatttgatatcccagaggcttctgacagtaggacgaaaaggaagttactacagaccgacggtgtcgaggacactgtctgtgacaaatacgacatcagcaaggaaaaatggtcccagttttgccagactcgcagagacccttcttgggaggatgtgcgcatgaaggcacaggccatccagaagcagaatactgccccccacgttttgtctcgtgggggttatgattatttggagcagaagctcctggctgagaagaccaagaagaagatgcaggaagctgcacagtcaggaagcgttgatggcgtcatcgaccctccatccccggtcagacgccacgccgcaaaggaaatcgctgagaagattgccacacaaggatcgttcgtctcccatggacgtcaggatgttctggccgctgctattggacgtccagagcaccctggacgtgtccgtgctgctggagccggtgtcaccatcaagcaatactttggattggctccacggacgtcccacagtgcttcctccctgcctcctgacgaattacagcagctgacccagtag

SEQ ID NO: 58091 - DNA, 276 bp, Glycine max
  Peptide Sequence Number=SeqID_149776
atggaggttgatgaaccttggttggggttatggctaccattgaattatcaagtaggcatgggagcaagtgatgttcgtcattggaagtgcgatagacagactttgtggttgattttagggatggcctttgtggataactgggcggtgggtaaggagaagacccacatcgatcctttcactggcaaagaccagatccgcaaagctttgaaggttctctccacctttgggcgtattcttttgaaagaatcgtgccctctttttgcacatgttctatag

SEQ ID NO: 58092 - DNA, 1206 bp, Glycine max
  misc_feature (571)..(571): n is a, c, g, or t
  Peptide Sequence Number=SeqID_149777
atggaacctctccaaatgcaagccttccgcaagacttacggaaagatcttagagttgaccatagcagaggtatccatagaagccattgcatcactcacccaatactacgaccagcctttgagatgcttcacgtttggagacttccaattggtaccaaccattgaagaatttgaggaaattctaggatgtcctctcgggggaagaaaaccatatctttcctccaggtgtctcccctctttgagtagaattgcaactgtggtcaaagattcagcgagaggtttggaccgcataaaacagactcgaaatggcatagcgggcctaccacggaggtacctagaagacaaggcgaggggtatggccaatcaaggagattgggtcccgtttatggatgtgttagctttgctaatttttagggtcgtcctctttccaaacatggatggtttggtggacctagtagcaatcgacgctttccttgcataccaccatagcaaggaaagttcggtggtagctgtcctggcagatttatttgacacatttgaccgaaggagaatagattgggaccagcttttgnccgggataggaggtagaacaatcagttggttcccccgatggaaggaaggaaaagaaggagtccttttctcatctggaggatacccaaacattccgctggtaggaacgaggggttgtattaactacaatcccgcgctcgctataagacaactagggtaccccatgaggggagcaccgacggaagaaagcatgtctcctttccttgcatgggaaaccccgttaaggaaagatcaagaacttataggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccactacacacattcggaaggagtgtgccgggttacgggaagagaatgcaattaccgcaagagcccttgaacaagagaccaagaaggctcgcaaggaagagtatggccggaataatttcgcggagctctatggggtagcaatagtgaactcaagctgcgaagggaagagagggaccagtcgcgagcacatagcatggttctga

SEQ ID NO: 58093 - DNA, 477 bp, Glycine max
  Peptide Sequence Number=SeqID_149778
atgacattgctacttagcaacattctgcccagcgaccgcaatgccaatctccccctgcaaaagtatcagttgggatcgcacccacaaagacacccagtggacctgaagaagtccaacagggcactggggtttccagctctggttacgggcctctatcggccctacagggcgcccgttccccccagcaagttcatgtcgtcgtgcataggtaaggagtgcctgtcgcctccagcaaggtcatcaggtccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggtaagcaaagtactaggtcagtga

SEQ ID NO: 58094 - DNA, 429 bp, Glycine max
  Peptide Sequence Number=SeqID_149779
ggctacacgccctcaccttgggtactagttaccctcaccgttgagaggactacacgtcctcgccttgagaggactacacgtcctcgccttgagaggactacacgtcctcaccatcagagggctgcacgccctcacctccagaggactacatgtcctcgccttgagagggctacacgccctcaccttggttaccctcaccgtcagaggactacacgtcctcgccttgagaggactacacgtcctcaccatcagagggctgcacactcttacctccagaggactacatttaccctcaccgttgagaggactacacgtcctcgccttgagaggactacacgtcctcaccatcagagggctgcacgccctcacctccagaggactacatgtcctcgccttgagagggctacacgtcctcaccttgggtactag

SEQ ID NO: 58095 - DNA, 249 bp, Glycine max
  Peptide Sequence Number=SeqID_149780
atgaggaagcctaaaggctcgcttagcacgaaagctcgcgctaagcgcgaggaagcaaaggaaaaagacaccgagataccaatccctacacaccaccctggagactcaaagctctctaatgaatacatcctaagcctcatcagattcagttttgataaagaaaatcattcaaataagggactttattatctccaaagagctaagtacggaagaggccaaaaagaggattcaatcttggagcaccaatga

SEQ ID NO: 58096 - DNA, 489 bp, Glycine max
  Peptide Sequence Number=SeqID_149781
atggagaggagtatgattgatgctgccagtggtggagctcttggtgatatgacccctgctgaggctaggaatttgattgagaagatggcttccaactcccaacaattcagtgcaataaatgatgctattgtccttagaggagtccatgaggtggccacagattcatcttcatctactgaaaataaaaagcttgagggaaaacttgatgccttggtaaacctagtaactcagcttgccatgaatcagaaatttgcacctgttgcaagagtctgtggtctatgttcttctgcagatgaccatacagatctttgtccttctttgcagcagtctggattcaatgagcaacctgaagcttatgctgcaaacatttataatagacctcctcagcaacaaaaccaacaacagcagaataattatgatctttcaagcaacaactacaatctaggttgcaggaatcatccaaatctgagatggacaagtcctccataa

SEQ ID NO: 58097 - DNA, 144 bp, Glycine max
  Peptide Sequence Number=SeqID_149782
atggagcttgcatcatgtggtatcaagagcatcttcatcaagggaatgatgcaatcctaccccgcaagggcattggatagaaaactccaagtagattgggccagagatgcaagagaaggtcctagggttcttatgagccttagg

SEQ ID NO: 58098 - DNA, 773 bp, Glycine max
  Peptide Sequence Number=SeqID_149783
gcatgggaaaacccattaaggaaagataaagaacttaggggcattcgtaatggcatcatcggtggttatcatgaatggttgaaagttcgtacacgagggttagattggctctccaagttgaaaattatcaacgaggagaacttcgaagcttcggaagaggatgaagaagtccgagctctaaaaaccgaactaggaaaagcaagacttgccaaagaaaaattcaagttagttgctacagacgtccagaaagagtgtgccgagttacgagaagaaaatgcagctaccgcaagagcccttgaacaagaaaccaagagggctcgcaaggaagatcatggccgagacaaattccgtggagctttgtggggtagcaacaatgagctcaaacttcgaagggaagagagagaccaatcacaagcacatagcatggtcttaatagaggagttagctgcttgctcaaggtccaagagaagcttgtctcaacgtttatgcgagacagagaccaacatgttagccatcgtcagcaagtaccaagaagaattaaatctagtcgaggcccacgagcacatagtggcggacaagtatgcccaagtgtacacgaaaaaggaggctagaggaagggtgatcgactcgttacatctagaggcaacaatgtggatggaccgatttgctcttactttgaatgggagtcaagaacttccgattgctagccaaggccaaagcaatggcggacacctactccgcccccgaggagatccacggacttctcagctatt

SEQ ID NO: 58099 - DNA, 594 bp, Glycine max
  Peptide Sequence Number=SeqID_149784
atgtctcatcatgagtcagaactgccaagaaatataagcaatttacatgatgatgatgatgaagatgatgatgatgattatcttgcatctaactcatacgttgaagagtctttcgatgaagatgatagtgatgatggaatatctgatacagatgatgaagtcactgacatcgttgaaccagtttcaattgttcacccaaccgaaggtgtaccagaaattcaaaatccattttggaatgatgctatgcattataataatatcaattggagtcatccggatgaggaggacatttgtggtctggacatgccaacgacttttaatgttggacaagaattatatgttggcatggattttgacagtaaagatgcggtaaaaaatgcactgaaacaatatgtgatgaaggtgcataaaagttttaaggttgttgaaacgaaatcacacaaatatatcgtttgttgccccaacaacactgtagagtctccttgccctttttatatgagggcaattttatccaaaaaaactgatgcatggaaagtgacacaatgggggtggaccgcacacatgtctaaatatgactatgacacaagaccatga

SEQ ID NO: 58100 - DNA, 290 bp, Glycine max
  Peptide Sequence Number=SeqID_149785
atggctgagaagccaaggagagtgacccttgaagattattcaagttcaagtgtgccgcaattcttttcaagtattgtgcagccggaggttcaagaacagaccatcacttaccctccatcattaatccaattgatccagaaaaatttgtttcacggtttgcctaatgaagacctatatgcgcacctagccacctatattgtgatttgtaacactattagactggttggtgtgcctgaggatgctatccgtttgagcttgttttcattctcgttgtctagagaagctaaaag

SEQ ID NO: 58101 - DNA, 243 bp, Glycine max
  Peptide Sequence Number=SeqID_149786
atgtcgcaacctacccttcggtgggagggcgacgcggggctcgcgggtgcatcttccaagggaggaaaatgcgcggagtcgccactaacgtttattcgaggaaaacatcggaaaaactggaaaatgtttggtctacgaactttaagtgtgaaaggttcgggagttgtatttatgcatggggaagggtgtttcctttgctcttacgtattcctcaattgtgataaggaaatcaaacctacgtag

SEQ ID NO: 58102 - DNA, 460 bp, Glycine max
  misc_feature (28)..(28): n is a, c, g, or t
  Peptide Sequence Number=SeqID_149787
gaaggccagaggggagagatctgaggcnccttccacttcagcatcatcagaggcaccaacaccttcttcttctacacttcctccttctttctccatagagatcccaatgattccttctgcacccacacagataccactaccagctcctctttctacagggcagtccatcatcatgaagagccttcagggcttgtgcttgccctccattatgagcatggaggagtttgacgcacaggtggcctggccaggagaccagccttcttcctctggagggggtggggcctccacagcccaggagcctgtggctaaggagccaccagcaccaccaccagcaccatcaccaatagcaacagaagaggagacaactccagctcagaccccacagccatctccaccatctgcacctgctcctgaggagactcatccatcagcactggatcttaatgaagaccagccataa

SEQ ID NO: 58103 - DNA, 657 bp, Glycine max
  Peptide Sequence Number=SeqID_149788
atggcagaatcatcaaagaagcacaagggctcatcttcctccaccaccactacaggccaccgccaccgcggttcttccgatgactctccgacaccacccaatccatctctttcttcaccatgttctctcaatctgttttccactgatatccaacgtgagaggtattactcatccttttccaattgtgtcattcttgatcctaaataccttgactctgaattctttgagggagaaaactttgattgctatcaattgtttcaaaattatgaactagtagatttcatgactctgaaattgccttattaccctaaattggttcgagtcttttataacaacttggaaattcatgatggattcatattttatgaagtacacaaaatacctgttgttgttgatcgatccttattttactccctaaccaaactcagcaatcaaggtgtgccttttgaaggaaccttagttgattattggaaacccatttattctagtcatgatgctcgtaaaatggtttgtgttgaaaatgctgatatgaatggccgcttacttgctggttcctttacctttgaatgtcgtatcatgcattatattctttgtcgtgtgttgcttcctcgttctactaaccttgctcaagcctctgaggaagatttaattttgtag

SEQ ID NO: 58104 - DNA, 419 bp, Glycine max
  Peptide Sequence Number=SeqID_149789
aggctaccattactcttcaagatgtgtcaattttattaggtcttcgtactgacggggcaccactaattggttcaacaaatcttgattgggccgacttatgtgaagaattattaggagtcagaccacaggaaggcgaacttgaaggaggtgtcttctttgttaacaaaagtagtagcagagtttctttaagagagatgtgcagtgccaccgattacaaagttaaatcaatcggaggtatgtgcatcttaatccaaatgtgggcatgggaacgatgcacgactttaactccaaagaggacgcctcccgtcatagaaaataaaccactcggacacatgtggatgcgacgtggaaatcaacatattggtaatgatgatcttagacttttccgtcgcaaattggatctgatgaaacgacatgag

SEQ ID NO: 58105 - DNA, 391 bp, Glycine max
  Peptide Sequence Number=SeqID_149790
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggcaaggattgacattctcaccctgggtcaagatttggggatcctctag

SEQ ID NO: 58106 - DNA, 492 bp, Glycine max
  Peptide Sequence Number=SeqID_149791
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtggagcagaagatcatgttgaagttgcacaatattaaaattgtggatgatatgtttggggggagtgatattgccatattaatgaggaaaactgtttcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 58107 - DNA, 525 bp, Glycine max
  Peptide Sequence Number=SeqID_149792
atggcatcatcggagttgaaagttatcgatgaggaggacttcgaagctccgaaggaagatgaagaagtccgagctctaaaattagagttagggaaggcaagactcgccaaggagaagttcaagtcagctgctacacatatccggaaggagtgcaccgagttacaagaggaaaacgcggccactgcaaaagcccttgaacaagaaaccaaaagggcccgcaaggaggaacatggccgagagaaattccgaggagcattgtggggtagcaacaatgagctcaagctccgaagagaggagagagatcggtcacgggtgcatggcatgatcttaaaagaagagttagttgcctgcgcgaggtccaaaagaagtttggctcaacacttggaagccacggagcaaagcatgctagctatcatagggcaatacaaggaagaattgaaccagtctatggcccatgaagaaaaagctagtggaggattttgcacaagtgtacgccgaaaaagaagcaagagggagggtgattga

SEQ ID NO: 58108 - DNA, 303 bp, Glycine max
  Peptide Sequence Number=SeqID_149793
atgggtgaccaagaggaagtacaggaacagatgaaagccgacatgtcggctttgaaagagcaaatggcttccatgatggatgccatgctaggaatgagacaactaatggagaataacgcggccaccgccgccgctgttagttcggctgccgaagcagacccaactctcccagctaccgcgcaccaccctatcccaaacgtggtgagacgagaaagaagcacattggggcacatcagcaacccccatccggggtacgaccgagtagcttacccctatggattaccacctaattacacaccacca

SEQ ID NO: 58109 - DNA, 315 bp, Glycine max
  Peptide Sequence Number=SeqID_149794
atggcttgcacccaattccagatttacacacgattctcctcaaatttcagccagcatcaattagaccttgcaccctacacttcagagccctacaatgctcaatgggacaccccgaggcttctccgtgacaagcacacgttgcgttcgagtcgtattctcggagaaatgaaggttgatgaaccttggttggggttatggctaccattgaattatcaagttttctcgttgcaaaattcatttcttggttggtgctcttggtttgtgctaaaggtgatgttcgtcattggaagtgcgatagacaggctttgtggttga

SEQ ID NO: 58110 - DNA, 381 bp, Glycine max
  Peptide Sequence Number=SeqID_149795
atgctcgaaagttttaaacaacaagaacaaatgtcagttctggaattgtacatagaaaaggatgtggcgggtggttctatatttcattctgcaaatttgcttacatcatgtggaaataatttatcttataatgagacacaaccgccaacaaatatgagcaatttacatgttgacgaagatgatgatgattatcttgtgtctaactcatacgttgaagagtctttagacgaagatgacagtgttgacgatatatctgatacagacgatgaagtcaccgacataattcaaccaagtcatcctgatgaggaggacatttgcggcttaacgatcccgtcgaccattaatgttgggcaaagaattatatgttggcatggaatttga

SEQ ID NO: 58111 - DNA, 303 bp, Glycine max
  Peptide Sequence Number=SeqID_149796
atgggtgttcgctccccctcactcagcgaaattccctccaaggggaaagcacccatgacccaagagtccgcaggcgcaaccaccccctcaaaagaagtggatcccccagcagtaaagggagctgaaaagaaggaaggtcaccaaggaaaggcggtgaccttggaagaggctcatgagttccttcgtctcatccaacaaacctcattgatgcaatcctaccccgcaagggcattggatagaagactccaagtagattgggccagagatccaagggaaggccctagggttctcatgagccttagg

SEQ ID NO: 58112 - DNA, 512 bp, Glycine max
  Peptide Sequence Number=SeqID_149797
atgccttcacttaaaaagaggttctatcaagtaaaggtcaagagcctagggatcaccagtctaaaagagttagggcagttgatgggtcagctccagcggcaagcttttcgcaaagcttacggtaaaatctgggacctagccatggtagaagtctccacagaggccattgcctccctcgcccagtattatgatcagccgttgaggaagcatgtcgaaaatggggtggttggaataccgagaaaatatttggaggaaaaagcaagaatcttggtaggtaaaggtgagtgggccccgttcatagattttctcacactgttgattttcggaggagccctctttccgaatgtggatgggttggtggacctggcagcgattgacgcttttctcgcctatcataaccataaggaaagctcggttgtcgctatgctagccgacctatatgacaccttcgaccgaagatgtgaaaagagcaatacaaggattgtttgctgtactccagctctttatgtatg

SEQ ID NO: 58113 - DNA, 312 bp, Glycine max
  Peptide Sequence Number=SeqID_149798
atggcattcttaggagagacttcgtcccagacgatcgtgaactcgagaacaacaaatgcaattttaaacttacttgaacgccccaacatccctacacatgatgcggttctgtattacaatggaaggtggaacatgccacgccaaaataactttgtgggttacgcgttcaccggaataaatccaaaaaaatttgatattccaaaaggatgtagcatagatcaactgaatgatttaatcaagcaagtagcacctaaagggaatccttctcatgggattcacgaatcccaagttataaggcggttgttttattga

SEQ ID NO: 58114 - DNA, 232 bp, Glycine max
  Peptide Sequence Number=SeqID_149799
atgacgttgctacttagcaacattctgcccagcgaccgcagtgccgatctccccctgcggaagtatcagttgacgtccagcggacccggagaagtccaacagggccctggggttcccagctctagttacgggcctctggaccgtgcccacaagatactcggtggacccagaggagcccaacagggccctggggtttccggctctggttacgggcctctattagtgctacagg

SEQ ID NO: 58115 - DNA, 447 bp, Glycine max
  Peptide Sequence Number=SeqID_149800
atggagacaattgcgatgacagcgcaattaatccatgaccgagtggagatggagtgcctagagggagtttgggagaccctcgaaggcaatgcgaggtgccgatttcgtggcacgattcaactcacggctacttcattggtacatccagaggaacctgcacgcacgcttcagcgcactgtggagtggatattacctacacctactccatatcgactagtggagcctgtccaagtgatagaggtgccgtcatctaaggaagaccttgaggaggacccagaggagttacctcctgagcctgctgtggatgccattgactttccagagggtgatgaggacccacttcctgatgtggattctctagaggacgtcatgtcagcatctgaggcagactctacggaggagagcggccctggagggatagtgactagtggagactctttatcatag

SEQ ID NO: 58116 - DNA, 800 bp, Glycine max
  Peptide Sequence Number=SeqID_149801
gactacacgtcctcaccatcagagggctgcacgcccttacctccagaggactacatgtcctcgcattgagagggctacacgccctcaccttgggattacacatcctcaccatcagagggctgcacgcccttacctccagaggactacatgtcctcgccttgagagggctacacgccctcaccttgggtactagttaccctcaccttcagagggctgcaagccctcaccttcagaggactacatgtcctcgccttgagagggctacacgccctcaccttggagggctgcaagccctcaccttcagaggactacatgtcctcgccttgagagggctacacgccctcaccttgggtactagttaccctcaccgtcagagggctacacgccctcaccttgaaaggactacacgtcctcgccagcagagggctgcacgccctcacctccagaggactacacctcctcgccttgagaggactacatgtcctcaccaccagagggctgcacgccctcacctccagaggactataagtcctcgccttgagagggctacacgccctcaccttggaggactacacgtcctcaccatcagagggctgcacgccctcacctctagaggactacatgtcctcgccttgagagggctacacgccctcaccttggggctacacgccctcaccatcagagggctgcacgccctcacctccagaggactacacgtcctcgccttgagagggctactcgcccttgccttgggtactagttaccctcaccttcagaggactacatgtcctcacctttag

SEQ ID NO: 58117 - DNA, 450 bp, Glycine max
  Peptide Sequence Number=SeqID_149802
actcatcttctccttgaagtggcgtctcctctccctcttccttctccattccactgccattcatcttccaagaagccaagggatccattgatgaagaagatcctaggcctacaagctccaatggagcttgcatcacatagtatggatttcccaaaaacccagctagtgacagtgctctgggtcaaacacccacatcactacatggttcctctcggttgtgggttttcaatggagaacaatgatggtttgtggtggctaatggtggctcacactccaacggttaacgaaggctgggcagcgcttttaccgaggcagctgcataccaaatttcgagaagatccaacggttaacgaaggctgggcagtgtatttaccgaggcaacttcatgtagctttctctagaagcttcattaagaggcttcctccagaagcttcctcgtggcttctttga

SEQ ID NO: 58118 - DNA, 330 bp, Glycine max
  Peptide Sequence Number=SeqID_149803
atgcaaattgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggggagaaacgttaaggcgttggaccattaacgatctcttgtttttgaaaggagagaagcgttatggcattggaccattaatgatctcttgggggtggtcgacaaaaagcggggcttttgctcctacgtatcctcaatga

SEQ ID NO: 58119 - DNA, 84 bp, Glycine max
  Peptide Sequence Number=SeqID_149804
atggtgcctttcattgccccagtgcaaggctttgaggcacaatcgttgtctttcgccatgaccttgcagcaaggaacctattgg

SEQ ID NO: 58120 - DNA, 230 bp, Glycine max
  Peptide Sequence Number=SeqID_149805
tggagctcgtccaagtgatcgaggtagcatcatccgaggaagaccctgaggaggatcttgaagagctaccccctgagcctgctgtgaatgctcttgactttctagagggcgatgaggacccacttcctgaggtggattctcccgaggaagtcatgtcggcatctgaggcagattctacagaggatagtggcccgggggagatggcaatcagcggaggctcttcatcatag

SEQ ID NO: 58121 - DNA, 306 bp, Glycine max
  Peptide Sequence Number=SeqID_149806
atgagattacactataaggaaagacgaacacctgcaatcactgatgaaagtaacccaactactgttgcgctatgtgagccgtgtgtgcgatccaaccaactcagcgttatgttcatcaagaccaaaatcttggctaggatacacaggtctgtcgaccaacatgaaaaggttcgagactttcttaaggctattgatgaccaattcatctcttcagataaggctttagcaaacaccctgatcatgaagttctcctttctctggctcaccaatgtgaaaggtgtgcgtgagaacgtaatgcaaatgtga

SEQ ID NO: 58122 - DNA, 540 bp, Glycine max
  Peptide Sequence Number=SeqID_149807
atgacgaaagacaacgattgtacctcaaagccttacactggggcaatgaggggcatcgtgcatgagcctcaagtgaacataagggcagatcaaaagatgaccgaccctctcgatgagtcgatctcttgctttctcataaggttggacccttgggtactagtacctaccacgttcagaggactgtacgtcctcaccttaagagggctacacgtcctcgcctttagaggactacacgtcctcaccttcagagggctgcacgccctcaccttcagcaggctacacaccctcacctttagagggtcatgtaccttcaccttcaaaggactagacgtcctctcctccagaggactacatgtcctcaccttcagaggactacgtgtcctcgcctttaaaggactacacatcctcacctttagagggctgcatgccctcgccttcagagggcttcacgccctcgccttcagagggcttcacgccctcgcctttagagggctacgcgtcctcactttcagtgggctccatatccacaccttaagataa

SEQ ID NO: 58123 - DNA, 465 bp, Glycine max
  Peptide Sequence Number=SeqID_149808
ggaaaaggaaaagtggtggaggaacaagatggcgaagcaccccacgcttcgaataaagatattccggcaaagggccccccggagaaaaaggatggtaaaaaggaggtgtcgctagaggaagccagcgagttcctccggataattcagcagagcgaattcaaggttatcgaacaggtcaacaaaaccccggccaggggtctcgctgttggagttacttatgagctccgagcctcatcgggctctgctagtaaaagttctgaacgaggcccatgtggcccaagatatctcggtagaaggtttcggagggctgtcaagtgtatggaccatatcgtagccaaggtgctcatcgataatggttccagtttaaacgtgatgcctaagagcactttggagaaattaccattcaatgcttcccacttaaagccgagttcaatggtggttcgtgccttcgacggcactcgctga

SEQ ID NO: 58124 - DNA, 195 bp, Glycine max
  Peptide Sequence Number=SeqID_149809
atggcctttgtggacaactgggcggtgggtaaagagaaggtttgttattggctgagtaatgacattgttgggatgactaaatttgcctcttttcagacccacatcgatcctttcactgtcaaagaccaaatccgcaaagctctgaaggtgccacttgagctgccaggtctctccacctttgggcgtattctttga

SEQ ID NO: 58125 - DNA, 640 bp, Glycine max
  Peptide Sequence Number=SeqID_149810
tggtacctggagatatgtcgcgggggtcaggagaccttggggacgtcaggtggggtgctattgcccaaaaccaagcttgaccaatcccgacccaacccgggcatagtcgggaactgggagttgatggaagcctctggtaatcgattaccagcctgtgtaatcgattacacagaggaatgggtcactgtgcctagagggagtttgggaaccctcgaaggcaacacgaggtgccgatttcggggcactattcgatttacggctacttcattggtgcatccagatgaaccggcgtgtatgcttcagcgcactgtgaagtggatactacccacgcctacaccatatcgtctagtggagccagtccaagtgatcgaggtaacgtcatccgaggaagaccctgaggaggatcccgaggagctacctcctgagcctgttgtggatgctcttgactttctagagggtgatgaggacccacttcctgagatggattctcccgaggaagtcatgtcggcatctgaggcagactctacggaggatagtggcccgagagagatggcgaccaacctgatgtataggaatttgatgattgtatacatgtggctgaagccaccaccatggacacctttgctctggatgacactag

SEQ ID NO: 58126 - DNA, 350 bp, Glycine max
  Peptide Sequence Number=SeqID_149811
cacaggtgtctaagtcagaaaaatcggagtccggattctctaatgaagagtatcaggagtatttgaggctcaagtccgagaagtccagcaatcaagcatcatcctcatcggcaccatgtttttcaacaacttgtgtttctcaatccattggaagtcctagtccttggatactcgattcaggtgcctttgatcatatctctggtaacaagtcctccttctcatccatttcttttccaaaagttcctcaccttgttactgtagctaatggttccaaagttgcatctcaaggaagtggtcaagtttcattatctccttcattgaaattaaattctgttttatttgttccttag

SEQ ID NO: 58127 - DNA, 108 bp, Glycine max
  Peptide Sequence Number=SeqID_149812
aatcaagaatcaagattcaaggatcaagctttcaagactcaagattcaagaatcaagagacgacataatcaagataagtatgaaaaagttttttcaaaaactgagtag

SEQ ID NO: 58128 - DNA, 1116 bp, Glycine max
  Peptide Sequence Number=SeqID_149813
atggaggagctgaaagcgcagattgagagctacttcaagggtgatgggcacgtgctcccgtcgatcatggaggcgactctgaagtggaagttgtcggggaagctcgagggcaccaatgacaagctcatggaggagctccgcatgtgccccctggacgatgtcgacgattgggacttcgaggacattaactataatgatgaggagatcaacgatttgtacaacgctgacagagacattccaggcatcgactctgatgaaaaccccaactttgtcaatccccaacttctctttcctcttctttatagctctcagcagatacctatcccaccactatgttcttcgtcaaaaaggagtagagctgtagagttccataatttgtatgaaaagagaaggaggagtaggattaaggagaaaatgaaagccttgcagaatttaattccaaattccaacaagacaaacaaagctttaatgctagatgaggccatagaatatttaaagcaactccaacttcaagagcaaaggaatgtgaaattcttactcagaacgaatgacgtcgtggcactaaccatggaggaggacccatgcaaaggatcacaaaggaagtgttctttggcaaagggtatgaacaaggatgaccttgctcgaatgcttattgccaagctagacttttttttgttacatatgttagttactgtaacattaaaaaatacaacactatcattacacagtacacaaattcaccaaaacaatcaaagtgtgttgctaggtgcacccagcatttttgctggtgcatccagcaattcattatctctccctccatccctccctcccgtgttggccttcttcttcctcctcacccctcaccattttttcttcttcttcctgaccccttacctcacctcactcgcgttcttcttcctttcactctaccctggtctcaaaaaagcttcacccaccatcgtcatcctccacgccgtgtttgttccccccgtgagtgtcgtcttcttcctccgtgtcgggagtccgtgttctgcaaccgcgccgccattgatgttgagtagcccaggaaaattgagggtggtgttctccctccgcgcgtcggcattgttgaggtaa

SEQ ID NO: 58129 - DNA, 441 bp, Glycine max
  Peptide Sequence Number=SeqID_149814
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagggcgcactaagcgcaattccaatcagagagggaattgcgcggagcgagccattgtgtag

SEQ ID NO: 58130 - DNA, 332 bp, Glycine max
  Peptide Sequence Number=SeqID_149815
atggttaggaccagaggattaggttgtgccttaggtcacgttactggcagaggtgtgggtcgaggagatcgtgatgattccgatgatgctccgcagcgtcgaaggcctactgcatccgcacggaggcagcgagtccctgtgactgcggtgcacaatgagccagtggtccatgcgccagatgtagaggctgacatatttccagatgacccgatggcaccaactgatgtagaggacactggggcagacattcctgcagacacaggcgcgcaggctgctgaggatgagcatgagggattttcgggtggtccgagcgacccatccgtgctgacccg

SEQ ID NO: 58131 - DNA, 243 bp, Glycine max
  Peptide Sequence Number=SeqID_149816
atgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaaggtgatcattttaaggcgttggaccttaaaaatgatccattttacttagtgggaaattga

SEQ ID NO: 58132 - DNA, 102 bp, Glycine max
  Peptide Sequence Number=SeqID_149817
atggaaaaaacccgttatcatgcctacttgaataacagtggatctgctattcaagagacacagggttaccactgttcaaggcttgtcagaaccatttgcact

SEQ ID NO: 58133 - DNA, 489 bp, Glycine max
  Peptide Sequence Number=SeqID_149818
atgagtcatcattcatctagtgttaatggcaagggtactagtcataaggaccctctatctagaatcttagatgagttgagttccctcaagttatggaaagaaaaactaaaaagaaaagaaaaaggaaaagagagggtaaaaataaatcaagatgagagggaacaaataagggaagaagaaagaaggaaaatactaaaagaattaagaaaagaaaaatatgtctcctatagtaatcataactcttgcaagagtctaagtgaagaacttcgtgattattatgaaggaaggcataggtcacatcttagacctcacccccatatgagagaaaaggaaagaaagcctcaagaggctaacattaacctcccatacttccatgggaaggacaatgtagaggctaacttagattgggaaataagggttgagcaacaacttaaaaggaattctacttcaaaatcttatggctctcactcttatccaaagaaagactaa

SEQ ID NO: 58134 - DNA, 477 bp, Glycine max
  Peptide Sequence Number=SeqID_149819
atggcgcctaccaggcaccctctggacccggataagtccaacagggccctgggatttcccgccttgatcataggactctgccagtcgttcggagtccctgtcgcacctagcaaggtgattcggccgcccatcacccgagcttttattgagaagtattgcacgcagagacaggtccagggggatgctccgcaggccgcagacgcgccgccacctcatcaggccggtccagccggattgtttgatacggaagtagtatttgcggcatttgatgagtcagcactgcagagtcagggctttacttcttttccgtgccctactccggaccagttcagggcagaggtcgcatggcctggagattggcctgaggcccgggcaggagaggcaccggcagaggctcccgacgaggcagatgaggcccgcgaggacgaggagatgaccgatttacttgatttcttaggaggaagcggggccacatga

SEQ ID NO: 58135 - DNA, 837 bp, Glycine max
  Peptide Sequence Number=SeqID_149820
atgatgcggcgactggtaattatcggcaacggtatggcggcaacccggctggcagagaagctggcggcgcgcgcgcaggggcgtttcatcatcacgcttatcggcgatgaaccgcagccggcctacaaccgcattcagctctcgccggtactcggcggggaaaaaacggcggcgcaaatccaactgctgccgacggagtggtacgcccagcatggtgtccgcgtgcggcttggcgaggcggtcagcgaagtggatgtcgcggggcggaggctgcgcgtcggcggcgactggctggaatgggatgaactggtgttcgccaccgggtcgcagccgtttatcccgtcgctgccgggtattgagcgcccgcaggtattcgcctttcgcaccctggcggatgttaaagacatcctggcaatccccggcccggcggtggtaatcggcggtggcgtattgggcgtggaggtcgcggcggcgctgcgccgtcacggtggggaagtgacgctactccatcgcggtagcggtttgatggagccgcttaccgatgcttttgccgcggaacagttaaaacaacagcttgaggcacgcggcatccgctgcgagctggagagccgaattgccgctattgacgagcagcatgtgcggctggaggacgggcgcgcttttgccgccagccgggtggtgttggccaccggagtgcggccggatatccgtctggcggcgcgcagcggcgtagcctgccagcgggggattatcgtcgaccgccggatggcgacctcgctgccggggatcagcgctatcggcgagtgttgtgagattgacggccaaatctgggggctg

SEQ ID NO: 58136 - DNA, 660 bp, Glycine max
  Peptide Sequence Number=SeqID_149821
atgaatgcggattgtaaaacggcgtttggcgcgattgaggaatcgctgctgtggtcggcggagcagcgggcggcctcgttggcggcgactctggcctgtcgtccggataacggttcggtgtggattttcggctacggttcgttgatgtggaacccggcgctggaatacagcgaatcctgcaccggtacgctgccgggttggcatcgcgcgttttgcctgcgcctgaccgccggtcgcggcagcgcacatcagccgggcaggatgttggcgttgaaggaaggcgggcgtaccaccggcgtggcctatcgtctgccggatgagacgctggagcaagagctgacgcttctgtggaagcgggaaatgatcaccggctgctatttgccaacctggtgccgtcttgagttggacgatgggcgtacggtgaatgcgctggtgtttattatggatccgcgccacccactgtatgaatctgataccagcgcacaaaccatcgcgccgctgatagcccgcgccagcgggccgctcggcaccaatgcccagtatctcttttcgttggatcaggaattacgcaagcttggcatgcgcgacgccagtcttgacgatctgattatccaggtgcgacatctggtcggcgaggcgagccaacccgggctcgcataa

SEQ ID NO: 58137 - DNA, 363 bp, Glycine max
  Peptide Sequence Number=SeqID_149822
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaggatgccctcttcgggggagaaaaccgtattcttttctccggctttcttccttccttgagcaaggttgcagctgtgattggagattcggcaaaagagttggatcgcatgaagcaaattcggaacggcgtagtgggcctgcctcggaaatacttggaagacaaggcaagggatatggcaagccaagagaagtgggggccatttgcggat

SEQ ID NO: 58138 - DNA, 399 bp, Glycine max
  Peptide Sequence Number=SeqID_149823
atgactagaggaaatccatctgacttacaatcctttgatcctgagatagatatgacatttcatagattagttagacatcatttagtaccttttgagcatcctgagcattctggtattggtgattttgagcattataattttgaacattctgattttgcacattctgagaatatggcacaacctccaccccgtgagaggactctaagggaaatggctgcacttgatttcacctacaaaagcttgtgcatccaataccctgatgaggatgtcccacatgttcttaaaattggactgatccatttgcttccaaagtttcatggccttgcagagggagtggcaaaggactggctatattacctcgctccaaggtccatcaggagctgggatgacctcaagaga

SEQ ID NO: 58139 - DNA, 1116 bp, Glycine max
  Peptide Sequence Number=SeqID_149824
cagcgatcgacgcttttctcgcctatcatgaccacaaggaaagcccggttgtcgttatgctagccgacctatatgacacctttgaccgaagatgtgagaagagcagtacgaggattgtttgctgtactccggctctttatgtatggttggtttcacaccttttttgccaagaagtgaggcatgcttgcccgctagaaagccaccgttcatgcacagagaaaggaggggcgaattgggaccgactcttagtaaacaaagaaggagcgtctttcaactggttccctcgatggaaagaaggaagaatcagggttcttatttcgtgcggaggatttccaaattttcccttgatggggacaaggggttgcatcagttacaatcccgttcttgctataaggcaacttggctaccctatgagaggggcaccactagaggaagagctcgcgcccgtcatttcacgaggtttcaataagaccagcgtggagacacttcagaaggtccgcaaggcatgggaggtggtgcaaaagaaggacaaagaactcaggggcagcagcaatgggcccatcggtggctaccataagtggttgaaagcccacgtgcaaggtttggattggctcccgagtttgagaaccgctaaaagggaggaagttgaggcagcggctcgtagggaagagcacggccagaacaagttcctaggggctctgtggggtagcaacaacgagcttaagctccggagagaggaaagggaccaatcacaagtagacagtttgatcttgaaagatgagttgaaggtttgctcaaggtccaaaagaaacctgtctcagcggttatgcgagacagagaccaacatgttatccatcgtcagcaagtaccaagaagaattaaatctagccacggcccacgagcacaaagtggtggatgagtatgcccgagtgtatgaggaaaaggaggctaggggaagggtgatcgactcgttacatcaagaggcaacaacgtggatggaccaatttgctcttactttgaacgggagtcgagaacttccccgattgctagccaaggccaaagcaatggcggacacctactccgcccccgaggagatccacggacttctcagctatt

SEQ ID NO: 58140 - DNA, 330 bp, Glycine max
  Peptide Sequence Number=SeqID_149825
atgtcgtcttctgcacttttgtcatccagagacggtgagttggatgacatgcggagatactcgagtggttatccgtgcaaaccatgtctgttaatcctgacccgtgaagccaggtggcaggcggagttatccgagtggttatccgtactgagacgatatctgttaatcctgacccgtgaagtcaggtggagaagatacccaagtgattatccgaagacactcatttgctatccgtcagactcagagtccggtagcatgcagagtctaacatcgtcatctgcaccttttgacaacgagaggcaagcgagcccgttggcacgtagagactaa

SEQ ID NO: 58141 - DNA, 306 bp, Glycine max
  Peptide Sequence Number=SeqID_149826
ttcaagatcaagattaatttcaagtttcatgagaagaaatcaagaagattcaagaatcaagagaagtttgatttcaagattcaagagaagatgaattcaagattcaagagaagaaaccaagaagacttcacaatggaagcgagactcacgggtgcgctttccaaaggaggaaagatgcgcggagtcgccaccaacatttatttgtgggaaacgtcggaaaaaccgaaggtcaacaaaagcggggctcttgctcctacgtaccctccatcgaagaggaaatcagacctacgtagttctttcttaagg

SEQ ID NO: 58142 - DNA, 459 bp, Glycine max
  misc_feature (331)..(331): n is a, c, g, or t
  Peptide Sequence Number=SeqID_149827
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcagnctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 58143 - DNA, 396 bp, Glycine max
  Peptide Sequence Number=SeqID_149828
atgtgcaagtgccgttcacataggaacctttcccctcttcggccttcaaagttctcatttgaatattttgctactaccaccaagatctgcaccgacgaccgctccgcccgggctcgcgccctgggttttgcagcgaccgccgcgccctcctactcatcggggcttggtccttgccccgacggccggcggatttcgactttccatgaccaccgtcctgcttgtcttaatcgaccaacaccctttgtggggtctaaggttagcgcgcagttgggcaccgtaacccagctttccggttcatcccgcatcgccagttctgcttaccaaaaatggcccacttggagctctcgattccatggcgcggctcaacagagcagccgcaccgtcctacctatttaa

SEQ ID NO: 58144 - DNA, 1257 bp, Glycine max
  Peptide Sequence Number=SeqID_149829
acgcgtgcaccaagggcaccagaacctgctccaggagacctcattgacctggaagaagtcgaatctgatgaagaacccatggccaacaggttggcacctggcattgcggaaagacttcaaaacagaaagggaaaaaccccccttaagaggtctggacgaatcaagactatggcccagaagaagagtactccaatcactcctgccacatccagaagaagcaaggttgctatcccctccaagaaaaggaaagaaatttcctcatccaattctgatgatgatgtcgaactagatgtctcgacatctaagagggccaagaaatctggaagaaaggttcctggaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtgttagattctcccctgcagtgatcaacaaacatctgggcagacctactgatggagtgatagatattgatgtttctgagcatcaaattgccaaggaaatcactgccaacgagattggagctgcatactgggttcccaccaatcatacttccactgttgccacagaatcatttgctatcaaattacccattgccttccctactgtattgtgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 58145 - DNA, 256 bp, Glycine max
  Peptide Sequence Number=SeqID_149830
atgtttgtgggttatgtcggcaggtcggggggttcaaacacgcgacctctgcgggtcacaccgctcagccccgtgatattggttaccttggctgacaatgagctgatgtcggtggcttcttctttcctttcactcggaggtgtatacctccacgggaccgcgtggctattttggtatgggacaggaacaggtttagctgccggggggtatcggggcttttgtggagctgcgtccttggtgacatatatcaccaaag

SEQ ID NO: 58146 - DNA, 210 bp, Glycine max
  Peptide Sequence Number=SeqID_149831
atgggtgaagtagaggatgtgcaagagcagatgaaggccaacatggaggccatgaaagagcaaatggccacaatgatggaggccatgatgagcatgaagaagataatggaagccaatgcggttacgatcgtcgctaccagcactgttgctaaggtgaacccgatgcccccatctggcctcaaccaaatgaatcatccgaccttagatatg

SEQ ID NO: 58147 - DNA, 291 bp, Glycine max
  Peptide Sequence Number=SeqID_149832
atgacaaagctggaagagtttatttctcaattcatgcaagtttccatgtccaatcaaaatagatttgagtcaaccatcgagaatctagaagtccagataaatccaaaggatgagtgcaaggttgtgatgactagaagcaaaatggtgagcatgaatgaaagtgagaagaggataggtgaagaaaaacaacagctggtgtctgaaccagcaagtatcccagtggtggaacctttaaatgagactaaggaagaagagaagcaaaagattatcagtagaaggagataccaataa

SEQ ID NO: 58148 - DNA, 633 bp, Glycine max
  Peptide Sequence Number=SeqID_149833
atggtggggatccatggactccctggagtgggtaaaacaacacttgctgtcgcggtctataattccattgttgatcattttgaagcttcttgctttcttgaaaatgtgagagaaacttccaataaaaatgggttagtacatctccaaagcgtccttctttctaaaacagatggagaaattaagttagcaaattcgagagaaggaagtaccataatacagcgtaagctcaagcaaaagaaggttcttctgattctagatgatgttgatgaacataaacagttacaagcgattattggcaaccctgattggtttggtcgtggtagtagagtcatcatcaccactcgagacgaacatttgttagcgcttcacaaagttaaaataacatatgaggtgagagagttgaataagaaacatgctcttcaattacttactcagaaggcttttgagttggaaaaagaagttgatccaagttaccatgatattttgaatcgagcgataacttatgcttcaggcctcccattggctctagaagtaatgggttccaacttatttggaaaaagtatagaagaatgggaatctgctctagatggatatgaaagaattcctgataaaaagatctatgacatacttaaa

SEQ ID NO: 58149 - DNA, 669 bp, Glycine max
  Peptide Sequence Number=SeqID_149834
atgactaccttgacccagacatggatgacgttgctgctcagcaacatcctgcccagcgatcataatttcgacctccctctgccgaagtgtcagctggtgtatgccatcctgacacggatgagcattgatgtggctcagttgatcattgatgccatctatttatttgcaggtatgccacctaccaggcaccctctagacccagataagtctaacagggccctgggttttccagcattgatcacgggtctctgccagtcattcggggttcctgtcacacctagtaaggtgattcgaccgccgatcacccgggctttcatagagaagtattgcacgcccagacaggtgcagggtggcgacccgcaggcccctgacgcaccgccaccacctcctcaggctgacccagctgggtcatttgacacggagcgggcgcacgtgcagacccatgactgcctctaccagttcagccttagcctacatagccagggtttccttccttttccatgccctactccggatcagttcaaggcagaggtcgcatggcccggagattggcccgaggcccaggcaagggaggcgcccgcagaggctcccgacgatgcagatgaggcccgcatggatgaggaaatgaccgatttgctcaatttcttgggagggagcggagccacatga

SEQ ID NO: 58150 - DNA, 444 bp, Glycine max
  Peptide Sequence Number=SeqID_149835
atggggacaaatcaaaacggcaaaaggttttatcaagtcaaggttaaaagtctagatgtcactagcctcaaggaattaggacgattgatgggacctctccaaaggcaagccttccgcaaagtgtacgagaagattctagatttggccgcagcggaggtatttacggaagctgtcgtatccctcgcccaatactatgaccagccgttgaggtgtttcacgtttggggacttccaaatggtaccaactattgaagagtttgaggaaatattaggatgccctcttggggggagaaaaccgtatcttttctccggctttcttccttccttaagcaagattgcagttgtgattggagattcagcaaaagagttggatcgcatgaaacaaactcacaatggagtagtggccctgccacggaaatacttggaaggcaaggcaagggatatg

SEQ ID NO: 58151 - DNA, 381 bp, Glycine max
  Peptide Sequence Number=SeqID_149836
atgccaatctccccctgcagatgtatcggttgggatcgcgcccacaagacacccagtgggcccgaagaagtccaacagggccctggggtttccagctctggttacgggcctctgaatcgcacccacaaagacacccagtggacccggagaagtccaacagggccctggggtttccagctctggttacgggcctctgtagtcctacagggtgcccgttccccccggcaaggtcacgtcatcatagggatcgcgcccgcaagacacccaatggacccaaagaagtccaacagggtcttggagttgtcaagctctaattacaggtctctgccagttcatcggagtgcctgtcacctccagcaagggcatcaggccccttactaa

SEQ ID NO: 58152 - DNA, 609 bp, Glycine max
  Peptide Sequence Number=SeqID_149837
atgcaaagccctgttatgtcctctcccctcggcaaggatttcctcttcggtgaaggtgaggtagttgttggctgtgatgttattgacgagtcccccaaagccttctacggagatgtcttgggctacatgagcttcattcaagacttttaccaacaaagctcgatggggctcagagctcatgagcagttccaaaagagagactctagcaggggttttgttgagttgctcaatcactttgaactcgctttgttgaataatgcggaggaactcgccggcctcctcgagcgatacctctttcttgtcacaaccctcttttccctcggaaagacctttcatcggaacatcctcacccggagcggggatcactttgacatttggccctttcgtcatccttgccttccccttagcgtttgcaagttgcgtcggcaggtcagggggcacgaatacatggccgctgcgggttatgctgctcagccctatgatattggttactttggtcgacaacgagctgatgtcggtagcttcttccttcctatcgctcaaaggcgcgtacctccacggaactgcatggctgttcttgtatggaaacggaataggtctaactactga

SEQ ID NO: 58153 - DNA, 243 bp, Glycine max
  Peptide Sequence Number=SeqID_149838
atgactcctgaagacctagagcagctgacacaaaaaatcatggaccagctggaggagtcaatcacagaaaaaatgcaatcacagggactcgcattgcctcctgagtctgaggttggtccttcaactgctcgtgtcagcataaaagagagtcgtgttgattcctcagggaacgatctagacatgggtgactcagagaaatgcgggttgtacgtcgaagaaaatcctcccgcctggttgccctag

SEQ ID NO: 58154 - DNA, 261 bp, Glycine max
  Peptide Sequence Number=SeqID_149839
atgggtaaagcagaggaggtgcaagagaaggtgaaggccgacatggaggccatgaaagagaaaatggtcataatgatggaggccatgatgagcatggagaagataatggaagccaatgcgattgcagttgccgctaccagcgttgctgctaaggtgaacccgacgtccccatccggcatcaaccaaatgaatcatccaacctcagatatggtaggcaaagatttgggaagtacgcgcaacccccgttatgcgcaaatttaa

SEQ ID NO: 58155 - DNA, 498 bp, Glycine max
  Peptide Sequence Number=SeqID_149840
atgcagtctcagattcagtcccagatgcaatctcagggacttgcactgcctcccgagcctctggttggtccctccagtcctcgagtaagcacaaaagggagttgtgttgatccctcaggaaacgatcctgagacgggtgactctgataggtgcgacttgtacatagaagcagatcctgcccgcctggttgccttggggagagtttatgagggatccactgttgttcataacactcctttgttgcctgaccaagtaaaggtgagtgtggaggaggttacagatgcaaatgctccacttcctgtacccactaatgaggtttccttagtgaggcaaacacttcacacctttcttgcttggccgacacatctagtcaagtctttatcacagcaggtagttgtgtctccggcaaaaccacttccaaagcccgatccggaggtcgatgatccgctttatctgatgacattgaccatcccagagcttttcttgaggcattaccag

SEQ ID NO: 58156 - DNA, 183 bp, Glycine max
  Peptide Sequence Number=SeqID_149841
atgatggtggacatccagtgcggctactatgtgatgcattggatgtccaccatcattttaggaacttttagaaataattgggaagcgtattttaacgatcctagaccattggagcctatgagattaaaagcattgcggatccagtgggcacagttttatctccgagttagagatcaggcctag

SEQ ID NO: 58157 - DNA, 225 bp, Glycine max
  Peptide Sequence Number=SeqID_149842
atgaagaacggtggaaaatcttcacgaaatcgctcatggaaacgtctcggaagcgttacgaaagcgcctcggcatggattttcttcacggaaacattttttctcactaattttaagggaaaagagagaggtggttgccgcccagctcgcccaggcgagctgggttgcttccaccaaaaggcaccgcttactgttggaacatcctggaaggcccaagtgggtctga

SEQ ID NO: 58158 - DNA, 702 bp, Glycine max
  Peptide Sequence Number=SeqID_149843
atggacatgaacataggagctcttatttctggccagatgacttctatagcccagtctaacacttctagacttgggtttcctactttgatcaccgcactatgggctacaactgagcttccttccacatttgcagctcctactccaacatccacatcagcagctccttctgtcccagctcagacatattctcaacactttaaagccatgcttcagagcattcatcagggacagatcattttattacagagtttacaggtggtggcgactccaggatctaatcctttagttgagcagttcagggagatgatagcctggccccggactcaaccttctcttcatagggaagataaaggtcccacagcccaggtaccaaagcatatggaggatgaatcatctgaggccaccattctagagccatttgttctaggggaggaggaaggtgagacacaggtgagacaggtagttgctgtcactcccgagagatctcttgaggccacttcagagcctcctgcaccattagtggacctaccctcacctcagcgtacaacaaacccctccactcctattctagagatgccagaggaccaaaccacactagtcctgactatggacacttctcctccagctactccagtacttcatctgacaaatgaggaggatgttcagacacaagatactcaagaccagtcacaggaattctaa

SEQ ID NO: 58159 - DNA, 282 bp, Glycine max
  Peptide Sequence Number=SeqID_149844
atgtcaaatgaagaattgaagctgcaggatccaagatgtcggatacaatgtccaggacatcctgcccgaaaatactggaagttgctgtacaatgcacaaagctgcaggatccaagatgtcggatacaatgtccaggacatctggcccgaaaatactggacatataaatctattttcaggaagaatgatagatctcatccagcacaagctgttgcagcccagaatcacacactgctataaaaacatggaggctgcacgagttctgtaccaagtccgggattga

SEQ ID NO: 58160 - DNA, 573 bp, Glycine max
  Peptide Sequence Number=SeqID_149845
atgacaatgatagtagacacattaccagtattctactatggaaaaaggtgggctacacaccttcaaagctttgaggatttggtctttgccagtgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggttcatcaacctccatttatccgagaatacgactcgaacgcaacgtgtgcttgtcacggagaagccccggggcgttccattgagcatggtagggctctgaagcgtaaggtgcaaggtctaattgatacgggctggctgaaatttgaggagaattgcgtgtaa

SEQ ID NO: 58161 - DNA, 303 bp, Glycine max
  Peptide Sequence Number=SeqID_149846
atggaagccaatgcggttacaatttccgctaccagcactgttgctaaggtgaacccgacgtccccatccggcatcaaccaaaggaatcatccaacctcagatatggtaggcagagatttgggaagtacggacgacccccatgatgtgcaaattcaaaacaagcatgccttcccgccatatggcttgcctctcaactatacaccacccaatgtagcgtacactcctagtgagaatgtcaataactccactccaatacccattgagagccagcaaccccaaactgatcatgcacatgtctcttaa

SEQ ID NO: 58162 - DNA, 564 bp, Glycine max
  Peptide Sequence Number=SeqID_149847
caacggcttcagatcattggagtgcctacttccgaacgcaccgcaaaactttgcgaggaactcggggttccgcttacgacgctcgatgaaacgcctcatctcgatcttaccgtggatggtgccgatgaagtcgataccaacctttcgctcatcaagggcggcggtggagcgcttcttcgtgaaaagatcgtggctgcggcatctgacgcaatgatcgttattgccgacagctcaaaggtagttgaggcgcttgggcgttttccactgcctatagaagtcaatcgcttcggtctcggtgctaccatgcacgcgattgaagaggcagctgcgaagtgtggtcttgcaggcccactggcactgcgtttaaaagatggctcacccttcgtaacagatggtgggcattatatcgtggatgcatcttttggccgcattcccgatccaaagacactatctgacgctctcttcgcaattccaggcgttgtcgagcacggacttttcatcggactggcgcgtgcggcagtggttgccggcaacgacggcatccgcaccatgaaccggtcttga

SEQ ID NO: 58163 - DNA, 291 bp, Glycine max
  Peptide Sequence Number=SeqID_149848
tttttagagaagaaaagtagtaaaaaaaatgtgtatccagaagaaattttaggcactgaggccttttccggaaggggtaaattccggaagaaggtcttccggaagttactaaggcctattccggaagaagtgtttcgggaaaacacttccggaagcacttcttccggaataggcctcagcaacttccggaagaccttcttccggaatttaccccttccggaaaaggcctcagtgcctaaaatttcttctggatacacattttttttactacttttcttctctaaaaactag

SEQ ID NO: 58164 - DNA, 237 bp, Glycine max
  Peptide Sequence Number=SeqID_149849
atgggagtgttggaagtagtgagaaatgagaaacaacggtggagaggaagtgtgagttcaggaatattgaaaggtagagaggcaaagcggaaggaatggtttgatagctacttactttgtgtgaatcttaacatatttagcgaaggaagggcatggcatcgaagggttacatcaagacatatatataaagcagagtcaggagaagtagtgccgcaagcattagtaggtttggagtga

SEQ ID NO: 58165 - DNA, 99 bp, Glycine max
  Peptide Sequence Number=SeqID_149850
atggagttgagttcagggaggatgattggcagttctaaagaggttgatggtctctatttctttgaagatgagtctagtcctaaggagaaactccactaa

SEQ ID NO: 58166 - DNA, 229 bp, Glycine max
  Peptide Sequence Number=SeqID_149851
atgggtggagtagaggaggtacaagagcagataaaggccgacatggaggccgtgaaagagcaaatggccacaatgatggaggccatgataagcatgaagaagatcatggaagtcaatgcggttgcagttgctgctaccagcgttgttgcaaaggtgaacctgactcccccatctggcctcaaccaaatgaatcatccaacctcagatatggtagggaaagatttgggaa

SEQ ID NO: 58167 - DNA, 246 bp, Glycine max
  Peptide Sequence Number=SeqID_149852
gatacgtaggagcaaaagccctgcttttgtcgaccaccctaccttttgctatcgtgacccaagagtccggtggcatgcggagacaccttacggttatccgcatctcgtcattcgaagacccctagtcggattgacaagcaaagaccaatgtggtcatctgcaccctttccggagatgtcagcatcttccgagcctcgcttttgtcgaccgcctcatgctttctgttatcccaacccgtgaagtcag

SEQ ID NO: 58168 - DNA, 449 bp, Glycine max
  Peptide Sequence Number=SeqID_149853
atggctagaacacgaggtttaggtcgcgctctaggtagacttataggcagacataggcaggatgatcatgatgcagttgatgttcccgagagacgtaggcctactgcatcaacccgtaagcaacgggttcatcagatgactgcggatgcacctgatatggctgaggatgttcctgacataactgaggatgtccctgatatggctgaggatgcacctgagatgactgtggacgtacagggtgatgatgatgctgctgagggatttccaggtgggccacgtgacccatcagtgctgacatcatttgcggaccatgttgcacacaccgtgacattgattgggaggccagtgcctgagattgaaggactggttggtgccacaggattaagtccactaatcgattgttcagttgttactggcgatcctggacttatatctacatttgtggagag

SEQ ID NO: 58169 - DNA, 288 bp, Glycine max
  Peptide Sequence Number=SeqID_149854
atggtcatgccccgccccgagtcgtccctcaggccccgcagacggatatccctcacgtgccggagctcaagagcatcgtcgacatctgtggaggagcctagacatgcagtggaagtttgtgatgacattgctaagaggttggagtgccatctgagtcaaggggtggtcacgccagggtcatcgacacatgaggtgattgaagaatgccttaggttggccaggagtgtgacacaggaccatctagtatatgttaggtctagacgcaggcggcacacgaatcaggcgtag

SEQ ID NO: 58170 - DNA, 195 bp, Glycine max
  Peptide Sequence Number=SeqID_149855
atggttgagactgtgtgtgagggagaggccctgacggactcttcggagtgtaggccttgggggtcatccggtttgagtgctcctataagcctgtgccgatcccacatggttggagcattctcgcaaaacagcatgaccctgactggtctccctatgatttcacttagtgagagtgacctgacttacccattgtga

SEQ ID NO: 58171 - DNA, 483 bp, Glycine max
  Peptide Sequence Number=SeqID_149856
gtgagtgtggaggaggtcagagatgcagatgctccagttcctgtacccactgataaggtagttgtgtctccgccaaaaccacctccgaagcccgatccggaggtcgatgatccgctttatctgatgacattgaccatcccagagcttttcttgaggccttatcaagttagatgggatgccaccgtgttcggggtcgttaatccagatttcctccgaaatcgcacacggtggtcaatgtctcagcatatcagtgttacagttgtggattctcctcagtccattcagaggtctgggcaatcgcagtttgaatctgaaagttacataaagagttggatgcagagttcacaacgcgatgtgtatcttggagcctacctaaatgggccagacaactaccgtaaggggattattaatagtgctatcaaaggtcttgatgatgctccacaacctaaatcaaaggctcctgttaggtggattgtcgtcaag

SEQ ID NO: 58172 - DNA, 462 bp, Glycine max
  Peptide Sequence Number=SeqID_149857
atgtgggatgttactgtgttcggggtgtttaatctagacttcccattgtacatcaagcacaaagatctctccgaaattgcacacggtgatcaatgtctcagcatatctgttattcaattgtgcattttgcatctgacagagacaagtatgcgagcagggaattctgatgtatatggattcctcgagccacagtccattcagagatctgggcaatcgcagtttgaatcggaaagttacatgaagagttggatgcagagttcaaaacgcgatgtctaccttggagcctacctgaatgctgctttgaaaggacttgatgatactccacaacctaactccaaggctggtgctaggtggattgttgttaagtattttaatgatgttagatcattggaagcagagagattcatggcgctttgcatccagtggacacagtattatctaaaagttagaaatcaaacatag

SEQ ID NO: 58173 - DNA, 225 bp, Glycine max
  Peptide Sequence Number=SeqID_149858
atgaggctactacttcaccttcctctagtgaaattgaagaagcaaaaggggaagaatctacacaagattgtagaagcaagcttcatgatgatgaaccaagcaattttgatgatgccaaaagcccaagtgattgattcaagacttcaagatcaagcatcaagaatccaatccaagattccagagaagaaatcaagaagcaacaagtcaagacttcatataggataa

SEQ ID NO: 58174 - DNA, 495 bp, Glycine max
  Peptide Sequence Number=SeqID_149859
ggtggacccttgggtacttgtacctatcacttttagaggactacacgtcctcgccaacagagggctgcacgccctcaccttcagaggactacatgtcctcgccttgagagggctacacgccctcaccttgggtactagttaccctcaccgtcagaggactacacgtcctcgccttgagaggactacacgtcctcaccatcagagggctgcacgctcttacctccagaggactacatgtcctcgccttgagagggctacacgccctcaccttggaggactacacgtcctcgccttgagaggattacacgtcctcaccaccagagggctgcacgccctcacctccagaggactacatgtcctcgccttgagatggctacacgccctcaccttgggtactagttaccttcaccttcagaggactacacgtcctcgccttcaaagggtcatgtaccttcaacttcagaggactacacgtcctcgccgtcaaagggtcat

SEQ ID NO: 58175 - DNA, 405 bp, Glycine max
  Peptide Sequence Number=SeqID_149860
atggaggtatttacagaagccattgtatccctcgcccaatactatgaccagccgttgagatgcttcacgtttggggacttccaaatagtaccgactgttgaagaatttgaggagatattaggatgccctcttgggggaagaaaaccgtatcttttctctgggtttcttccctccttgagcaagattgcagctgtggtcggagatttggcgagagagttggatcgtatgatgcaaactcgaaacggcgtagtgagcctaccgcataaatacttggaaggcaaggtgatgcaatcctaccccgcaagggcattggatagaagactccaagtagattgggctagagatccaagggaaggccttagggttctcatgagccttagggtagatttcgagcccatgggctaa

SEQ ID NO: 58176 - DNA, 843 bp, Glycine max
  Peptide Sequence Number=SeqID_149861
gacatgatcgacgagtactacgtgcgcgagggccaggaagccgccgatgaagcgcgcaagctgctcgatgtcaccggcaccgactacaccagccatgtagaattcggcaaaccggcgatcgagatccacgcctatgcgcaggaacaccagtgcgcgcgcatcgtcatgggcacgcgtggccatggcgcgctggccggcgtgctgatcggctcggtcgccaaccaggtggtgcaactggccgaggtgccggtgacgctggccggtcggcaacgccggcaaggtcagcgtcacgcgcagcccgcccagcggcgatggccccgcgccgacctcgccaccataggtgccggccaggtcccgcacgatgtccaggcccaggccggaacctggccgttgctcgtccatgcgcacgccacgctcgaagatgcgttcgcgctcgtcttcggagatgcccgggccgtcgtcgtcgatcacgatgctcaggcggtctggcgcggtcgcctgggcgccgatgcggacgcgccgcgcggcccatttgcaggcgttgtcgagcaggttgccggccatttcctgcaggtcctgctcctcgccgcgaaactcgagccggtggtggtcgatctggcgctgcgccatcgcaacctgttcacgcaccaggcgggcgaaggcgccctcttcgcgcatcgccgcgttgcccaggatggtcaacggcgtcttgaccgcatgcgccaggttgccggcctgggtccgcgcccgttgcacgatgtcggcgttgaccgccaggacgcggttgacatcatcgaccagcggctggatttcgctgggaaaacggccctcgatgcgcacgct

SEQ ID NO: 58177 - DNA, 382 bp, Glycine max
  Peptide Sequence Number=SeqID_149862
atgactagaggcaatccatctgacttacaaccctttgatcctgagatagataggacatttcatagattagttaggcatcattttataccttttgatcattctgagcattccattactggtgaatctgtgcattttgttattggtgattttgaacatcctgatcttgagcactataattttgagcattctgattctgagcattctgattttgctcattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 58178 - DNA, 537 bp, Glycine max
  Peptide Sequence Number=SeqID_149863
gaaaaagaggtggcgccactcggctccagtcgcagctggccggtgaattttgccgtgatttgcgccacgcatcgcgatctggcccagcgcgtggccgccggcgaatttcgtgaagatttgctctatcgtctgcaggagttcgccctgacccttccgccactgcgcgcctggccgaacgtcgccgggtttatccgcgatttatggcaggagctgggggccgcgcagcgtggcgtacagctgtctccggcactgctgacggcgctggcgcagcagccgtggccgggcaatgtgcgccagctacgcagtctgctgcgcgtgctgctggcgctcgccgatgagggcgaaacgctgacggaaagtcacttgccggcagagtatcgccgcccgccggcaccgccgctgcgcgaacgccacgatgaacagctgatcagtgaaacgctgcagcgctatgacggcaatatcagtaaagcggcgcaggccctgggggtcgcgcgcagcacgctgtatcgtcgtgcggcgcgcgacagaggggattaa

SEQ ID NO: 58179 - DNA, 267 bp, Glycine max
  Peptide Sequence Number=SeqID_149864
atgaagtcagctgacaagcgcgggtaccatatggtcattcacaccgttcatcaaccaggggcaaacgagcccgttgacgcgcagagactaatgtcgtcttctgcaccttctgtcatcatgacccatgaagtcaggtttacattagtcgtccaaagatattcaagcccaacgacgcacgagattcttctctgctgggcagggatgatcaagttcgatagcgcgtggaaacgtcgtggttatcccatcttatcgctttcaagacactaa

SEQ ID NO: 58180 - DNA, 523 bp, Glycine max
  Peptide Sequence Number=SeqID_149865
atgaccggccttcttgatgagtcaatctcttactttctcataagggtggacccttgggtactagtacctattgcctttagagggatgcatgccctcaccttcagagggctacatgtcttcgccttcagagggttgcacgccctcaccttcagagggctacatgccttcgccttcagaaggctgcacgcccttgcctttagagggctgcacgccctcgccttcaaagggctacacgccctcgccttcagaggactacacgtcctcaccttcagaggactacacgtcctcgcctttagaggactacacgtcctcaccttcagaggactacacgtcctcgccttcagaggagtacacgtcctccccttcagaggactacaggtcctcaccttcaaaggagtacaggtctcttgccttcagaggactacatgtcctcaccatcagaggactacacatcctcaccttcagaggactacatgtcctcgccttcagaggactacacaccctcaccttcagaggacaacac

SEQ ID NO: 58181 - DNA, 408 bp, Glycine max
  Peptide Sequence Number=SeqID_149866
atggtcaggacctgttcgaatcggaaagagagaagagtctttggaaagggattcccaggttcaaggaagtatttacgaagtacaaggctaggacaagaaagagggcttcgaatcattgggcgattcgagctggcgaatggtcgagtcgaagtcatcaagctggcgtatggtcgagtcgaagttcaagacagcaagatttctggacttagcacaatttctgaccaaactccacaaaatcagcttcgacttcgagcaatatggataaccgttctaaggagcagttatgtgcatttacttccagcatttcgatttctgttaaacaattttactttctgcaaacttcaaaaccatcaagtgttcgttgcaacgatgaacatcagaaacttgacatttaaagcaaacacataa

SEQ ID NO: 58182 - DNA, 348 bp, Glycine max
  Peptide Sequence Number=SeqID_149867
gcctccacaatgttccagtcccctttctaagcctggtaatcgattacacccccttggtaatcgattaccagaagccctcatggcttcctgacctcgttttcaagcctgagaccatacctcatatatcaatcaagttttacagctggccagccaccacaagcccccttgccttgtggtctttgttccttttatctgttgactgccaggagctcgcctgcttaggtacatcacaggttctcactgatcgactatgcccgggttgggtcgggattggtcaagcttggttttgggcaatagcaccccacctgacgtccccaaggtctcctgacccccgcgacatatctccag

SEQ ID NO: 58183 - DNA, 462 bp, Glycine max
  Peptide Sequence Number=SeqID_149868
atgtccaaatcttgtggatttgggatgaccggccctctcgatgagtcgatctcttgctttctcataagggtggacccttgggtacttgtacctatcaccttgagaggactacacgtcctcgccttgaaaggactacatgtcctcaccatcagagggctgcacgccctcacctccagaggactacacgtcctcgccttgagagggctacccgccctcgccttgggtactagttaccctcaccttcagagggctacacgccctcgccatcagaggactgcatgtccttaccttcagagggctacacgccctcaccatcagaggactgcatgtcctcaccttcagagggctgcacgccctcaccttgagaggactacacgtcctcgccatcagagggctgcatgccctcacctccagaggactacacatcctcgtcttgagagggctgcacgccctcacctttag

SEQ ID NO: 58184 - DNA, 652 bp, Glycine max
  Peptide Sequence Number=SeqID_149869
attgaaggactggttgctgccgcaggattaagtccattgatcgggtgttttgttgttaccggcgatcctgaacttatatccgcatttgtggagaggtggcacagggagaccaacaccttcccccttccagtagaagagttgacgatcacactggatgatgtgtcgtcactcctccatctgcctatcagtggcgccttccacaactttcatgctctttctgtggacgaggcgatatttttgttgatagagttgctcgaggtgtctgctgaggaggctagagccgagacaacacgatcacgcggggcatatgtacggctgggatgggcttttcgcgacctaagtcagagtggtggttatgcctggggagttgccgcgttggttcatatgtatgaccagttagatgaagcttctaggaccacgacacgacagattgggggtgctggatctataagcacttttcgagtgtgcatcagtgcgtcacagatgatgcgtacgaggagacgtccccactgcttcctggtggctgacgatgaaggcgcatctgatttcatcgttctagggtcagctgagatggggtcctatggtggtcatagttcaaccggagagggtgctacggcagtttggttacattcagagcatccctccgccgcct

SEQ ID NO: 58185 - DNA, 291 bp, Glycine max
  Peptide Sequence Number=SeqID_149870
atggacctgaagaagtccaacagggccctggggtttccagctctggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctctgtcagttctacggagtgcccgtcgccccaacaaggtcattaggccccacattaaccgagctttcatcaagaagtactgcgcccccagacgggcgtag

SEQ ID NO: 58186 - DNA, 231 bp, Glycine max
  Peptide Sequence Number=SeqID_149871
atgaccaaagtgaaccaagagccatttctagggcaaaatttgggtgttgaagagtcaaattttgattcgcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgtccgaccgccacctag

SEQ ID NO: 58187 - DNA, 320 bp, Glycine max
  Peptide Sequence Number=SeqID_149872
ctgtccctcctgttcagttactgacggggtggtgggtaacggcaaaagcaccgccggacatcagcgctggcaagagtagcggtcacgctgcgcggcgcgtccccttcgccattcaggctgcgcaactgttgggaagggcgatcggtgcgggcctcttcgttattacgccagctggcgaaagggggatgtgcatcaaggcgattaagttgggtaacgccagggttttcccagtcacgactgtaaaacggcggccagtgaattgtaatacgactcactatagggcgaattggagctccaccgcggtggcgaccgctcgagaa

SEQ ID NO: 58188 - DNA, 253 bp, Glycine max
  Peptide Sequence Number=SeqID_149873
atggcggcgaagttctcaccttctagaccttcattttcggcgactccttcggcttggtctaagcaaacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagg

SEQ ID NO: 58189 - DNA, 88 bp, Glycine max
  Peptide Sequence Number=SeqID_149874
gcgaggactttgagtcctgggaaagataaaagcaaggactttgagggtaccgagctcgaattcgtaatcatggtcatagctgtttcct

SEQ ID NO: 58190 - DNA, 210 bp, Glycine max
  Peptide Sequence Number=SeqID_149875
atgtcagtgaaaaccctcgtcgggcgcctaggagtacatgacaagacaaaccacacactagcaaggagaccagccaagtcactccaaccatatgggatcaacataggcttaaaggagcactcaaaccgtgtgacccccaaggcctacactccgaagagctcgtcagggcctctccctcttgattcaggtccaacccagaaaatattttag

SEQ ID NO: 58191 - DNA, 384 bp, Glycine max
  Peptide Sequence Number=SeqID_149876
atgattatggggggccaagacatttatagtaaccaagatgaggctactacttcaccttcctctagtgaaagtgaagaagcaaaagaatctagtgaagaaatatacccccaagaagaaggacaacctttaatggttaaggagaagtgtaaggaggtaagtatctcctccaagaggaataatcaacatgaaaatacagaaaaaggtacgctttattgcattactttccttaattttttaaatagtgatcaaggggttcccacagaccctaagagaataaaggccattcctgattggcccactcaaccaagtataagggaaatctggggctgccatgacttaacaaacttttacaaaaggtgtcaagggaaggagcccagagtatga

SEQ ID NO: 58192 - DNA, 474 bp, Glycine max
  Peptide Sequence Number=SeqID_149877
atgaccatgattacgccaagctcgaaattaaccctcactaaagggaacaaaagctggtaccgggccccccctcgagacgtaccatgtccccaggacctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58193 - DNA, 362 bp, Glycine max
  Peptide Sequence Number=SeqID_149878
tggccaaagtgcttgttgacaatggctcttccctcaatgccatgcccaaggctactttggacaagcttccttttaatgcatcacacataagaccaagctccatgatagtgcaggctttcgacggcagtcccttggattcattcgattggggtggtcccgtcaacactacaccagaagttgaaatttgtggtggatgggcaattgattatagttttgggagaagaagacatactcatgagttgtccttcttctacgccttatgtggaggctgtggaggagtccttggaaacttcctttcaagcattggaagttgtgagaaatgcttacgtggagtctcccctggtatagccgcgcttaactag

SEQ ID NO: 58194 - DNA, 752 bp, Glycine max
  Peptide Sequence Number=SeqID_149879
gtattgattccggctccaccgccaccaaaggtatcctgctggcagacggcgccatcgtgcgccgtttcctcagcccgacgccctttcgccccgccgatgccattcacgaggcctgggagacgctgcgcgcggacctcgcggcaacgccttttttaaccctcaccggctatggtcgccagttggtcgattttgccgataaacaggtcaccgaaatttcctgtcacgggctcggcgcgcgcctgctggcgccggaaacccgcacggtgattgatatcggcggccaggacagcaaagtcattcagttggatgcgcagggcaacctcagtgattttctgatgaatgacaaatgcgccgctggtaccgggcgctttctggaagtgatttcacggaccctcggcgccagcgtcgaccagttggacgccattaccgaaggtgtagaaccgcacgccatcaccagcatgtgtacggtgttcgccgaatcggaagtcatcagcctgcgttccgcgggggttgccccggaggcgattctggccggggtgatcaacgctatggcgcggcgcagcgcgaactttattggccgtttatcggcgcagggaccgctgctgtttaccggcggcgtcagccactgcgccgccttcgcccgcatgctggagacgcatgttggcatgccggtcgcgacccatcccgacgcccagtttgccggggcaatcggcgcggcgctgatcggccagcgccagcggaggcgcggatga

SEQ ID NO: 58195 - DNA, 482 bp, Glycine max
  Peptide Sequence Number=SeqID_149880
atggtgaaagttggaacttcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcctcctattgtttttcaaaacctttgtaacaagctgggaatgatgaatatccattcccagcttgagggggggggggatcttaagctgcaccatgtgaaagttag

SEQ ID NO: 58196 - DNA, 252 bp, Glycine max
  Peptide Sequence Number=SeqID_149881
atgccattgaagggcaagcagttggtggtatacccctgcaaacactttggagggccctcagtatcacccataactacacctcttgtattccccaacaaggccattgaaggaggtgaagattatgcctttgttaacctagaagagttgttcctagtacccaatatcatcacccctcccaagttcaaggtgccggactttgacaagtacaaggggactacttgccctaagaaccatctaaagatgtattgttga

SEQ ID NO: 58197 - DNA, 123 bp, Glycine max
  Peptide Sequence Number=SeqID_149882
atgactgttgcaaacgatattaagataactcttcctaagatcgatagtgctaaagagtttatgagtaagttaattcaggaagaaacggggcttaagaatcaaggaagtcactcagtctattat

SEQ ID NO: 58198 - DNA, 276 bp, Glycine max
  Peptide Sequence Number=SeqID_149883
gggttatggctaccattgcattatcgagtggatataggagcaagtcagcataggacgccggaatttggggtgaatcctacatgctttttgctgcaaaattcctttttggttggtgttttggttcgtgctaaagggatggcctttgtggataactgggtggtggggaaggagaaggggaaacttggtcgtataggaatggcaatcacagcatgggtttctccctccttctcatcctcttcatttgccccagttttctcattcctcaaagcaggatga

SEQ ID NO: 58199 - DNA, 278 bp, Glycine max
  Peptide Sequence Number=SeqID_149884
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcaaggttcaagatctcaaaaatcaagatcaagaatcaagagaaggcttaa

SEQ ID NO: 58200 - DNA, 608 bp, Glycine max
  Peptide Sequence Number=SeqID_149885
atgaaagataagagggatgaggaagaaaaactagaaaaacaaaagaaaaagaaggatagtaaggcattgtcttcaaaggccaatgggaaggaaaaagaggaaaaggattcctctaagaagattgttaagaaggaaaatcattttgcaacaaaaggtgatatcaaaagagcactccttcttgaacaatctttcaactttctcctatcaagggaaacatcccttagcactgtcatacctcttgagcttgaggttattcctcaagtaaaggagttattggatgagggggttcccacgaaccctaagagaataaaggtcattcatgagtggaccactccaccaacaccactcattgagttggtgaggaaccatgttccctcatgggaagattcccaggaaatgggtgttgagggaagaagcccagagtttcaagaacctctggatttgaggtccatgggtgtcgcaacctacccttcggcgggagggcgacgcgagactcgcgggatgcgtgttccacgaaaggaatacgcgcggagtcgccaccaacgtttatttggggaaaacgtcggaaaaaccggaaaagacgagatctacgaactttttagtgaaag

SEQ ID NO: 58201 - DNA, 228 bp, Glycine max
  Peptide Sequence Number=SeqID_149886
atgactaatgcaaactgtccgcaagaatcattgcattcagtctcaaacgggaatctaaggttcactcagcatgaggaacaattgtttatagagaaaattacattgatgagggtaccaaaggatcatcatattctaaacatcatcacccacacgatgcactcctatattgaagagttactaaaccaattaggccaaaacaagcattataatcaatttgcagtagcatga

SEQ ID NO: 58202 - DNA, 180 bp, Glycine max
  Peptide Sequence Number=SeqID_149887
atggtgaaagttggaacctcttacgtgccgatcaacgtgtcattttcgccaaaagttggcccagggcttcccggtatcaacagggacaccaggatttatttattctgcgaagtgatcttccgtcacaggtgctccagtggcttctgtttctatcagctgtccctcctgttcagctactga

SEQ ID NO: 58203 - DNA, 127 bp, Glycine max
  Peptide Sequence Number=SeqID_149888
atggctgatgcacctgccactttggcgtccatgttccagctaacgccgcacgaggatctaccatacattgagttctggtgtcgtggcaaacccgcacattattgccaggtggaagaggaatgggacg

SEQ ID NO: 58204 - DNA, 411 bp, Glycine max
  Peptide Sequence Number=SeqID_149889
atggcactagaatctattgcctttagaggactacacgtcctcgccttcagagggctacacgtcctcgcctttagaggactgcacgccctcacctttagaggactacacgacctcaccttcagaggactacatgtccttgccttcagagggctacaccccctcgccttcagaggactacatgtccttgcctttagagggctacacgcctttgccttcagagggctacacgcccttgcctttaaagggctacacatcctcgccttcagaagattccacgtcctcaccttcagagggctacactcccttgcctttgtagggctacacgccctcaccttcagagggctacacgccctcgcctttagagggctacacaccctcaccttcagaggactacacgtcctcgccctttag

SEQ ID NO: 58205 - DNA, 147 bp, Glycine max
  Peptide Sequence Number=SeqID_149890
atgggaaataatgccaatatcttattacgcgaagagaaaattccgaaacttcgagaaaaaagggcattcacttattacagagatggtgcgattcagccccccggtgagaaattgccaaatcatttgactcttcaccattccatataa

SEQ ID NO: 58206 - DNA, 391 bp, Glycine max
  Peptide Sequence Number=SeqID_149891
atgcatacgaggcaagatttcacccgtgccgctgcaaagagacaacgaccgcaatgccgatctccccctgcggatgtatcagttggtctgtgtcgtcccgacataggtaagtatgcatatggttcaactgatttcttataccatccactatttgcagggatcatgctcgcaagactgccagtggacccggagaagtccaacaggttctacggagttcctgtcacccccggcaaggtcattaggtcccctactaatcaagctttcatcaagaagtactgcgcccccaggcaggcgcagggtgaaacaccacaacagcctggggatggctggcagcgggcaacaaacacaccgccaccacctctagagttcatctcagctcatccacaaaatg

SEQ ID NO: 58207 - DNA, 345 bp, Glycine max
  Peptide Sequence Number=SeqID_149892
atgttaagacaaagttctcaggcggttaaacctttgaatctttgtgaatggggatacaaaagaattctcaggcgggagaaaggagacacaaaagaattcaggcggttagtcctttgttattttggaaaagggagaagagagacacaaaaagaattcacgcggttagtccttggcgaattctttttggcaaagggagaagagatgaaaagaaagaatagcacagttttcaaggtttggaaaaccagaaaactttggaagaagaagaagaagaataagatgaagaagcataggtttctcaaacttggttctaaagaattattggaaaaatttgttcaagataattga

SEQ ID NO: 58208 - DNA, 795 bp, Glycine max
  Peptide Sequence Number=SeqID_149893
atgaagggcccgatgaagggcgccaccattgcccatgccaagcagcgccgtaccgtgacgcgttacatcggcctgaccgagccgggcattatcgcggccgagtcgccgaatccgatcgtcaaccacctggtgatcatgccggacatcgagaagcgcctggaggccttcgtccgcatcggccacggcatcatcgtgttcgccggtggtgtcggcaccgccgaggaaatcctgtacctgctcggcatcctgctgcgcgaggaaaacaaggacctgccgttcccgctgatcctgaccggcccgacggtggcggcgccgtacttcgagcagatcgaccggttcatccgcctgaccctgggtgatgcggccgccgagcgctacgagatcgtcatcggcgacccggtggcggtggcaaagaaaatggccaacggcatcaagcgcgtgcgcgagcaccgcctggcgcagaaggactcgttcttcttcaactggtcgatcgagattccgtgggtgtaccagcagccgttcgtgccgacgcacgaggcgatggccgcgctggacctgcaccacgggcgtgccccgcacgcgctggcggccgacctgcgccgggcgttctcgggcatcgtggccggcaatgtgaaggaagacggcatgcgccgcatcgagcagttcgggccgttccagatccatggcgacccggacatgatgcaggccctggacgcgctgctgcgtgccttcgtcgaacagcgccggatgaagatctccggcgaataccagccctgctatcaggtgctggcatga

SEQ ID NO: 58209 - DNA, 327 bp, Glycine max
  Peptide Sequence Number=SeqID_149894
atgggtgcattagttaacctatgtttgagggcagcaaaggcctcttcttgtttcttaccccatttgaaacccacattcttcttaacaacttcagttagaggagcagccaatgtactaaaatccttaacaaatgatgaggacatgaccaagagcaagggcaaggatccacttgaaggacttggagggcctatgacaagggctagagcaaggaaagccaaggaagctcttcaacaagtgttgtccatactatttgaatacaagcctaagtttcaaggagaaaagtacaaggtcgtgacttggaacaaaacccagatgggggaggactaa

SEQ ID NO: 58210 - DNA, 321 bp, Glycine max
  Peptide Sequence Number=SeqID_149895
atgtccccagtggagtcgccaactgtcgcaacgtgcccctttgcgggcgagcgaaggcgaggctcacgggtgcgctttccaaaggaggaaagatgcgcagagtcgccaccaacgtttatttgtggaaaacgtcggaaaaaccgaaggaaactggtcgaaatgaaaattctaagttcgggagttgtatttacgtttgaggaagacaaaagcggggctcttcctcctacgtaccctccatcgaagaggaaatcagacctacgtagttctttctgggcaatttcttgcttcaaccttaagcaagaaattgcccagaaactctag

SEQ ID NO: 58211 - DNA, 153 bp, Glycine max
  Peptide Sequence Number=SeqID_149896
atgggagaacgacgattcaacattatgtcgtggatcacaatatctgatgcatcggcctgtgtatggagcaatcataatgaactgctgcggattgtctggtcaggtttactcaacatgaattgtggttcaagcaagaaatttgaggagtgctga

SEQ ID NO: 58212 - DNA, 136 bp, Glycine max
  Peptide Sequence Number=SeqID_149897
atgaacgaaaacgcaattcatagggctccgaaaagggttgagaatggagaattgcacttagcgatcactacgcgtagctccaaaatcgaaggtggaggacacatgaacgaaacgcaattcatggggctccgaaaag

SEQ ID NO: 58213 - DNA, 396 bp, Glycine max
  misc_feature (371)..(371): n is a, c, g, or t
  Peptide Sequence Number=SeqID_149898
atgggaaaatgcctggcccttaaatacaacgtcctgcatttgatagacgccagatggctgacgtctcaagaggaccggcccaacgtgaaaacaaacccgctcgccaatcatggagggggagcagttaatgccatcgagttgggtaggccgcacaggtccaagcctttaaaggacatgacgacccccaggaggtttatctacgaggccctacaaaagggaggcgtaattccccacgcaatggaggacctgttgcaacagatgatagatcgaggccggctggaagtcggcgatgaggggagtaaagaacagcatatatgtatgcagtccacagatgagggaaggtttggaaggcctaaacctttggtggtatntttcaccagagacgcagctccctaa

SEQ ID NO: 58214 - DNA, 114 bp, Glycine max
  Peptide Sequence Number=SeqID_149899
atgaagatgctcttgataccacatgatatgaatgacagtggaatggagaaggaagagagagaggagacaccacttcaaggagaagatgaatctagaagaagctcaccaccatag

SEQ ID NO: 58215 - DNA, 262 bp, Glycine max
  Peptide Sequence Number=SeqID_149900
caatttgcgtttctgggctgcaacggcttgtgctggaggagatcgatcttcttctgaaaaatctgcagacatcgtgtccgacatcgtggatcctgcagcttcacttctgcacttggcttttatcttgcattgtacaacaattccagtattctcgggcaggatgtcaggacattgtatccgacatcgtggatcctgcaacttcacttctgcacttgacttttatcttgcattgtgcattgtgcagcccgatctcattccttga

SEQ ID NO: 58216 - DNA, 249 bp, Glycine max
  Peptide Sequence Number=SeqID_149901
atgaacatcacaagcatcatcataaaaaccctaaaacagaatggaaacctagcaagactacccatcatatctctcaaaaccccatacccacgaaaatcaaaggagaaagaagttcacccaaacctgaaatttcgaagtcccactcgtagacacgcacttcacgactccgaaaatgccctcctttcacgatttggggcagaaatgatggccaaaggttggagctttgtttggagcttcaatggagaatga

SEQ ID NO: 58217 - DNA, 821 bp, Glycine max
  Peptide Sequence Number=SeqID_149902
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttttgctaggatatcctatgcctccttcgaagttgtggcaattgcaattttttcaaaatgtgcagagtccacacattgatgcaagaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58218 - DNA, 453 bp, Glycine max
  Peptide Sequence Number=SeqID_149903
atgctttgttggtctaggtataagttagttgtcaagatggaacagaacggggagaagagtggtgatgagatcaaggtgttccctgcgtgtgttgatcaattgttgggtaaaacttgggttgtgagattcaaacaccgtatacagatgcaccaatcatccatgttggattttagtgaacaggaacatcatatacaatcagtgatatccacgctaggtctacaggatgaacaatgtttaagcaacaagtcagctgctgttggtgctgcatcttcatcacaacaagattaccatcctacacctttattgtcacagtcttctaaatatgatcctggaaatgctgcctttgtaactcctgcaaaaagaacgtccgatcagcaaggaagtagtcagtttgatagtgacgacttcacaacatatgaactatcgaccaacaagcatataaaagctaagtaa

SEQ ID NO: 58219 - DNA, 387 bp, Glycine max
  Peptide Sequence Number=SeqID_149904
atggctccgagaaagctttccgcaaagagatctaggaaggacgccgcagctgaaggtaccagtgccgcccccgagtttgacaaccatcgtttcaggagtgctgagcaccagcagcgtttcgaggccatcaaaggatggtcattccaccgagagagacgcgtccagctcagggatgatgagtacacggattttcaggaagagatagctcgccggcgttggacatcgctggtcactcccatggctatgtttgacctggatgttgtcctagagttttacgccaatgcttggccaacggaggagggcgtgcgggacatgcggtcatgggtaagaggccagtggatcccttttgatgcagacgccctcagccaattcctcggagacgcgcta

SEQ ID NO: 58220 - DNA, 363 bp, Glycine max
  Peptide Sequence Number=SeqID_149905
atggtttctagaggtatcatccccttcgaaaaacatattgcggcagtagggactaccaacaacaatatgttatcaaagagaaaaactctagatgagggttcattgttatcaagcaagtcggagacccagcatgaccatagattcacttccactccttatgtttccatggacccgggtataaggccccttttcaactcactgtgtgtgcaaaaagtggagtcgcaacctacccttcgacggaagggcgacgcggggctcacgggtgcgtcttccaaaggaggaagacgcgcggagtcgccaccaacatttattccaggaaaacgtcggaaaaaccagaacgtgtggtctacgaactttaagtaa

SEQ ID NO: 58221 - DNA, 327 bp, Glycine max
  Peptide Sequence Number=SeqID_149906
atgggaatctacggttcactcagcatgaacaacaattatttatatagcaaattacattcagcacgtataacaacattcatgacatacaagaacattcatgacgtacaagaacatacaaggacatcaacagttgatagcaaaggatcattaaattgtaaacatcatgagccacatgatgagggaagcagtatcaaatcaatgctttacaagcttttggtcaatctgaggagtggtgtcttcatgctgcaaattgatggtttctggtggaaaatcctaatttggttaagccagaaattttgcagcatttgcaaagtagattcaaattaa

SEQ ID NO: 58222 - DNA, 522 bp, Glycine max
  Peptide Sequence Number=SeqID_149907
atgggaagcgttaaacggaaatttttccaacgtgcttttgggcatcacattcaaactggagccattatcgatgagtactttggcatgacgtggtccatgcatttgactgacacatgcaaagccctgttatgtcctctcccctcggcatggatttcctcttcagcgaaggcgagactcttactagcaaagctcgatgaggctcagagctcaagactattccaaaagagagactctagccggggttttgttgagttgctcaatgactttgaactcgctttgttgaataatgcggaggaactcgccggcctcctcgagcgatacctcttccttgtcacagccatcccttccctcagaaagacctttcattgtaacattctcatccggagtggggattactttgacattttgtcctgccgtcatccttgccttccctttagcgtttgcaggctgtgttggcaggtcagggggtgcgaatacgcgaccgctgcgagtcatgctgctcagccctgtgatattggttag

SEQ ID NO: 58223 - DNA, 252 bp, Glycine max
  Peptide Sequence Number=SeqID_149908
atgaggtctgacacaaacatcggtagtagaggaagaacttcatttgtgttaattggttgtgaaaggagtggtcagtataggtctaggaagaaagactttgttagaagagatactgggagtagaaaatgtgggtgtcccttcaagcttcgtgggaaaccagtggttggggggcaaggttggatggtgaagttgatgtgtgggagtcataatcatgaattgaccaagtcattagttggacatccatacgcatga

SEQ ID NO: 58224 - DNA, 282 bp, Glycine max
  Peptide Sequence Number=SeqID_149909
atggctaagtttgaccctgaggtagtcctggagttttacgctaatgcttggcccacagaggagggagtacatgacatgtattcatgggtgaggggtcaatggattccttttgacgcagatgccctcagccaattcctgggtgacccactagtgttggaggaaggccaggagtgcgagttcagtcagaggaggaatagggccaacgggttcgacgaggaggccattgcccagctattgtgcacactagggcaggatttcgctcgaactgctgccgggagacgg

SEQ ID NO: 58225 - DNA, 216 bp, Glycine max
  Peptide Sequence Number=SeqID_149910
atgccttccccccctcttatggtagtaaaatactgcgaattcaaaggatactgggctgccttgcagcgacattttccgctggcccaacgccgggaaggggtgacgattggtcggtcgcgaccctatcctccatttgccttcatccctaagtacctacaagcaggagacaaacaatatgcggccaatcgtgaccgttcatcgtcttaccttggttga

SEQ ID NO: 58226 - DNA, 288 bp, Glycine max
  Peptide Sequence Number=SeqID_149911
atgggtggaatggatgaatgcatgaagaaatgcatgacacagatgcaatttatgaatacgggagcccgggaaattgtctctgtatttaagaaggtggcacggaccctccgttggtttgccaaagagaggggatcaaaacagaatccgtgcgtgatgcatatgcgaaaggcgcaacacgagagtcgtatccgcttcgtgcccctattcaagggacctatatgggagagagctaaaaaggtttttagtgataatccccaaggtggtcatatttctcttgatggtctctag

SEQ ID NO: 58227 - DNA, 618 bp, Glycine max
  Peptide Sequence Number=SeqID_149912
atgttctttgtgattgctctgtggcacttgatttgcatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgtaagaagagtaggagagcgtatcatagccttaaaattggtagtgggacaggacacctttaatgttattagtgggtacgcacctcaggtggggttagcagaacactttaaggtaaaagtttgggaggatctagaaggggtacttcaggatataccccaaggagagaaagttttcctaggaggggatctcaatggacatgtaggtagcgtggctagaggttttgagggggtgcatgggggttttggcctatgggagatgaatgcggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaagtattgcttgaactgtaaa

SEQ ID NO: 58228 - DNA, 609 bp, Glycine max
  Peptide Sequence Number=SeqID_149913
atgtctctaaacagttttcttggaaggtgggtaggggagatcaaattcttttctgggaagattcttgggttgatggtgggatacctcttaaagatcaatttccagaattatatcaaatttattcccaaagattacagcttctggcagatatgggatctttcttttaaaatgggtgggaatggactttctcttagagatgaaatttgtttgacactaagcaatcttctgaagcccaatgtctgggtttccaacagctttgggatattaaaatccctcctaaagccttatcatttgtttggagattgctttgggataggcttcctactaaggataacctatctaggagacaagttgagattgacaatgatctttgtcccttctatcaaagccaacctgagtctgcctctcatctgttcttcacatgtggtaaagtcttgcctttgtggtgggaattcaattcatgggtgtcacaaccgacccttcaacgggagggcgatgcgtgactcgcgggtgcgtgttccaagaaaggaatacgcgctgagtcgccaccaacgtttatttgaggaaaacgtcggaaaaaccggaaaagacgtgatctacgaactttaa

SEQ ID NO: 58229 - DNA, 534 bp, Glycine max
  Peptide Sequence Number=SeqID_149914
atgaagaatggcagcaaatcggtggaatattgttcgataaaattcacggggaaattgaaaatgcttggggatggaaatgaaggaatgtctacactccctggattgaatcagatacaatttgaagggttttgtaggtccattgatcggggcttaccagaagggctttttaagtttccaaaaattgaggatacagatcaagaaattgaatttcaattatttgtagaaacatatcaattattagaacccttgataaacgaaaaagatgctgtatttgaatcgcttacatattctgctgaattatatgtatccgcgggactaatttggaaaagtagtagggacatacaagaacaaactatttttgttggaaacattcctttaatgaattctctgggaacttctatacaaagccctggtatttattcccgttcagaattggaccctagcggaatttcggtctatactggcaccataatatcagactgggggggtagattagaattagagattgatagaaaagcaaggatatgggctcgt

SEQ ID NO: 58230 - DNA, 144 bp, Glycine max
  Peptide Sequence Number=SeqID_149915
atgagcaatgcaaccaatgaaaagcatggatgtatgcgaatgatgtacagtggaagtattgcgaatttttacgcaggatatgggaaatgggtttatgatcccaacatggttggctcatggtgcctaacacatgcaactaagaag

SEQ ID NO: 58231 - DNA, 426 bp, Glycine max
  Peptide Sequence Number=SeqID_149916
atggatccaacaactatgctcagaatgatgcatgcacctgacctcaactctcagatgcaatgcgtatttgttgaggccacccagtcgtacaccgtaactccccaccaacttggtgatcatgcctgggccacaaggagtttcctaccaggtgacacaccccctagtccacgaaagtacatactgccacagtttatactatctcatatgtggcatgaaaccatgggcgtcgtcaagtacctgaccatggatgaattaaagcgcctaagcatcccctcagaaatgcttaaattctttaaccactctagtttcccacacaagggacatccgacaaggtcactgcactcccccatgaacgtacacaacatgcacatctcaatgcatttccaacatcatcaacattccatttcaatatcattctcaacataa

SEQ ID NO: 58232 - DNA, 379 bp, Glycine max
  Peptide Sequence Number=SeqID_149917
gcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggagttaggtcttggaagtcatggcgccgggttaaggctaaactggaaggacaag

SEQ ID NO: 58233 - DNA, 459 bp, Glycine max
  Peptide Sequence Number=SeqID_149918
atggaacacgagatggaacttcaacgcctcaatcagaatgaagaaaattacaaaaagaagagaagcatagcccttaaagcctcatctttagtacaagaagaaaacgaagaagaagattcagatgatgaagaagatttttccttctttgttaagaaatttcagaaatacatcaagaaaagaagaattgacaggcatcagaatttcaataatggaagaaaatcacaagatgattctcaagtccttaggtgctacaaattcaaccaaattggtcacatcaaggccaattgtccttcaaatgaagaatggtcagagaaaagtgaaaagaaaagatttgatgaaagaagaactaagaaagcatacattgcatgggatgacaatgattcatccgatgattcagaaaaggagattaatcttctaaccaaagattatgaaagtgatgagaacatctctcaaggatga

SEQ ID NO: 58234 - DNA, 234 bp, Glycine max
  Peptide Sequence Number=SeqID_149919
atgagggttgtggttgggggtgatactgagggccttccgaagtgttttcaaggggtataccaccaactgcttgcctttcttcgttggtttttgagccaagttgagatgggcaaacttggccatatggcgggaaggcgcgctcgttttgaatttgcacatcatgggggctgcccgtcattcttacccaaatctttgcctaccattatctcgaggttggatgattcattaggttga

SEQ ID NO: 58235 - DNA, 675 bp, Glycine max
  Peptide Sequence Number=SeqID_149920
atggtggaggtctccacggagtccattgcctccttcgcccaatattatgaccagcctttgaggtgcttcacctttggggacttccaattaacacctacggtggaagagtttgaagagatcctgggatgccctctgggaggaaagaaaccatatcttttctcagggttccatccctccttggctagaatttccaaaatagtcaaaatcttgacacaggaattggaccggggaaagcaagtcgagaatggggtggttggagtaccaaggaaatgtttggaagcaaaggcgagaaccttggcaagtcaagacgaatgggctccgttcgtggacgtcctggcgctcttgatctttggagtggtcctctttccaaacatagatgggctagtggacctagcaacaattgatgcttttctcgcctttcacgatcgcaaggaaagcccagttgtcgctatcttagtcaatctatatgacacattcgaccgaagatgtgagaagaacagtgcaaggatcgtttgctgtacaccgtccctctacgtatggttggtttcacaccttttccaccaagaggtgagacacgtttgcccactagccaccgctcatgcaccgagaagaagaggcaaactgggaccgactcttagcaagcaaagaagagcgtctgtcagttggttcccctga

SEQ ID NO: 58236 - DNA, 208 bp, Glycine max
  Peptide Sequence Number=SeqID_149921
ggatctcaactcatctaatatcttatacaagggatccttaggagtagaaatgatgtacgctccattggagcttgtaggcctaggatattcttcatcaatggattcctttgcttcttggaagatgaatggcagcggaatggagaaggaagagagagaggagacgccacttcaaggagaagatgagtctagaagaagctcaccaccatag

SEQ ID NO: 58237 - DNA, 384 bp, Glycine max
  Peptide Sequence Number=SeqID_149922
atggatcgcgcccacaagacgcccagtggacccgaagaagtccaacagggccctggggtttccaactctggttatgggcctctgtcagtcctacagggtgctcgtccccccagcgagggatcgcgcccacaagacacccagtggacccgaagaagtccaacagggccctggggtttccagctctggttacgggcctctgtcagtcctatagggtgcccgttcccccagcaaggaatcgctcccacaaagacagccagtggacccggagaagtccaacagggccctggggtttccagctctggttacgggcctctggatcgcgcccgcaagacacccagtggacctgaagaagtcccacagggtcttggagttgccaagctctaa

SEQ ID NO: 58238 - DNA, 75 bp, Glycine max
  Peptide Sequence Number=SeqID_149923
atggcgtctggaggatatggaagactgaccttcgtcaccctaagtgggcggacgttcgctacaagttgggcctag

SEQ ID NO: 58239 - DNA, 693 bp, Glycine max
  Peptide Sequence Number=SeqID_149924
gatcccacagaggactacacttcctcgccttgagaggactacacgtcctcaccatcagagggctgcacgccctcacctccagaggactacatgtcctcgccttgagagggctacacgccctcaccttggagggctacacgccctcaccttgggtactagttaccctcgccttgagaggactacacgtcctcaccatcagagggctgcacgccctcacctccaaggactacatgtcttcgccttgagagggctacacgccctcaccttgggtactagttactgcctcatcgttgaggggactacacaccctcgccttgagaggactacgcgtcctcactttcatagtttccttttaacagttcctgggccaccccctgatattggaggagggccaactgtgcgagcacaaccagagagggaggctatcacacagctactatgcatactggggcaagatttcacccgtgccgctgcaaagagaagacaacattctgcccagcgaccgcaatgccaatctccccctgcggaagtatcagttggtctgtgccgtcccgacatggggatcgcacccacaaagacacccagtgaacctgaagaagtccaacagggccctggggtttccagctctggttacgggcctctatcagtcctacagggtgcccgtacccccccggcaaggtcacgtcatcatag

SEQ ID NO: 58240 - DNA, 221 bp, Glycine max
  Peptide Sequence Number=SeqID_149925
gtggcgtctacccagacttatcttccttaaccggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccactcctactcagtgtctttcagactttgtgtcataa

SEQ ID NO: 58241 - DNA, 582 bp, Glycine max
  Peptide Sequence Number=SeqID_149926
atggagagaagtatgatagatgttgctagtggtggagcccttggagaaatgacccctgctgaagccaaaaatttaattgagaaaatgacttccaactcccaacaatttagtgccagaaatgatgccattgtcattagaggagtgcatgaagtagccacgaattcatcttcatcaggtgagactaagaagcttgaaggtaaactagatgccttggttaacctggtaacccaactggccatgaatcaaaaatctgcacctgtcgccagactctatggtttatgctcctctaccgaccaccacacagacctttgtctttctgtgcaacaatctgaagcaattgaacagcctgaagcttatgctgcaaacatctacaacagacctcctcaacctcaacagcaaaatcagccacaacagaataattatgacctctccagcaacaggtacaatcccgaatggaggaatcatcccaaccttagatggtcgaacccttcacaacagcaacaacaacaaaaaccttattttcaaaatgttgttggcctaagcagaccatacgttcctccatcaatccaacaacagcaatag

SEQ ID NO: 58242 - DNA, 213 bp, Glycine max
  Peptide Sequence Number=SeqID_149927
atgaggatggaccgatttgctcttactttgaacaggagtcaagaacttccccgattgctagccaaggccaaagcaatggcggacacctactccgcccccaaggagatccacagacttctcagctatttattggcgatcaaaattgccattccctgggttatggggttgaaccaagctcgtgcttttacgaaaaggttcatcgagtcaagttga

SEQ ID NO: 58243 - DNA, 318 bp, Glycine max
  Peptide Sequence Number=SeqID_149928
atgggacttacctgtcaagcgctcaagtatttgatcaatgaatggcaggggaaaatgatccttcctagttgcctggttcaacctcctatagtcattgcagactctccagctgttctgcactcatgtggggataagctcatccctctcattttttattactgtgaggcctgtcttcttaggaaccatttgtactggactcacccactggctgtcagaattggggtagaggggctaataccaggaatgtctgctaaagtccatccaatggctttcttgtgcttcttgagcactagcagcaacttgtcctcttgctcagca

SEQ ID NO: 58244 - DNA, 87 bp, Glycine max
  Peptide Sequence Number=SeqID_149929
atggcgacgttgttcgtctccgatgaggtgccgagcgtcgtcggcacggccacgatgtccacgggcggtgggccgtccggcagcacg

SEQ ID NO: 58245 - DNA, 444 bp, Glycine max
  Peptide Sequence Number=SeqID_149930
atgcatgcgagatgcggaagaaccagtccatgtagtcgctggcacactgacctggcacaacgcacacctcacctgctagaaccatatgatctgagtagtgcatccgcctgtcgtgtatatcatcatacgacacccatgaatcgacaggcggaacaggaatggtctgggtgtatccaaactgccgcacgaccctctctggtcggtaatacacagcaacaggcccccagtgcaggagatcggaatatcatgaaatcaaatgaaagtcccggaccgctcaaaggtcaatcaaagaatgagttcaagatagaatcaagaacacttcaagattcaagaggaaagttgatttcaagaatcaagattcaagagatcaagattcaagactcaagaatcaagagaaggcttaatcaagataagtatgaaaaggttttttcaaaaactgagtag

SEQ ID NO: 58246 - DNA, 833 bp, Glycine max
  Peptide Sequence Number=SeqID_149931
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgttttaaatcatgctttcgtgcaaatgcctgtgagcacacctcgcatttaaacggacgttctccgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58247 - DNA, 620 bp, Glycine max
  Peptide Sequence Number=SeqID_149932
atggggacgaggggttgcatcagttacaatctcgttcttgctataagacaacttggctaccctatgagaggggcaccactagaggaagagatcgtacctgtcatttcacgaggtttcaatagaccgatgtggagacacttcagaagtttgagaaccgctaaaagggaggaagttgaggcaccagaggaagacgaagaggtgcaggcccttaaggcagaactcgagcaagctcaaacagtcaaagaaaggttcaaatcagtggctcttaggatccgaaaggagaatgccgaattgagagatataaatacagctaccgcaaaagcccttgaacaagaaaccaagagggctcgcaaggaagagcatggccgagacaaatttcgtggagctttgtggggcagcaacagtgagctcaagcttcgaagggaagagagagaccagtcacgagcacatagcatggtcttgaaagaggagttagctgcttgctcaaggtccaagagaaacttgtctcagcatttatgcgagacaaagaccaacatgttagccatcgtcaacaagtaccaagaagaattaaatctagccacggcccatgagcacaaagtggcggacgagtatgcccgagt

SEQ ID NO: 58248 - DNA, 276 bp, Glycine max
  Peptide Sequence Number=SeqID_149933
atggaagttggaagtggaagttactggaagttggaagttggaaatgaaagttactggaagttaaaagttgaaaatggaggttggaagttggaaggggaagtggttgtcatcatcaaaaagggggagaatgtaaatcatgaagattttgatgatatcaagaagaatttgcttgagaaagagggagatgtaaatcatgcaagctttgatggtgtcgagaagaaatcatatgtttgtcatcatcaaaaagggggagaatgtgaatgtatgtatacatga

SEQ ID NO: 58249 - DNA, 522 bp, Glycine max
  Peptide Sequence Number=SeqID_149934
atggaaagtggtcatcaaattgggagggaccgtatgaaatcaaaacggtttattctaataaggcctgctcgattcaccaaaaaatatttaaagcaatataaaccaaccattatggaaaatccctatcactctcgtgcaagtctacttgcagtcctagttcacgctgatttcacctacgaaaacaccgtcaactcgctcctcacatccctcgtcaactctgtcgcctttgccaaccacaaccacaacaaattcaccgtcctcgcctcctccgacaccatctacagcctcttccagtgccgcagcgacctcaccctcgactgcatattacagagcaagagtctggtcaggacctgctcgaatcgaaaagagaggagaatctttaagaaggaattcccaggttcaaagaagtatttacgaagtacaaagctaagacaagaaagaggacttcgagctattgggcaattcgaactggtgtatggacgagtcgaagtcgaggcagcaagagttctggacttagcgtaa

SEQ ID NO: 58250 - DNA, 345 bp, Glycine max
  Peptide Sequence Number=SeqID_149935
atgaagacaattgatctgaaatccaaatatgtcaagctcaagccgtctcttgcaaatttagagaaagaagagaaggatttagaagaacaactaaaaacaattcaggataagcttgtgactgttcgaaagcaaaaagatgaaactattgcagctaaagcaaaagtgatcaaaactcaggaagaaactcttgcagctgcgaaaattattgctgcacctttagtagaacaattacagaaagagatctctccaagaaaatcaggcctagttatttgcagaccccaaagttttgatcaagaagcacaacaaaatgagacttgtctacctgccttgaacatttttgcttga

SEQ ID NO: 58251 - DNA, 177 bp, Glycine max
  Peptide Sequence Number=SeqID_149936
atggcactgaagctaccacggcacacacaaccacggcagggcagactagggcacaacagatgttgccttctcgacaaagccaaaggtactaaactaactggtgttggtggtacattagtaccaaaagtatgtaataaaccaataccatttcaaggtagacagacaataccaggatga

SEQ ID NO: 58252 - DNA, 3993 bp, Glycine max
  Peptide Sequence Number=SeqID_149937
atggcggaggaggaggaagacgacgagagcttcggcgacttcacgttcgcgtcgtttccgagtcaaccgacctcaaacgacaccaatcccgtcgacgacgacgacgattggggcgacttcatgaaccattccaatcagatcaacggcaaacccttcgacgcgttcggggttcccacggatcccacgaacaaacacgtgaacgacaacaacggcgttgccgttcaggccgaggcggcgaaaaagcctaaaggagctatcccgctttcgatcttcggcgaggaggaagaagaagaggaagagcaacaggagaaacccgcttctgccaatgttttctccaacggtggtgcggtgaaaaggggatccgattcgaacgggtccgttggaatcagcgatttgatttcgagtttgtataaccagcagcgccctcaggtggattctcacaacaacggatcggtttcggtatccaatgttgatgctcccaattcgacgaactcgaacggaagcaaattgaattcggatgaggtggatgaggatgatgatggatgggaattcaagtctgcggaatgggaaactggaaccaagagccaggatgttaaggtaatagaccgaatttatttgaggttgtggattattgaacttgaagctgaagagaatgctggaattgataagtatgctgaaacgccaaaacatgatagtggtgctcttgatgtcggtactgtgttggattcatccaatgggatttcagacaaagctggtggatggcacatggagtttgagttcagtccacgttttgcatcgcaagatcatattaacccacaaccaagtccaaaaaatgaatcaaatgacattggaactgggtttgccatgtttaatcaaaattttggggagtttagttcagggtcagggccagggccaaatcaaaatttggaagcaccgaagaaggctggcatttgtgccactaatatggaattactcaaattcaatggtgcaactccccatggtactattgattcatctctcacgtcagaatctcatcaatctgatgaatggaacttcggatttaatttcaattctagttatgtgggtgaagacaatcatagttcagattcatatttcaaaaccaaaaacaaccaggatgataacaacagaaacaatgcttccccaactaatatagatgttgattcacatgtcaatttctttgactcagagagtgatgttacacaacatgagaagcccctaacaagcccagagaatcgtagggaagccttacctctgtcaatttttggtgatgagacaccagatactgatgaacatcctgtgtctcaagatttatctccctatacaccctcatccccaataaggaacagcttcactagccctggttccaacttttctatcaatgacatatggaatttatataatcaagctgaaaaccaaagttcttctaatgtgacaccaaaagcaagtgaaaatcagattcatgccccccctgaagtatcgggctccagtttggttaccggtaatgatgatttagatgatgacttctgggactataaggatgccgcaactgaaacaagatttaccaatgaatctgcacagaaaacttcttcaccacaagtcaatgagaatgggttgcagtcttccccaacatttttaaattctgatttgaccaacggtgatgatgattttgaggatgattcatgggaatttaaggaagctacctctggaacaattaatcaagatcacacatctactcttgatcacagaggtttaccacagttatcaacaaaactagagcaggttgattatgcagagttttatagcaaagtgaaggatgaattgtgcaattatgttctgttccatcttcagaatctgaagaaaactcaaaatgttgctgctctctcgggtgaagatgccaaagcaaaagctcttcaggaggaaatatcggaattctccaagatactgcatcaggatactatgagcatccccaatgaatatctctctgaggattattgcccaagaaatgtccgctttaatgagcttcttgaagttttgaaggaacctaagttccaacctgttgagtcagaatatcaactagcatcaaggttgtcgatggctgagaaggatattaaatatggtatggaacttttgaaagatacagtatcaacattaagaattctcaagctgggatcaagagaagaacaatctagttatcttaccatatggtccaaaatagcctttgtttgttctcaagagctgaaacatggtgcttatgtttggaagcaagctgtactacagaatgttcatgaccagatattatctagccagaaaggtgttcagtatatccttgcacttggagaaatttatagagtggcagaaattattgaagcttcagccaaacttcataaaccttggatgttgtcaggacttgaagaagcccttttgagtatagcaaatcagaataattttgagctagatggcatttcaagggaattagttgaatccattaagtatattcatgagcttgatgaacatgcacttcagagctttgtcatctctggagaacaaactacttgccagttgtcagccttgccagctggtttcataccagtcgttgcacaagtgagagaggttgaaggcggcgtgagaatgttggacatcaacctattcagagaggagaagggccacaaccctgaactcatacgcgaatcccaacgccgtcgtttcgccagcgtcgaaatcgtcgacgaggtcatcaatctcgacaaagaatggcgaaaacgtcaattcgagttggaaaatctccgcaaggaattcaacaagatcaacaaggaagtctccaaactcaagcgtgctggggaggatgcttctaagttcattactgaatcagaggagaccaaaaaatcgatagcggagaaagaggttgaagtgcgggaaactctgaatctcttgaattccaagttggaaactattggaaacctcgtccacgattccgttccaattagcaacgatgaggccaacaatgttgttgttagatcgtggggagagaaaagagtggagcctaagctgaagaatcatgtggatctagttgagcttctcggtattgcagatacaaagaaaggagctgatgtagctggaggtagaggtttctatctcaaaggagatggtgttcgccttaatcaagctctaataaactttgggcttgattttttggataaaagggagtatactttattgcatactcctttcttcatgagaaaagatataatgtcaaagtgtgctcaactagcccaatttgatgaagaactttataaggtaactggtgaaggagatgacaaatatctgattgcaacagcagagcagccactctgtgcatatcatttagatgattggatccaccctacccagctaccaataagatatgctggatattcatcatgctttcgtaaagaagctggatctcatggtcgagacactctaggaatattccgagttcaccaatttgagaaagtggagcaattttgcctcactagtccaaatgacaatgattcatgggacatgcatgaggaaatgctgaagaactctgaagatttctacaaagcgttaaatcttccctatcaagttgtttccattgtatctggtgcattgaatgatgctgcagcaaagaagtatgatctagaagcatggtttccagcctctcaagcttacagagagctagtgtcctgttcaaactgtacagactatcaggccagaagattagaaattcgatatggtcagaaaaagagcaatgagcagatgaagcaatatgttcacttgttaaactctactctaacggctactgagaggaccatttgctgcatactggagaacaaccagaaggaagatggggtagagataccagaagtcctcagaccattcatgggtggaaagactttcctgcctttcaagagccaaccatctaatgaagccaaagggaagaaatcgaaggcctaa

SEQ ID NO: 58253 - DNA, 611 bp, Glycine max
  Peptide Sequence Number=SeqID_149938
atgggtcatgaagataaggagaaagatgatgataacaacaataccatcaataacgatgatgatgatgatgatcatgttcctcaacaacaacacacaattacatgtggtcatactagaacgagaggagatgaggaggatctacttcatgacatcaacgtatacagaaaagttttgaaccttgctgttctggatgaaaatgaaaaggcttcatgcttagctgaagagatagcagaagatctagagaacacgaaatgcgaagactttcgtgactactaccctctgcctagttacacctccagaattcctagcttccaaaagagtgtaaacaaatgcaagatcaacatcaacacaacaaaagatggggtcatcatgcctgtttgtgtgccaaagttggactccgatgctttgttttccaattataccaaatctaatcgcttctctaagtatctcaataattccaagtacaagatagcagggattggttccgaggacgattggatggttcttattatcagcaccaacacttcttctggagatttctcctctgcaacttctctgctttctggggctttgaagggtcactaccttatgatggcattcttcttgagcac

SEQ ID NO: 58254 - DNA, 699 bp, Glycine max
  Peptide Sequence Number=SeqID_149939
atgctgaaagtgaaaccctacatttgcacaacccattaccccttttcaatttcagatcaccctctctcattcccaatctccattctcaatccaatttctcttcgcctttcgcaatcgcatccaactcccacaatcccatgcgctaagaggcgcggctggtcccaaccatccaatcgaaaaattcttcaactggcttccaccgtcgcgttcaatctcaagatcctgccggagcccttcaattccctcgctggcgaaatcgcgcgcggcgattctcagactctgagctttctcgtcggtggtggccggagagggaaaatagcccccaacaggagggtaacgaagaagaaatcggcgtggttcgcattcgtgttggtctgcgttgcgggtggcctctggtcgtggaggattcaagagtttgacctgttcctgagggcgttgtcgttttgtctcgcggggatttcgttgcttcgcttgtggttggggaagaaagccgtcagggaatgggttttagggtttttctttggggttgttttgattttgagttccagattggggaaagaggacgtgaaattttgggttcacaaactcgcgtcttctccggttacgcaaattgtaactacgatcaaaagaagtgttcaagagaatgcctttgagttgctgttatcatcagcgaatggtacatggatacattgtttttaa

SEQ ID NO: 58255 - DNA, 300 bp, Glycine max
  Peptide Sequence Number=SeqID_149940
atggagcctcagagatctcactacagagagataactaaaataatacttgaatttatgactgcaggggaattcagctgtgaggttggcactgatggtaaagtgttgatatctggagtaactacaactggagagaatactgtatccaggagttgtcatgaaagggaaatgtacatgatggcaaagttctgtccaatcagagtccttccatttattccaccacaccaggcaccaacgaaggtggcttgtatgccctgcataaatgcacaatcatatcatccacaatcatatctgtctatttag

SEQ ID NO: 58256 - DNA, 1356 bp, Glycine max
  Peptide Sequence Number=SeqID_149941
atggaggtcattcacttatggtctgctccaaggtccctcagtaccactgtcatgtattctttcgctcagagggatgacattgaagtgcttgatgagccactctatgctaatttccttcgagtcactgctgttcatagaccctacaaggaggaactactctccaaaatggaatctgatggaaataaggttgttaaggacataatttaccgtccaggaaacagcaagtatagattctgcaagcacatgtcgaaacagaggatactgggtttgccggaggatctaatgaagaaaggaaagcgcttcattctgataagaaatcctcttgacatattgccatcctttgatgaggttgtccctccttctttttttgagttgggattggcagagctagtttgtatctacaatgaactttgtgagattggaaaaccaccacctgttgttgatgctgcagaacttcagcaagatcctgaggctactttacgggctcttttcaatgatttggagattccttttcaacctgcaatgctcaattgggaagcaggtccaaaaccaatagatggcttatgggccccttggtggtataaaactgtacacaaatctactggctttaaggaagaaaacaagtatcctcagattaaatcccataagaaaatccgctatttggaggtggggtcgaaaatcctggctgaagaagccatcccttctaggcactcccttacctactcctctgatcttccagttcctgcaaatgagaaattgcttgcctgggttggtaatgagattgtaccacgtgagagtgcaaaggtttctgtgtttgattcagttgtccaaggaggtgactcagtttgggagggtcttcgagtgtataatggaaagatatttaagcttgaggaacatctagacaggatgtttgattcagcaaaagctttggctttcgagaatgttccaactcgagataagattaaggaagctattttcaaaaccctgattaggaatggaatgtttgacaattcccacattcgactttctctaacacgaggaaagaaggttacttctgggatgagccctgcattaaatctatatggatgcacattaattgtgcttgctgaatggaagccccctgtttatgataatgagcacggcatagttcttgtaactgctacaacacgccgtaattccccaaatgcctcttctagtgttgcggcaacctcaccaacaaccagtgctctcgctgcgtgtcgcatgcgatcacccagctcggcaacctttgcttcacttcctgcgacggcgcgttgcagcttgacagctgtttcatcaagtatgacaatgtcaccttcatcggggtcgaggaggtga

SEQ ID NO: 58257 - DNA, 435 bp, Glycine max
  Peptide Sequence Number=SeqID_149942
atgtaccggttccctttatctttcagaatatttttgcaacattcgaagcatattagcatttcaattggcagaccacatgagaactgtccatcatttaacaacttgtatatgctagatggacaacaaatatccatatcaagtcctggatttatctatgaatcctatgaacctcgtgagaaaatcccatttgggaagagaaaaatcagcatgcaacagggacaggcagatatactcatagttaggttccctgaccctaactatggtgttaaaacgcctctaccaggccaaaacgaaggagacttagtatggattttagaaaacaaagctagtaacagtgctctgggtcaaacacccacatcactatatgagagagttgagagcatttcgggttttacaaaggaacatcatttggaaattccgaccacgccaatgtga

SEQ ID NO: 58258 - DNA, 570 bp, Glycine max
  Peptide Sequence Number=SeqID_149943
atggattttaggagatggaggcatgataatacgggattttactctactaatttgccatacaagttgctaatttctgccggggttgaggagcaagtcgacacctttcctttattgtggaagttgaagataccaactaaagtggcattcatggtgtggagggctctcagcaatcgtttaccatcgaaggacaatttgaagaaacccaatgtgatcaatgaggaggccaagctgatgtgtggtacatgtcaacatgattttgaatcaactcaacatttgtttttatcgtgcaaaagtggcaacgcaaatatggctaaaatgttatgcttggacatccccaacattttccactgtccaacatggagatttagtgggccatctcaagcaatttgcagggcgagaaataacaagattttcaacaatattgaagtggacattctgaaattgatggaggatataaaatttcaatcctggtcatggctatatcatcaacaaccgggatctaatcattcaattgtgctttggagtggcaatcctgtggcatctattggaggtgggaaagtgaagctgtga

SEQ ID NO: 58259 - DNA, 477 bp, Glycine max
  Peptide Sequence Number=SeqID_149944
atgctggaaagttttaaacaacaagaacaaatgttagttctagaattgtacatagaaaaggatatggctggtggttcaatgtttcattctggaaattcgcttacatcatgtggaaattatttatccaatgatgagacacaatcgccaacaaatatgagcaatttacatgttaacgaagatgatgatgatgattatcttgtgtctaactcatacattgaagagtctttagacgaagatgacagtgttgacggtatatatgatacagacgataaagtcactgatatgattcaaccagtaagaattgctcacccagcagaagtgtacaaggaattcaaaatccattttggaatgatgctttgcattataataatatcaactggagtcatcctgatgaggaggatatttgtggtttggagataccatccagttttaatgttagccaagaattatatgttggcatggacatttgtggtttag

SEQ ID NO: 58260 - DNA, 336 bp, Glycine max
  Peptide Sequence Number=SeqID_149945
atgcttctcaaagaagatgatcatcggcatgagagaagagtcgtgagttcgagaataagatttcggaaactttcaggtggaagagaagatgaaagtttctttgaatctctgtggagggacatacacatgaacaggcttcgtcatgatccttccaatgatttgaatttcgtaattgtttctcacggtttgacatcgcgtgttttcctgatgaagtggttcaagtggacagttgagcagtttgagcacctaaacaattttggcaactgcgagttccgcgtaatgcagctggaaagtgatggagaatacagcttagctgtaaatcacacagaggaataa

SEQ ID NO: 58261 - DNA, 543 bp, Glycine max
  Peptide Sequence Number=SeqID_149946
atgggtcagctgaccagtctgagctattttatggttctgcacaaatgtcaaatgcacacacactttcccatgattgctacacgccacccagcaccagctacacgattccatgatgaagtcggtggtggtgctcttgcctacgccatccttgtcagaggtgatgacaacaatgcgggggatggagtcggagagctcgggcttacgattccactggaggagggcagagggggatttgggttttggaggggaagaggggagaatgggggtggaggaggaatgcgaagttgggggcggtggtggcgtcgggaagaaggtggagagatgagattgggaaggggagagagggagagggagaagaagatgaatgatgatgaagaagaagcacaatggttgacttcgagcttcgttgtttggttaccgtttatcagatgggatcatacgaggtacttggctgagtgcgagttcgaagcccttaaggagcgtgtttcagggaaaagaatgggcttcagaagagtctcttgtataaatgcctcaagtgaatag

SEQ ID NO: 58262 - DNA, 816 bp, Glycine max
  Peptide Sequence Number=SeqID_149947
atggttgagcaatcggtgctggtgctcgaaaagcaagggccaaatccagtgttatcagaaggaatccacgattgggtgtttgagtgccatgggcttttgcacaatgcggttttgatcatcgcttcttttcttttcgtcttgtacttagcactgcaagctaaaaagagcttcctcagactctcccatggccgctcttatatcattatatcctattacgcttccctctggcttgtcagcatccttaatcttctttggtgcttttcccaggcatgggagtgctctcctgggaaagagttcgcatggaacttgttatccctctttactacttctggaatgctgtttctagaagtgagcttgcttgcttttttacttcaaggaaatagtaccagtggcttagaagcgttgacgcgaacttttggtatatcagggattattgttggttttgatatcttgttgaagtggaacttgtgggttatccacaagctgctgcttacccttgtttatggtttcatactgttcatgtatcattctaggtggagagaaaggttacctgcaaggcctgcttactataagtatgttaccattatgttcatcttgaatgcaattgcgctgtttgcttgtggcattactggaaacggcgctgcttttggtttctggttatatcatttcacggttgtatgttaccatgctgcctatcttcccctgctgtatataaccttcctggctgacttttttcaggaggaagatttgcatttggagaatgtgtactactctgaaatgaaagatgctggtttctttgaagcagattggaactga

SEQ ID NO: 58263 - DNA, 258 bp, Glycine max
  Peptide Sequence Number=SeqID_149948
atgtaccatttcttgttctcagtcacaacaatccaagtagatgtaccctctacttgtaccacaaaggatgtaccctccaatgtgttaagacaaagttctcagacgggaagaatcaaaagaattctcagactgtgtcgttttgaattctttgacaagggagaagggagacacaaaagaattcaggcggttagtccttcgttcttttggaaaagggagaagagagacacaaaaagaattcaggcggttagtccttggtga

SEQ ID NO: 58264 - DNA, 1968 bp, Glycine max
  Peptide Sequence Number=SeqID_149949
atggcggaaacgcacgaagacacaccgaaagaaaccgttcacaaagaagaagaagaagaggaccaaagcttcgaagagctcggcgtggacgctcgtctccttcgcgccctaatcaagaaaagaatcgagaaacctactccaattcagcgcgtcgcgattccactcattctggaaggtaaggacgtggttgcacgtgccaaaacaggttcgggaaagacactcgcgtaccttctcccgttgcttcagaaactgtttactgctaactctgatcggaagaaactcgcgccaaatgcttttgttcttgttcctactcgcgaactaagtcaacaggtatatgcggaagtgaagtctctggttgaattatgcagagttcagctgaaagttgtgcagttgaatagtaacatgcttgctaatgacttgcgggcagcattggctggacctcctgatattttgatctccactcctgcttgtgttgcgaagtgtttgtcctgtggcgtacttcaggcggcatccattaatgcatcgcttgaaactcttgttcttgatgaggcagatcttctattatcatatgggtatgaaaatgatattaaagctttaacacctcacgtacccagaagttgccagtgtcttcttatgtctgcaacatcaaggaatagaatgggtattcccagttatagattcagtgctgatgtggacaaactaaagaagttgattctgcacaacccctttattttgactttgcctgaagtgggaaatcataaggatgaggtcattcctaaaaatgttcagcaattctggatctcatgtcctgccagtgataagttactttacatccttgctgtgttgaaattggggttggtccaaaagaaagttctgatattcacaaataccatagacatgagtttcaggttgaaacttttcttggaaaagtttggaatcagatctgctgttttaaatcccgagttgcctcagaattctcgtctccatattcttgaggaattcaatgcgggcctgtttgattatctaattgcaacagatcttagccagtcaaaggaaaaggatgaagtgcctaaggaaagtattgttggatcacggaagtctagaaaacatgctaaaataaaattagattctgaatttggagttgtaaggggaattgactttaaaaatgtatacacggttataaactttgaaatgcctcagagtgttgcaggatatgtacatcgaattggacgtacaggaagagcatacaattctggtgcttctgtctctctggtttccacggatgaaatggatactttagaagaaataagatcttttgttggggatgatgaaaacaaaggcacaaattccattgctgagtttcccctcctcaccaagaatgcagttgaatctttacggtacagggctgaggatgttgcaaagagtgtgactagaattgctgtccgagagtcacgagcccaggatctgaggaatgaaattttgaactctgaaaagttgaaaacccacttcgaaactaatccaaaagacctagatctactgaagcatgacaaaattttgagcaagaatgccccacctcctcacctacgggatgtgcctgagtacctattagacaaaccaacgaaagaggcaagggaaatggtcaagcttgcaagggatgcaatgggaaataataatcgccgcaagggatccaagagaaaattaagaaaagaaggagaccctctgaaggctatctatgctacggcgtcatcaaaaagaccgcacaaagctaggaagactggtggaagcgatagcctaaatagcagtgataggcataaacacaaaaagaataagggtccaaatatcgtaaaacgaaaaacagtacaaatttcgctttcgtccatgtctcttgtctcgcatggcatgtggcatgcggaagatcatattggtgacactagaatgtcttcccattccaagattgttgtggcttag

SEQ ID NO: 58265 - DNA, 189 bp, Glycine max
  Peptide Sequence Number=SeqID_149950
atgtctgccagggtccagcctatagccttcttatgcttcttgagaacagacaacaacttctcttgctcatcaacaagggagacagatataatcactggaaaacttttgctgtcatccaagcttcaattctggtgtggccggctagatagtggtagaaagggagatggtttttcagcctgtaccacataa

SEQ ID NO: 58266 - DNA, 123 bp, Glycine max
  Peptide Sequence Number=SeqID_149951
atgggggttccaatggcaacgaagcccactagggccttccaggatgttcctccagaaggcggttgcttctggaggaagcaacctagctcgcctgggcgagctgagctcgtttgggcgagctgg

SEQ ID NO: 58267 - DNA, 117 bp, Glycine max
  Peptide Sequence Number=SeqID_149952
atgcatgatagtatcatgtttgaagaagttgatatgaatgttgaaaatgagaaagatgttggcgtgaaagtagaacatattgattgctctgatgcctttaatacttctcagggttga

SEQ ID NO: 58268 - DNA, 498 bp, Glycine max
  Peptide Sequence Number=SeqID_149953
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggtttaaggctaaaactgaaaggacaagttttggtgactgcgctcctccaagccagttacctcggttcaaagagttggtag

SEQ ID NO: 58269 - DNA, 162 bp, Glycine max
  Peptide Sequence Number=SeqID_149954
atggaagacgcacccgtgagccccgcgtcgccctcccgccgaagggtaggttacgacactatcgaagaccacatcatcgctgaagagccaagaagagtcacccaggaagattattcaagttctaatgtgccacaatttttcaccagcattgctcaaccagaa

SEQ ID NO: 58270 - DNA, 332 bp, Glycine max
  Peptide Sequence Number=SeqID_149955
atgtcgactttgaaagaacaaatggattctatgatggagggcatgctgggaatgaaacgactaatggagagtaacgcggccaccgccaccgccgctagcacggctgccgaggcagacccgactctcccaattactgcacaccatcccattccaaacattatgggacgagagggaagcacactggggcatgtcagcaacccccatccggggtacaaccgaggtgcttacccctacggtttaccacccaactacacaccaccagccatgcatgaagacgtgggtcacgttactcccctcatcctcgaaggggagcctcctcggcatcctgacgg

SEQ ID NO: 58271 - DNA, 321 bp, Glycine max
  Peptide Sequence Number=SeqID_149956
atgaaggcccaagtggagaaggatgaaggcccagaggcagagacactatcaagactattaattgttgctgaaggcccaagtaatccttgtggcgtctacccagacttatcttccttcactggaagtggcgtctacccagacttatcttccttcaccggaagtggcgtctacccagacttatcttccttcactggaagtggcgtctaccctgacttatcttccttcactggaagtggcgtcatccaaaccttcgtagcctgtatcaaacgatccactcctactcaggttcacatcatctggtatcagagctttggctcttga

SEQ ID NO: 58272 - DNA, 198 bp, Glycine max
  Peptide Sequence Number=SeqID_149957
atggaaaattctgaaaagaaaaatcatagtgaaaagaaactgaaagcatacatcacatgggatgaaaatgatttggaatcctctgaagattctgaaaatgaagagataaatctctgccttatggccaaaagttacgaaagtgatgaagagaagaggacatggcatatcaacttgctacttcaagaaaaattacagtaa

SEQ ID NO: 58273 - DNA, 603 bp, Glycine max
  Peptide Sequence Number=SeqID_149958
gatggacccttgggtactagtaccctcgtctccagaggactatacgtcctcaccttcaaagggctacacgtcctcaccttccgaggactacatgtcctcatcttcagaggactacatgtcctcacctttagagggctacacaccctcggctctgaggactatacagggctacgcgccctcgccttcatagggctgcacgccctcaccttccgaggactacatgtcctcatcttcagaggactacatgtcctcacctttagagggctacacgccctcggctccgaggactatacgtcctcatcttcagaggactacatgtcctcacctttcagagggctacgcgccctcgccttcatagggctacacgccctcaccttccgaggactacatgtcctcatctttcagaggactacgcgccctcgccttccgaggactacatgtccttcacctttccgaggactacatgaactcaccttcagaggactacacgtcctcgcctttcagaggacaacatgtccttcgcccttcacctttctgaggactacacgtccttacctttcagtgggctacacgcccctcggcctttcaaagggactgtgttaa

SEQ ID NO: 58274 - DNA, 206 bp, Glycine max
  Peptide Sequence Number=SeqID_149959
aggatcttgaagaggacccagtggagttacctcctgaacctactatggacgcccttgacttacctgaggatgatgaagacccactccctgatgttgattctccagaggatattatgtcagcatctgaggcagactctacagaggagagtggccctggagggacagcgaatagtgacgactcttcatcagagcagatggctccttag

SEQ ID NO: 58275 - DNA, 361 bp, Glycine max
  Peptide Sequence Number=SeqID_149960
gctgccgtcccttgggacggacgtgtggggtgctaataccttccccgtgcgtaaatacaactcccgaacctttcacttaaaagttcgtagatcacgtcttttccggtttttccgacgttttcctcaaatagacgttggtggcgactctgcgcgtattcctttcgtggaacaggcatcccgcgagtcacgcgtcgcccttccgctgaagggtgtacccctcgaatctccccaacaattggtatcagagccattggttcaagttggtgactggctcagacaagtatgcaagtaccgcaggtggccagaatggctagcgggcagggcaagtaccgcaggtggccatggctatactcgtcgatga

SEQ ID NO: 58276 - DNA, 570 bp, Glycine max
  Peptide Sequence Number=SeqID_149961
atgagtggtggagttgggaagcccggcctgttgcgccagctcggggcactggccgccggagccgtacggggttttttgccgcgtttcgcgggcgcaggggttgccataacatctccacagtcattgcagtatgactggctggcatttagccagcgtaatgacgtggatggggcaagagtgagcaataaaaccgcaacgctacagcagcagctggcacaacgcatcatgattctggacggtggcatgggcaccatgatccagagttacaaactggatgagcaggattttcgcggcagccgcttcgctgactggccgtgcgatgtgaaaggcaataatgacctgctggtgctgagtaagccggacgtcattcgcgaaatccacgatgcttacctggcggctggcgcggatattctcgaaactaacaccttcaacgccaccccgattgccatggccgattatgaaatggccgcgctgtcggcggagatcaacttcgaagcggcgaaactggcgcgcgcctgcgccgacgcgtggacggcaaaaacacccgaccgcccgcgctacgttgctggc

SEQ ID NO: 58277 - DNA, 111 bp, Glycine max
  Peptide Sequence Number=SeqID_149962
atgggttcaaaaatctaccctaaggttcatgagaaccctaaggccttctttagtagctctagcccaatcctcttggagtcttctatccaatacccttggggggcattctga

SEQ ID NO: 58278 - DNA, 674 bp, Glycine max
  Peptide Sequence Number=SeqID_149963
ggctgcacgccctcaccttgagaggactacacgtcctcgccttgagaggactacacgtcctcatcatcagagggctgcacgccctcacctccagaggactacacgtcctcgccttgagagagctacccgccctcgccttggggctacacggcctcgccatcagaggactgcatgtcctcaccttcgtagggctacacgccctcacctttagaggaccacacatcctcaccttcagagggctacacgccctcgccatcagaggacagcatgtcctcaccttcttagggctacacgccctcacctatagaggactacacgtcctcgccaacagagggctgcacgccctcacattgagaggactacacgtcctcgccaacagaggactacacgtcctcaccatcagagggctgcacgccctcacctccagaggactacacgtcctcgccttgagagggctacccgccctcgcctttgggctacacaccctcgccatcaaaggactgcatgtcctcaccttcttagggctacacgccctcacctttagaggactacacgtcctcgccaatagagggctgcacgccctcacattgagaggactacacgtcctcgccttgagaggactacacgtcctcaccatcagagggctgcacgccctcacctccagaggactacac

SEQ ID NO: 58279 - DNA, 402 bp, Glycine max
  Peptide Sequence Number=SeqID_149964
atggcctcgaggaagcttgcctcaaagaggtccaggaaggataaggcggccgaaggaactagttccgctcccgagtatgacagtcaccgctttaggagcgctgtacatcagcagcgcttcgaagccatcaagggatggtcatttctctgggagcgacgcgtccagctcagggacgacgagtatactgatttccaggaggagataggtcgccggcggtgggcatcactagttacccccatggccaaatttgatccagacatagtcctcgaattttatgccaatgcttggccaacagaggagggcgtgcgtgacatgagatgctatcggctagctcctgggatatccgttggtgctggaagagggccaagagtgcgagtatggccagaggaggaaccagtctga

SEQ ID NO: 58280 - DNA, 114 bp, Glycine max
  Peptide Sequence Number=SeqID_149965
atgattgaaggcactgcagataacttgggaaccaaagatcacaatgatcaaggaatccaaggacttggcgtcaatgttgatggaagctctcttcagaaaattgcttgtatatga

SEQ ID NO: 58281 - DNA, 846 bp, Glycine max
  Peptide Sequence Number=SeqID_149966
atgacgctcacccgaagcgccggcgcgaaaacagatgccacgctgcgtatcgatctcggcgggctggatacgccctccgtcaaagagccggagattgcctcccggctgctgctggacaatgtgcctctgaagctggacaagcagcgctggcagctcacgccatggcacctgaaaacggacgacgcggccaccatcaccgcctttctgaaaaatattcaggaagggaaggccctgaccctgcgcggcggtaagcaggtgatttccctgagcggtctgaaagccgcgctgctgtttattgatgcccagcaaaagcgtgttggcagtgaaaccgcgtggattaaaaaaggtgacgatccgccgttaagcgtgccgcccgcgcccgcgctgaaaaaggtggcgaccgttaatcctactccaacaccgctttcccacgccgaactgaatgacctgctggattatggcaccgggcggatgaacagcagccagtgctcgctggatcctaaccgccgcgaagtgcgcgtcaccgcgttaaccgatgaaaaagcgctgttgatcgtcagctgcgaggcgggggcctataacaccgtcgatctggcatggctggtgtcacgtaaaaaaccgttctctgcccgcagcgtcaggctacgtctgccgtttacgccgtcgagtggcagcagtgaaatggaattaatgaacgccagcttcgatgagaagacgcgcgagctgaccacgctggcgctcgggcgcgctgcgataactggaatgggccagatgcctggcccacgttgtggatcacccgctagcttcgacttacccggcctacaaaacatccgaactgtaggccgg

SEQ ID NO: 58282 - DNA, 261 bp, Glycine max
  Peptide Sequence Number=SeqID_149967
atggccacaatgatggaggccatgatgagcatgaagaagataatggaagccaatgcggttgcagttatcgctaccagcgctgttgctaaggtgaacccgatgcccccatctggcctcaaccaaatgaatcatccaacctcagctagggtaggccaaatgaaccctatttatgcgcaaattcaaaacaagcatgccttcccaccatatggcttgcctcccaactatacaccacccaacgtggcatacactcccaatgaggat

SEQ ID NO: 58283 - DNA, 813 bp, Glycine max
  Peptide Sequence Number=SeqID_149968
atggtggcgccaatacacaccgtcaagcaagccgccgaaaccatccacgttgccgctgccgagattgaaaaaggcaacaacgacctgtctcgccgcacagagacccaggccaatgccttgcaggaaacctccgccaacctggaaaccttaaccaacaatatccggcaaaccgccgaacatgcacaccaggccagcctgcaagcaagccaggccaaccagatggcggtacaaggcggtgaagcattcaatgccttaaccactactatgcaaggcattaatgaaacctcggcacaaattgcccaaattaccagcgtgattgacagcattgccttccaaaccaacatcctggcgctgaatgccgcggtagaagccgcacgcgctggcgaggaaggccgcggctttgccgtggtggctggtgaggtgcgtaacctggcaaaacgctctgctgcttcagccaaggaaatcaaggagctgatcgcggcctcagtgagccagactaatgccagcgccaaacaagtgagccaggcgggtcataccatgcatgaaatcgtcaatgccgtacagcaggtgtctcatagcatacaagtgatttccgaggcctccagccagcaaagtagcggcctggaacaaatttatgaatccatgacatccattgatgaaaccacgcagcaaaatgcagccctggttgaagaagccgcagcagccgctgaaagcatgctggagcaggtgcacacgctggttgagtcggtgaatcaatttaaaatggatgccgatgataccaacgaccacggccgtttacgcctcattgcctga

SEQ ID NO: 58284 - DNA, 435 bp, Glycine max
  Peptide Sequence Number=SeqID_149969
atggaggaagctgctcaatctgaaagcactgaggccttgattgaccctctatctcccatcagacgacacgtgaagtggaagagggcccgcaccaagaaaattggtcagatgacgtatgaggcaacaaaggaaattcttgagaagattgagtcacaaggttcctttgtcccccatggacgtcaggatgtcctgattgctgccattgggcaaccagaacaccctggtcgtgtgcatgctgctggaaccggtgtgaccatgaagcaatactttgaatcggctccacgaacctcccgcacttcttcctctatggattccaaagaactagagcagctgactcaacaaattagggaccagctggaggagtcgatcatagaaaaagtgactcggcaactgatgttatccttcagccagatgcagtcccagtttcagtcatag

SEQ ID NO: 58285 - DNA, 258 bp, Glycine max
  Peptide Sequence Number=SeqID_149970
atgtcggtgcgcaactgttatgacggccaacgcgcggggatcgagtgcggcctcttcgctattacgccagcggcgaaagggggatgtgtatactggcttactatgttggggcttcctcgtctgactcctaccgctcggtcgttcgatgcggcgacggaaagtggtccctacacggggcggaattcgatcacgattgttatttttgccagaaaacttaacggaagtgcagagggccgcggcaaagccgtttttccatag

SEQ ID NO: 58286 - DNA, 267 bp, Glycine max
  Peptide Sequence Number=SeqID_149971
atggggatcgcacccacaaagacacccagtggacctgaagaagtccaacagggtcctggggtttccagctctggttacgggcctctattagtcctacagggtgcccgtaccccccctagcaaggtcatgccatcccgacatagggatcgcgcccgcaagacacctagtggacccgaagaaggccaacagggtcttggagttgccagctctaaatacgggtctctgtcagttctagggagtgcctgtcgcccccagcaaggtcattag

SEQ ID NO: 58287 - DNA, 189 bp, Glycine max
  Peptide Sequence Number=SeqID_149972
atggatgaatgttccgtccctgtactacttgttattatggatgcgaaatcttatcggcaagtgtaccgagtcgtgcagatgttcatgtgttctatactgaggacaacattcccaaacatcgatgtctcgcatgaatggactaattctaataaaactttattctcggatgtctcgtcgaacttagcttaa

SEQ ID NO: 58288 - DNA, 252 bp, Glycine max
  Peptide Sequence Number=SeqID_149973
atgtcacgaaaccttatggattacgcaatcatcccttctttggcttctggaatgttccaaaacttttcggattgtgccttaacatgtcctttcaactcccgacatgtcacggaacttcacggattgcctaacgatgagtgtcaagtacctcaaagtggtcaagcaagggtcgcaccccaacaaacagatgatccccgaacaaaattagggtatgatagttgcccctctttacttgtcttttattggagataa

SEQ ID NO: 58289 - DNA, 516 bp, Glycine max
  Peptide Sequence Number=SeqID_149974
atgacggctgatatggtggccttgaaagatcaaacagcttccatgatggaagccatgttaagcatggagagaataatggaaagcaacgcagccgcagttgtcgctgctagtgccgccactgaggcggatcctacccatccatctgcaataaatcaatcacatcaacccgtcccagacatggtgggacaaggaggagaggtgttgggcagcgccagtggtccacacatggggtatataataggaatgcttacccctatggcctaccccccaattatatgccgcccgctgtgcacatggccaaagagaactccaatcatgtcgttcctgttacctttaagggtcagaaaccccaacctatgggaggtgcccgtgaagaacctcgggagcatgctcaaggttactttgatccatatcccacattcaccaccgaggggtcgttgtttaatgttatgcctcaacccaatactgcgagagctcctcaaccccgccctctacaactgttgcatttctcagtag

SEQ ID NO: 58290 - DNA, 813 bp, Glycine max
  Peptide Sequence Number=SeqID_149975
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgactgtcctgcctcagcctcccaagtagctaggactacaggcacgagccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58291 - DNA, 309 bp, Glycine max
  Peptide Sequence Number=SeqID_149976
atgttggggaagcttgggaggattgatggggacccggtgttgagagaaacgaggatatgggctacgtgggagtacgtgagctcagttggaggtgggcaacaggggatggtgggtttatgcgcgatttgtggatgtggaaaaacttgttgtgcaccatcgcccgaccgccacctagtaccacatgtgatggagtggtaccaggagatatgtcgcgggggtcaagagaccttggggacgtcaagtggggtgctattgcccaaaaccaagcttgaccaatcccgacccaacccgggcatagtcagtcagtga

SEQ ID NO: 58292 - DNA, 866 bp, Glycine max
  Peptide Sequence Number=SeqID_149977
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctatcaaagcaatagtagctacaccttataattggattctacacagttgtcaaggcatcaagtcgcgtctgaccaacaaatacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58293 - DNA, 381 bp, Glycine max
  Peptide Sequence Number=SeqID_149978
atgagaaaaggactccttcttttccttccttccatcgggggaaccaagtctgattgttctacctcctatcccggccaaaagctggtcccatctattctcctcttttcagtacacgagcgatggctcaggagccggacatgcatgccttgtatctcgtgctggaacaagtgcgaaaccaaccaaacacagagggcgggcaagcaacagatgatctgtgcgctactcttttgcgcaccttcggtcaacatgtgtcaaactaatcctgccagaacatgctaccaccggactttccttgccatggcagtatgcaaggaaagcgtcgagttgctgctaggtctaccaaccatccacgtttggaaagaggacgaccccaaaaattag

SEQ ID NO: 58294 - DNA, 249 bp, Glycine max
  Peptide Sequence Number=SeqID_149979
atggctccggataggatgcaactacaaaaagtgtgcaaaaagggggacggatctttcaaagaacacgcccaaaaggtggagggatctggcggcccaggtggtacccccaataatggaaagggagacgataatcgtgatggtagacacattatcggcaaatttgatcatcctactaggacgactgagaaaactggggcaaataaagagggtgaggatgagggagaaacccatgctgtgactgccattcct

SEQ ID NO: 58295 - DNA, 219 bp, Glycine max
  Peptide Sequence Number=SeqID_149980
atgactatcatggtgtcgcaacgtgcccttttgcgagcgagcgagggcgaggctcacgggtgcgctttccaaaggaggaaagatgcgcggagtcgccaccaacgtttatttgtggaaaacgtcggaaaaaccgaaggaaaccggtcgacaaaagcggggctcttgctcctacgtaccctctatcaaagaggaaatcagacctacgtagttctttcttag

SEQ ID NO: 58296 - DNA, 129 bp, Glycine max
  Peptide Sequence Number=SeqID_149981
atggctccgagaaagctttccttgaaaagatctaggagggacaccgcggctaaagggactagtgccgctaccgagtttgatagccaccaagagggagtgtgggacatgcgatcatgggtgaggggttag

SEQ ID NO: 58297 - DNA, 867 bp, Glycine max
  Peptide Sequence Number=SeqID_149982
atggataggcctgaatatgtgtggaaacaaacttggcaatggatggtagatgatattgtatttaatcatagaagacaaggcatccaactaacagacaaagaaaaaatgcatctttgtttgacggaaattgaaaacctcttgcaagccaacaggaaaagcttacgagattttccttcgatgccatatccactaggatatgccgccaagatgcaccaaaataatcttatctacaatgaattggcttacaacagggagatattggctgccaaatttgacaaatgctaccagtcgctaacagatgagcatgcttctatttttaataagattatgcatgtggttgcaactcaatcaggtggagtttattttctatatggatatggtggcacaggcaagacatttgtgtggaaaactttatcatctgctatacgctctactggcggaattgttttaacaatagcttcaagtgggattgcctcaatactattgcctggtggtagaacaacacattctaagtttgctattcttgtccctgcaacaaaaaattcgacatgcaatatccatcaagggagtgatttggctgaattgttgcatatcacaaaactcatcatatgggatgaagctccaatgtgtcatagatacagtattgaggcccttgacaaaagtttacaggacatcatgcacaacaacaatccttttggaggaaaggtcattgttttttgtggtgatttccgtcaaattctacctgttgtgccaagaggtaatcgttctgacattgtctatgcaactttaaattcatcttacatttggaaccattgtcaaattctaaagctgactaaaaatatgcgcctcgccatcaaatcctactga

SEQ ID NO: 58298 - DNA, 398 bp, Glycine max
  Peptide Sequence Number=SeqID_149983
atagctgctttggactcagagttgtcagatctctagaattttacagatggcttagaggtcttctcttaagagtaccggaaagttgcaaatgttgcctacttcaagttttcttgtgcaagaaaaatcaaagttctctccatagaggagaatttactccttcctacaagtttctattaggccagcacggaaagaatctcgcaatattcctaatgaaaagtttggtgacttctgtaaaaataaaaagcttattggtcagacaaattggtatcagacttcaaggccaagagatggcgaatggagttagttttcttgcttactactccaaatgctttttcgatgctcacaaagagacaactatgataattgagttacaagatgaaattggtcttcgctactag

SEQ ID NO: 58299 - DNA, 714 bp, Glycine max
  Peptide Sequence Number=SeqID_149984
atggctaaatcatcaaagaaacgaaagggatcttcctccaccaccattgctattggccaccaccgccatggaacctctggagacccaccaacattagttcctccctttctttcatctcctcagtcatccatattattttcctgcgatgatcagcatcagaggtactactctcaattatgtaatagagtcattctagaccctaagtaccttgaccttgaattttttgatggagaaacaattgattgttaccaagtgtttcaaaactctactttggttgatttaatgtctctcaaacttccctactttcctaaattagttaaagttttctataataatttgaaaattcaggatggtgttctttattttgaggtgcatcatattcccattgttgttgatcagtccttgttttattcattgactaaattgcccagtcaaggtgttccttttgagggcactcttatggatgaatggaaatttgattattcaagtcatgatgctcgcagaatggtttgcaatgaccaggctaacatgatcgaaaaattacttgctgggttatttactttcgattgtcgcatcatgcactatatcattgttcatattttgcttcctcggtcttcaaatcttgcccaagcctctaaggaggatttgattctgctatgggccattcaaactgttggatcgagtggcctcagaataactaagaaggggggttga

SEQ ID NO: 58300 - DNA, 108 bp, Glycine max
  Peptide Sequence Number=SeqID_149985
atggagcttacaccacctgagaagaggtatggtccctttccccctagaggacatcctaagatctcttcaaattcttctaccatgggtgatagctggaagtccccaaag

SEQ ID NO: 58301 - DNA, 372 bp, Glycine max
  Peptide Sequence Number=SeqID_149986
atgaaacatatgatgctaatgccacaaaatggtggcagtcgtggtgatgtccatgttgaggataaccaaaacatgtcctttccgtcgtgggagggaacctttatgaggtggttcagtgaaatagatgaaaagcttgctaagaacattgacactgatggatttcgtggcggtagcacttctgtatctgtaatcaaacagggtgaccaagtaataattggcaatgtgggggattctcgtgcagttctttgcagaagagcacctgacaatcaccttattcctgttcaacttactgttgacttgactccagatattccaaccatattcattaagaacttattagatgagagtttctttcaggacttctttgggtaa

SEQ ID NO: 58302 - DNA, 549 bp, Glycine max
  Peptide Sequence Number=SeqID_149987
atggcgctgaaagcaaccatttataaagccgcggtcaatatcgctgatatggatcgtcacttctaccacgacgccacgctgacgctggcgcaacacccgtccgaaaacgagcagcgcatgatgctgcgcctgttggcctggatctgccatgccgacgagcggctggtgttcaccaaagggctgagcgccgacgacgagccggagatctggcagcgcaacgaccacaatgggctggaaatgtggatcgagatggggttgcccgacgaaaaacgtatccgcaaggcctgcaaccagtcgccgcgcgtggtgctgtacgcctacggcgagcgcgccgcgcacgtgtggtggcagggaatgcagggcaaggtggccggctacaagaacctgagcgtgcgtttcctcgacgacgaacagctggcgcgcctgactgcgctggccagccgcaccatgacgctgcaggcgacgttgcaggagggaactatttggctgtccgatgctcagaatagtctggaaatccagtttgccgagtggcagcaggcacaggtgtaa

SEQ ID NO: 58303 - DNA, 1120 bp, Glycine max
  Peptide Sequence Number=SeqID_149988
gctgcctgggagattccggcgtatgagcccaccgccatgaatggtgcctggtacgaggcgcctgggcaggcccttttacaagcgattagcgaaacctttccacaacttagcctggttgctgaggatttaggtattattaccgccgatgtggatgccttgcgccacgcttttgacctgcctggcatgaaaatcctgcaattcgcgtttggcggtggtgaggataatccttacttgccggagaatgtcgaagaaaacagtgtggcttataccggcacgcatgataacgatacgacgctgggctggtatcaggttgcgccggaaaatgtgcgcaaccatctgcattactatttaaaacaagaacatccagatatgcctaatgctttaatacaactcaccttcaactgcatctcccgcctggcaattgtgcctatccaggatattctgggcttggatagccaggcccgcatgaatacgccagggacgattgacggtaactggcggtggcggatgcaatggtcccaactcaccgccgaaaaaatgcaatcattccgccatctggcgaactactctgccatttgcaaagagtttgaacctgcaaaggcgtggcaaaccattttgcaagtcactgcagatgcaatccgcccactgctggataaatatgctggaattcaggccattggcataggctttcctggattcatagatccacagacaggcgtcttggcacagtcgcccaatttgcccggattacgtaatgtcaatcttggtcatgaccttggtcagttactcggcttgcctgtacgcgtggagaatgatgccaatgctgccgcctatggcgaattctgccatctgtcgcagcctgctggaggtctactttacttgggattggggactggcgtgggtgcaggcctggtggtgaatcatcacgtctgggctggtcaacatgggtatgcactggaagcggggcatattattgtggttccggatggtcctttatgcggctgtggtaaccaaggttgtgtcgagcaatatgcttctgcgactggaatcagcagggcatatgctgacctggcgggtcaaacactctctgcacaggagattgcgctggctgcgcaaaatg

SEQ ID NO: 58304 - DNA, 432 bp, Glycine max
  Peptide Sequence Number=SeqID_149989
caaaggcatacatggcatttaggttatatgcaaggacagtgtttaaaaggcacgcagcgtgtatcatccccttcgacaaacatattgcggcagtaaagactaccagcaacaatatgttatcaaagagaaaaactctagatgagggttcactgttatcaagcaagtcggagactcagcatgaccatagattcacctccactccttatgttcctatggacccgagggaaccgacaaaagaggaagtcatgatattgcacgagattagaaggcctaactctctaaaaacaatcccaactggagtagccaactgtcgcaacctacccttcggcgggagggcgacacgagggctcacgggtgtgtcttccaagaaaggaaaatgcgcggagttgccaccaacttttattcgaggaaaacgtcggaaaaactggaaag

SEQ ID NO: 58305 - DNA, 375 bp, Glycine max
  Peptide Sequence Number=SeqID_149990
atgggttctccacctgcctccactactcctcctccttctcctcctcgtcctcctcctacttcggacgcatcagcttcgacgtctgccgtgaagcggacacgcaaagcctcatgcccacgatcgttgtccactagaccacctggtgttgagagaccagtggtgcatgttgatcctgctacagggaaggccgacggtccccacaagaagaaattaagaacatatttggggattgtggcacgtgataaggtggacatcacctacgagaactggaagaaggtccctactgctcagaaggacctgatttgggaggatattcaggcagaatttgatatcccagaggcttctgacagtaggacgaaaaggaagttactataa

SEQ ID NO: 58306 - DNA, 333 bp, Glycine max
  Peptide Sequence Number=SeqID_149991
atggtcaacctgattacgatcatctacgcttcagatttcctgaagttcgtagcgctaaaagcaaggaatgtaacgatgaaaaaatggcttccgcttgcctgtctgttcgcgtccagcgtggcaatggcacagcaaaaccctatcgatcagcagctcaatcaatgcctgaataaagagtccagcaccaccggcatgtcgcagtgctacagcacggccaataaggcgtgggacaaagagatgaatgcgcaatatagccagctgatgaagaaattaaccggtgagcccaaagacaaactgcgcaatgcgcagcgccgcctggctggcctaccgtga

SEQ ID NO: 58307 - DNA, 417 bp, Glycine max
  Peptide Sequence Number=SeqID_149992
atgaagcacttcactgacaccctcatcagtgccaacatactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58308 - DNA, 119 bp, Glycine max
  Peptide Sequence Number=SeqID_149993
atggccgccctccattgtctcacggcactggcacacccacgcaaaaaaatccccaacatggggtctgcagctggtgcatccctctgctggtcacctgcctgggtcggtgtcatgaaagg

SEQ ID NO: 58309 - DNA, 441 bp, Glycine max
  Peptide Sequence Number=SeqID_149994
atgtcgatctccccctgtggaagtattagttggtctgtgtcgttccgacatagggatcgcgcccacaagacacccactggacccggaggagcccaacagggccctggggtttccagctctggttacaggtctctgtcagtcctacagggtgcccgtccccccagcaaggaatcacacccacaaagacacccagtggacccgaagaagtccaacagggtcctggggtttccagctctggttacgggcctctgtagtcctgcagggtgcccgctccccccaacaaggtcacgtcatcatgacatagggatcgcgcccgtaagacacccagtggacccgaagaagtccaacagggccttggagttgccagctctgattatgggcctctgtcagttctacggagtgcctgtggccccccagcaaggtcatcaggccccctactaa

SEQ ID NO: 58310 - DNA, 765 bp, Glycine max
  Peptide Sequence Number=SeqID_149995
atgacgtctaaggccgcaaaggaaatcgctgagaagattgatgtcctgactgctgtcattgggcgaccaaaacaccctggtcgtgtacgtgttgctggagccgttgtcaccattaagcaatacattggatcgactccacgaagctcccgcagttcctcctccatccctctcgaagaactcaagcagttgactcaacaaatcaaggaccaactggaggagttgatcatagaaaaagtgactcggcagctaatggcatccttcagccagatgcaatcccagcttcaatcacagatgcaatcacagggacttgcactacctccggagtctgaggttggtccctcagctactcgtgttagcacaaaggggagttgtgttgatccctcaccgaccgatccagagacgggtgactcagacaaatgcgggttgtacatcgaaaaaaatctttcccgcctagttgccctaggaagagtttatgagggatctacaacggttcacaacatccctttgttgcatggccatgtgaaggttggtgttgagggggttgaagatgcagaggttcccgttcctgtacctactgacgaggttattttagtggggcaggcacttaacaccttccttgcttgggcgacacatctcgtgaagcgtgtatcagaacaagcagttgtttctccggcaaaacctttagataggccggatcataaggtcgatgatcccctatatctgatgaaattgatcatcccacagcttttcttgaagcatctccag

SEQ ID NO: 58311 - DNA, 444 bp, Glycine max
  Peptide Sequence Number=SeqID_149996
atgactgaagcactcaaaagggggtcacggaaagttccacaattccttagaatgagaactcacaaaaagtacatgaaacgaacatgttttgggtaccagccacgggtgacatttcagaatgattggaaagcatcggtttggggtaccttaccaagttggaagaccgaagaaaacgaagaacgaacgatcgaatgtcgaagaacggttgaaaatcttctaattacccacgggaaacgttatgagaagatagcctcggcttacttttcttcaggaaacaattttcctcagcaattgtcaagagaatacgaggggaagcttgtccacccagctcgcccaggcgagctcagctcacccaggcgagtctcaggtgaatccacgatttctttttacttgaaaggtgaccatttaaaggtgttggaccttaaaaatgatccattaacttgg

SEQ ID NO: 58312 - DNA, 318 bp, Glycine max
  Peptide Sequence Number=SeqID_149997
atgccagatgagcatcagcaaagggttacccttgaggactattcaagcagttcagtgtcgcaattctttactagcattgcacgtcccaaagggaacttattccaaggattaccaaatgaggacccctatgcatatttggcaacattcattgaaatttgtaacactgtaaagattgcagaagaagccaaaaggtggctccactcatttaagggtaacagtctgaaaacctgggaagaagttgttgaaaagtttatgaagaaatatttcccagagtcaaagactgcggaagggaaagctgcaatctcttcatttcattag

SEQ ID NO: 58313 - DNA, 417 bp, Glycine max
  Peptide Sequence Number=SeqID_149998
atgatacgcggagataccttacggttatccgcacccttttgtcatccagaggcggcgggcccgatgacaagtagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaaatttggtcattctgcacccttgtatcatccagaggcggcgggcccgatgatacgcagagataccttacggttatccgcacccttttgtcatccagaggcggcgggcccgatgacaagcagagaccaaatttggtcattctgcacccttgtatcatccagaggcggcgagcccgatga

SEQ ID NO: 58314 - DNA, 315 bp, Glycine max
  Peptide Sequence Number=SeqID_149999
gccatttgtctaacaagtggtatcaatgtaaatcatgaagattttgatgatatcaagaagaatttgcttgagaaagagggagatgtaaatcatgcaagctttgatggtgtcgagaagaaatcacatgtttgtcatcatcaaaagggggagaatgtgaatgtatgtatacatgatttagatgatgtcaaagaagaatctaacaagaccaagccttgccttaaaacaaagtgctttcaagacatgcaaggctctggtaatcgattaccaagaagtgtaatcgattaccagaagacagggttgagaaatagctgttga

SEQ ID NO: 58315 - DNA, 270 bp, Glycine max
  Peptide Sequence Number=SeqID_150000
gtcagagatctattgaaagccattgatgaacagtttacgacctctgagaagtcgcttgctagcacactcattatgcaattctcttccattaagcttactggaacgagaggtgtgcgtgaacatatcatgcgcttaagagacatagtggctcagttgaaaaccttgaaagttaccatgtctgaatccttcctgggtatggaaagcctgaggaagctagtgggaagtgagcagtgcatctactcagggagtaggatgagatcacatgtagag

SEQ ID NO: 58316 - DNA, 264 bp, Glycine max
  Peptide Sequence Number=SeqID_150001
atgtcatctgcaaaaagcaggcatctcggcgctatctcttggatttgttccgtgaggacatccagaattaagattggcactaacgtgcttctcctccattcctccggcatgcgttttgacctcataatttcgttaaagagttcggtgagccactcaagacctctatctccaagagttttccacacttcaataggtatgttgtctggccccaccgccttaccattactcattcttttcaacgcttcctttacttcctgtttttga

SEQ ID NO: 58317 - DNA, 262 bp, Glycine max
  Peptide Sequence Number=SeqID_150002
atggctgaagagccaagaagagtaaccctggaggattattcaagttctagtgttgattctgttctcattttcttagctggagaagctaagagatggcttcattcttttaaaggaagcagtctgaagtcatgggatgaagtggtagaaaagttcttaaagaagtacttccctgaatcgaagactgcagaaggcaaagctgccatctcttccttccaccagtttccagatgaatcattgagtgaggcacttgaaagattcagag

SEQ ID NO: 58318 - DNA, 722 bp, Glycine max
  Peptide Sequence Number=SeqID_150003
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58319 - DNA, 336 bp, Glycine max
  Peptide Sequence Number=SeqID_150004
atgaacaacatgatcatgctgcaacacactgaaattaaagcatcctttgaaacaagtacacatatggttggacatgtttttaaagttaccttatacaagaggcttcttggcatggtttcaagtaattctttagtgaagcgtagtgcatcatcttctgaccaaccgattccaagaagaaccatgccgatatttgatcaatttcatccgtttatacacgatttcattaacaacattgtggatgtcaaagctgacggtaactgtggatatcatgcgattgatgctttattaggtatgggtgaagattcttggtccttggtgcacaaccatttgctttaa

SEQ ID NO: 58320 - DNA, 264 bp, Glycine max
  Peptide Sequence Number=SeqID_150005
agcttcacattttttcctctcagaagtcgaccaccggttgattctgctgcacaccgcataatatgcgtcagtcatgtgtttggtagtcattttgttcaggtttatctgaaagatcgttgtcccttactgcctatggcgttgttgtggtcaagcaatgtgtatctggaggcaaaacaatggccaactgcatatgtaggtagaatgcagcaatacttaagcctaatgacaattaatacaacgcatgtagacctaagcggacactga

SEQ ID NO: 58321 - DNA, 447 bp, Glycine max
  Peptide Sequence Number=SeqID_150006
atgggtgaagtagaggagatacaagagaagatgaaggccgacatggaagccattaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcaaatatggtaggcaaagatttgggaagtacgaatgaccccatgatgtgcaaattcaaaacgagtacaccttcccatcatatggcttgcctcccaactatacaccacccaatatggcgtacactcccaataagaatgtcaataactccactcctatacccattgaaagccagcaaccccaaactgatcatgcacatgtctcttaaactgtggaagagacccatgaaattccccatcacaatctag

SEQ ID NO: 58322 - DNA, 636 bp, Glycine max
  Peptide Sequence Number=SeqID_150007
atgccaagtctctatgaccgaaccacaaagctggaagagactctagctcaactcatcgatgtgtcaatgtctaaccaaaagagcaccgagtctgcaattaaaaatctggaagttcaggtgggccagcttgcaaagcagttagctgaaagactatccaacaactttacaacaattacagagaaaaatcataaggaatataaagctgatcagaaggtggagggatttaaacaacagctggctgatgaaccggaactagaaccggttgatgattttgttgaacttgaagaaattgttcagcaagaagaaggtgatgaagaagaagagacaccaataagagactctcaagagaaaataaagaaggaagaaaaagaaaaagaaaaagaaaaagaaataaaaaaagaagaaaaagaaaaagaaaaagaaaaaaagttgaaaaatgaaaaacgaaaagagaaggttgttaagattgagaagaagaagagcaagagtgaggccaacatagaaaagaagaaagaggctactcctattgaatgcaaggaggtaactggagtgctgtcattcaacgcattcttccacccaagcacaaagatcctgaagttgtcacgataccgtgttttatcggcgaggttgttgtag

SEQ ID NO: 58323 - DNA, 493 bp, Glycine max
  Peptide Sequence Number=SeqID_150008
ggatcgcgcccacaagacgcccagtgggcccgaagaagtccaacagggccctggggtttccagctctggttacgggcctctgtcagtcctacagggtgctcgttcccccagcgaggaatcgcacccacaaagacacccagtggacccggagaactcttgtccaacagggcccttggggtactatccactctttagaggcctctggatgaccggccctctctgcaggacactcctaggtggacccgatagaagtacctatacaggttctacggagtacctgtcacctccagcaagggcatcaggccccccttactacatcaagctttcatcaagaagtactgcgtccccaggcaggcgtaggagcgaaataccacaacagcctggggatggccgacagcgggcaacagacgcaccacattcagcctctagagttcacctcagctctatccacaaaaaggttagagcttgcttacgacccatgtctgaccaatga

SEQ ID NO: 58324 - DNA, 451 bp, Glycine max
  Peptide Sequence Number=SeqID_150009
tttctttaccttttgtttcaaacccccaacaagaaagaaccacaacttagaggctaacttagattgggaaataagggtagagcaacaacttaaaaagaagtctacttcaaaatcttatggctctcactcttatccaaagaaagaccaaggccaaggcatcctaggggtgacaccttctaagaccaaatatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttattgtagccaagatgaggctactactttaccttcctctagtgaaagtgaagaagcaaaagaggaagaatctagtgaagaaatctaccccaaaaagaaggacaacctttaa

SEQ ID NO: 58325 - DNA, 51 bp, Glycine max
  Peptide Sequence Number=SeqID_150010
atggacacccgtctccgtgtgattggtgatcccatgaatgaagttcaacgg

SEQ ID NO: 58326 - DNA, 381 bp, Glycine max
  Peptide Sequence Number=SeqID_150011
atgaagaatgtgttcgacaagaaggaaggacctttcgtcgtgaaaagggctttttccgaaggggccctggtgcttaccgacatggatggcgaggagctacctttacccgtgaactctgatgttgtattcttgttcgctgtaattgtctcgtcgcagttatttaaaagaatctgcagggggagattcctcctcattgtggttgctgggcagaatgttgctaaattgcaacgtcatccatatccatgtaagagtggtcatcctccttctctggatgtgctcgcacagttggtcgccctccaatatcagggggtggcccaggaactgataaaaggaaactactggccccttaaccgggagcgcaagtctcggttaagcatctaa

SEQ ID NO: 58327 - DNA, 210 bp, Glycine max
  Peptide Sequence Number=SeqID_150012
atggcatcttcatcatcatcttcatcacatgttaacattaagtctggccccatcgatgctgataacatgtttggaatggggaagaagataggaaattacatatcagacgagctgtccccacgtatcaaggggaagaacaaattcctgagcaaatttttccttttcttctacaatctggtttcgcctggattatcaagatggggtacttaa

SEQ ID NO: 58328 - DNA, 414 bp, Glycine max
  Peptide Sequence Number=SeqID_150013
atgcatgatccacaacatgaagcgcctcgagaccaaactctagccgactttgagcctcacctcggatgttccactaaggggaaagcatttggtggcatacccctgccaaacactttggggggccctcagtatcgcccacaaccacaacccttgcatttggcgttggaaagactgcctcctgccatggtagaaagggagaaatttgatcatatagaggaaaggttgagggctattgaaggaggcggggattatgcctttgttgacatggcaaagttgtgcctagtgcctgacgtcatcattgttagacaagtggcctcagatatcttaagaagggggaattcctttacaacaagagacccacggtctcttaatcccttagagaatgaggagaagaagaagaatgaatctctctag

SEQ ID NO: 58329 - DNA, 372 bp, Glycine max
  Peptide Sequence Number=SeqID_150014
atgaaggaaggcatgggtcacatcttagacctcactcccataggagagaaaagaaaagaaagccttaaggggctaacattagcctcccatacttccatgggaaggacaataggacacattacttctcaatgccccaccaagaaaaccatgattatgaggagccaagacatttatagtagccaggatgaggctactacttcaccttcctctagtgaaagtgaagaagcaaaaggggaagaatctagtgaagaaatctacccccaagaagaaggaaaaccattaatggttaaggaggagtgtaaggaggtaagtgtctcctccaagaggttagctaagacagagaatcattttgcaatacagacaaacatttaa

SEQ ID NO: 58330 - DNA, 847 bp, Glycine max
  Peptide Sequence Number=SeqID_150015
atggcttctaggaaaagaaaggcaccctctacacccactcaggttagatttgacagatccagattcacttctcaagaggattgggaaagatatacagatgttatagtgcctagcaagcttttgccagagaggaatgtggtggtctactatacagagtttgatgagttcaaggagaaactcgagagatgccattgggatgaggagttgactgactttggggacggcaacattgatgttgccattgtaaaggaattctatgccaacctctatgaccccgaggacaaatcacctaagcaggtaagggtgagaggtcatttgattaagtttgatgaggacacacttaacactttcttgaagacccctgttattgtggaagagggggaatcactctgtgcttattccagatttgcaatcccgaggcataatcctcaggagttagctgctaagctctgtatcccagggaggggatttgagcttaatgttaatgggcaacccttaaagatattgaggaagaaaatgaccaccctagctcagacatgcagtgttctttccttctctaacctgattcccacctcccacacttctgatgtcactctttatagggccagagtcatctatggcattattatgaagatggatatgaatgtgcggtacctcatttcctaccagatctccctcactgctcagcatgacacatccagacttggattcctggctaagggagttcagtatgattcgagatccttggagagcctgaatcctgccattaatttggcatatattaagaagaacttttggaatcttgatgatccaacagtaactttcagaggacttaggaaggccaagg

SEQ ID NO: 58331 - DNA, 273 bp, Glycine max
  Peptide Sequence Number=SeqID_150016
atgaccatgattacgaattcgagctcggtacccgatgtcacaatcgaggcagaattgttgcttgcattttgggcaaataacagaaagtccaggcttgtttcctgtgtcccaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 58332 - DNA, 903 bp, Glycine max
  Peptide Sequence Number=SeqID_150017
atgaagagaggtatgatagatgctgccagtggtggagcccttggagacatgacccctgctgaagccagaaatttaattgagaagatggcttcaaactcccagcaatttagtgccagaagtgatgctattgtcattagaggagtgcatgaagtagccatgaattcatcaggtgagactaagaagcttgaaggtaaactagatgccttggttaacctggtaacccaattggccatgaataaaaaatttgcacctatcgccagactttgtggtttatgctcctctaccgaccaccacacagacctttgcccttttgtgcaacaatatgaagcaattgaacagcctgaagcttatgctgcaaacatctacaatagacctcctcaacctcaacagcaaaatcagccacaactaaataattatgacctctccagcaacaaatggtcgaatccttcacaacagcagcagccacaacaacagacttattttcaaaatgctgctggcccaagcaaaccatatgttcttccaccaatccagcagcaacaacagcaacagccccagaaacagcaaacagttgaggcccctccgcaaccttcccttgaagaacttgtgaggcaaatgactatgcaaaacatgcagtttcaacaagagaccaaagcctccattcagagcttaactaatcatatgggacaactggctacacagttaaatcaacaacagtcccagaattttgatagattaccttctcaatttgtccagaatcccaaaaatgtgagtgccattacattgaggtcaggaaagcagtgtgcatctaaagagaagcagcatatccctctctcattccctccaagagcaatttccaacaaaaaaaatggaagaggcagagaaggagatcttggaaacatttag

SEQ ID NO: 58333 - DNA, 1147 bp, Glycine max
  Peptide Sequence Number=SeqID_150018
acgccgcctcgtcataggcgcgttcgggcagcaggatgatgtgcggcgcttcgtcatcgccgttgccggcaaggccggcggccgcagccagccagcccgcgtggcggcccatggcctcgtagatgacaacgcgggtggaggtctcggccatcgccgccacgtccagcgccgcttcgcgcaccgagacggcggtgtacttggccgccgagccgaagccggggcaggtgtcggtcactgccaggtcgttgtcgatggtcttgggcacgccgatgcaggtcaggtcgtagccggaggccttggccagctgcgagaccttcagtgcggtatcggccgagtcgttgccgccgttgtagaggaaccagcgaacgtcgtgcgcgcgcagcacctccagcaggcggtcgtagcgggcgcggtcggcgtccagcgatttcagcttcacccggcacgagccgaaggcgccacccggggtatgggccagggcgcggatcgcggcggcgctctccttgctggtgtcgatcagctcctcgcgcagcgcgccgaggatgccgttgcgggcggcaaggaccttgatgcccttggcccgggcctgctcgatcaccgctgccgccgtggcattgatgaccgcggtgacaccgccggactgggcgtagaggagagtaccgttgcgcatgcttctacctgctcgggggaggggacattgcagggacattacccggatgcggggacacaggcgacgcgcctgaaggaaaagctggggatcgcccacatttcgaccggtgacatgctgcgcgcggaaatcgccgccggcacggagctgggcaagcaggccaagacggtgatggatgccggcaacctggtgtcggacgacatcctgctgggcatgctggagtcgcgcctgacccaggccgatgtcgccaagggcttcatcctcgatggctacccgcgcaatgtggcccaggccaatgcgatggacggcctgctggccaagatcggccagccgctggatgccgtggtgcagctggacgtggccaccgagctgctggtcgaccgcatcgccggtcgcgccaaggagcagggccgcgccgatgacacgccggaagcggtgcgccagcgcctgcaggtctacaacgaccagactgccccggtg

SEQ ID NO: 58334 - DNA, 276 bp, Glycine max
  Peptide Sequence Number=SeqID_150019
atgatgaaccaagcaattttgatgatgccaaaagcccaagtgattgattcaagacttcaagatcaagcatcaagaatccaatccaagattcaagattcaagagaagaaatcaagaagcaacaagtcaagacttcatattgcatggaaatagaaaaatacttgtacttgagggcttgtcactcggtttggaactcccttgagactcaggctgatcatcgtgggggggggggggagttgtctgtgcacgacatggtgacctcgatacttactgcctag

SEQ ID NO: 58335 - DNA, 123 bp, Glycine max
  Peptide Sequence Number=SeqID_150020
atgacccgagagtccggtagtatgtggagacgccttacggttatctacacctcgtcatttggagaccccaagtctgatcgacaagcggagacctatgtggtcgtctgcgccctttctggagat

SEQ ID NO: 58336 - DNA, 240 bp, Glycine max
  Peptide Sequence Number=SeqID_150021
atggtcattcagaaacgaaaagctaacatccaaaatctcatttatggttatggggatcccatcagcagactctccttccctgcatgtttgcattttagtggagaaaacatcgagactttttcaagtctcacaagttatccagaactacgtaggtctgagttcctcattggaggatacgtaggagcaaaagcctcgcttttgtcaaccgcgccgctttctgttaccatgacccaagagctg

SEQ ID NO: 58337 - DNA, 411 bp, Glycine max
  Peptide Sequence Number=SeqID_150022
atggtgaaagttggaacctcttacgtgccggatcaacgtctcattttcgccaaaaagttggcccagggctttcccggtatcaacagggacaccagggattttatttatttgcgaagtgatcttccgtcacagctgtcccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgtgatgaagtggtgctcgccatcgctaagggtggcccagtggcagaggtcctgcgatag

SEQ ID NO: 58338 - DNA, 427 bp, Glycine max
  Peptide Sequence Number=SeqID_150023
gcttttcgacttacagacagcaaatctttatacggataaccactcgggtatttccgcccgtcagcgtgactcaaaagtcaatatgacagatcttgtgagcgcggaagatgacataaatctccacctatcaacgatcttgtctgccgcgattgaggaaggcttttcgacttacagacagcaaaaagtttatatgaataaccactcaggtatttccgctcgtcagcgtgactcaaaagtcagtatgacagatcttgtgagcgcggaagatgacggcgcagaagacgacgttagtctctgcgtgctatcaggcttttcatcttacagaatgcaaaaagtttatacggataaccactcgggtatttccgctcgtcagcgtgactcaaaagtcagtatgacagatcttgtgagcgcggaagggatcctctag

SEQ ID NO: 58339 - DNA, 201 bp, Glycine max
  Peptide Sequence Number=SeqID_150024
atgaagctttgcttctacatagatgtctcaaattttggtgttgttcaccaaggagatgatttctttcgaaggtgggctaaagctaaaatgaaatcctgcttttcgagtgtaacaactagccaagcttccattgacaagtggtctcctccacccttgggtcatgttaagtgcaacgttgatgctgaattctttcatgaataa

SEQ ID NO: 58340 - DNA, 253 bp, Glycine max
  Peptide Sequence Number=SeqID_150025
tcttatccaaagaaagaccaaggtcaaggcatcttaggggtgacaccttctaatcccaaaggtgataaggggaagacaatagaaaagcaaccccctaaggctacaaaaagggaagaatctagtgaagaaatctacccccaagaagaaggacaacctttaatggttaaggaggagtgtaaggagacacttgttagcactgccacacctcttgggcttgagattattcctcaagtaaatgagttgttggatgaag

SEQ ID NO: 58341 - DNA, 429 bp, Glycine max
  Peptide Sequence Number=SeqID_150026
atgagacaggccaatgcattcccactgacgataacactcgagaaattcatttcatggggaatcagtagaggcaacggtacactcaaggaggattttcaggcttccagcaaggtccttataatcagcaaggacagtggaggacacaccctggcaaccagttcaataaagaccaaggtaacgatgtcaaatcataagagtactgagttagcactgaagaaccttgaagtacagatgggacaattggccaagcagatagctgacaagtcatcaattagctttggagcaaatacggaaaataatcctaaggaggaatgcaaggctgtgatgactaggagtaaaaggttggtggaagctgaggatgaagaaaatgaggtagacaaggaacaactgagtgaaaagaaacgagttgaggttaagaaaaattgttaa

SEQ ID NO: 58342 - DNA, 487 bp, Glycine max
  Peptide Sequence Number=SeqID_150027
gagttggggcgattgatggacctctccaaatgcaagccttccacaaggcgtacggaaagattttagatttgaccatagcagagatatccacgaaagtcgttgcatcactcacccaatactatgaccagcctttgagatgcttcacgaaaccgtatctttcctccgagtttcttccctccttgagcaagattgcaattgtggtcagggattcggcaagagagttagatcgtgtaaagcagactcgaaatggcgtagtgggcctaccacagaagtacttagaaggcaaggtgagggatatggcgaatcaagaggagtgggtcccatttatggacgtattagcattgctaatctttggggttgtcctctttccaaacatggatggtttggtggacctagccgcaattgatgctttccttgcatatcaccacagcaaagagagctcggtggtagctatcttggcggacttatttgacacatttgaccgaag

SEQ ID NO: 58343 - DNA, 435 bp, Glycine max
  Peptide Sequence Number=SeqID_150028
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttgcaaaagaaagtgcagatgtcataattctggatgataacttctccacgatagtagggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 58344 - DNA, 216 bp, Glycine max
  Peptide Sequence Number=SeqID_150029
atggagaagaggcccacgaggacgaggagatggccgatttgcttgacttcttgggagggactggagatacatgactgggagatccccaagattcatcgcatacatttttgtttggattgttgcgttagtgtttatatatcattactatcgatgatgtttgaaattctggaaccatgtagagttcttcgtttaggaacatcgtccaaaaatatatag

SEQ ID NO: 58345 - DNA, 311 bp, Glycine max
  Peptide Sequence Number=SeqID_150030
tgaaagtgaagatgcaaaaggggaagaatctagtgaagaaatctacccccaaggagaaggacaacctttaatggttaaggaggagtgtaaggagacacttgttagcactgtcacacctcttgggcttgaggttattcctcaagtaaagaagtttttggatgagggtttggttcgtaagagcttaaatccttgtgctttgttggtgcccaaaataggtgtcaagggaaggagcctagagtatgaagaacctcaggatttgaggtcaaatcctttccaaggtggaggggatgatgcaatcctaccccccaagg

SEQ ID NO: 58346 - DNA, 561 bp, Glycine max
  Peptide Sequence Number=SeqID_150031
atggataacgaagagggagtgcaagaacagatgaaggccgacatgtcggccttaaaagatcagatggcttctatcatggaagccatgctaaaaattcaaaaatcaatagaagacaatgatgtggcagtcgcttccaatacaactagggaagcggaaccggtgctacagcctgcaatgaacttgggccaggacagaagcgcgacggacttcactccccgtaccgctccagacgatttgagccaagcccctaccttcgaggggcaactccctcctcatgtcgactatcctctgcaggaagatgatgaaggagatgcccatttaggccctctacttcccctcaaggaactggccccccatgagttgccccaaccaaatataatctgccatgccccgtctcaatccgcacccgttaaggaactcgttcccatttcaaaagacaagggaaagattgatctgcttgaagagaggttgagagcggtggaaggcctcggcaactatcctttctcggatttagccgatttgtgtctagtacctgacatcatcattcctcccaagtttaag

SEQ ID NO: 58347 - DNA, 897 bp, Glycine max
  Peptide Sequence Number=SeqID_150032
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccatgcgctacagcgctgaagtaatccatgccatactcccaggaaaagctcgaacgaccttcaacaaatgggtacctgtacccgaaaccgacacaggggtgcctcctcacaaagggggtcgcagtgacccagccccgggcgactgtttaccaaaaacacagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaagtcggccttag

SEQ ID NO: 58348 - DNA, 818 bp, Glycine max
  misc_feature (808)..(808): n is a, c, g, or t
  Peptide Sequence Number=SeqID_150033
ggctacacgccctcgcctttagaggacttcgcgtccttgccttcagaaggctacacgccctcacctgtagagggctgcatgcctttaccttcagaggacttgacattcttgcctttcgaggactagacgttctagccttcagagggctacacgctctcgccttcagaggactacacgtcctcaccttcagagggctgcacgcccttgcctttagaggactacacgtcctcaccttcagagggctgcacgccctcgccttcaaagggagacacatcctcaacttcagagtgttgcatgccctcgtctttagagggctatgtgtcctcactttctccagtagtttccttttatcagctcctgggccaccccctgatcctggaggagtgccaactattcgaacacaaccagaggaggaggctatcgcacagctactatgcataccggggcaagatttcacccgtgccgctgcaaagagacgattgtggatcatgcgcaccaacatgaccactcttacacagatatggatgacgttgctacttagcaacattctgtccagcgaccgcaatgccgatctccccctgcggaaggatcgcgcccacaagacacttagtggacccggaggaatccaacggggccctggggtttccagctctggttacgggcctctgtcagtcctacagggtgcccgtcccccccagcaaggaatcgcgcccgcaagacacccggtggacccagagaagtccaatagggtcttggggtctccagctctgattacgggcctctgtcagttctacagagtgcctgtcgnccccagcaag

SEQ ID NO: 58349 - DNA, 261 bp, Glycine max
  Peptide Sequence Number=SeqID_150034
atggccttgacattaaccagacttaacattgctgacaacaacatcacaaacttcttgcatcccggatacaaaggcttattcaaattactttgcaatgtatcatacataggggcagtgcttgctgaaaagattcttgtccaagatcaggaatcatttcctctaagcgatctctcatttgtacgtcaaccaattcagattaggactccctctacatgtctatcaattcaccatgtcatatccatgtcgtataattcttcttaa

SEQ ID NO: 58350 - DNA, 603 bp, Glycine max
  Peptide Sequence Number=SeqID_150035
atggcccgcaccaagaaaacaggggagatgatgactgaggccgcaaaggaaatcgctgagaagatcgcgatacagggatccttcgtcccccatggacgtcaggatgttctcaccgctactattggacatctagagcaccctagatgtgtcagtgctactggagctagtgtcaccatcaagcaatacttcggatcggctccacggacgtcccacagctcttcctcattgcctcctgaagaattgcagcaactgacccagcaaatcaaggaccagctagaggagtcaatcacagaaaaagtgactctacagctcatggcatcgttcagccagatgcagtcccagtttcagtctcagatgcaatctcagggacttgcactgcctccggagcatctggttggtccctcaagtcctcgagtaagcacaaaggagagttgtgttgatccttcaggaaacgatcctgagacgggtgacttagataggtgcagcttgtacatcgaagcaaatcctacccgcctggttgccctagggagggtttatgagggatccactattgtttataacactcctttgttgccaggccaagtaaaggtgggtgtggaggag

SEQ ID NO: 58351 - DNA, 363 bp, Glycine max
  Peptide Sequence Number=SeqID_150036
gagagttggggcaattaatgggtcaactttcaacggcaagccttccgcaaagcctatggacttccaactattgccgactgtgaaagagtttgaagaaatcctgggatgcccactgggaggaaggaagccatatcttttctctgggttctatccctccacgacaagagttgccaaggtggtgaaaatctcagcacaagagttggaccgtgcgaatgggctttcttttattgacatcttggcgcttttgatctttggagttgtcctctttccgaatatggaagggttagtggacctagcagcgattgacgctttcctcgcctttcatcatggcaaggaaagcccagtcgtcgccattttggccat

SEQ ID NO: 58352 - DNA, 222 bp, Glycine max
  Peptide Sequence Number=SeqID_150037
atgttgttaagtagcaacgccatctatatctgggtaagaatggtcatgttggtgcgcatgatccgcactcgtctctttgcagtggcacaggtgaaatcttgcctcgatatgcacagtagctacgcgatagcctcctcctctggttgtgctcgcatagttggtcgccctccaatattagggggtggcccaggaactgataaaaggaaattactggccccttaa

SEQ ID NO: 58353 - DNA, 265 bp, Glycine max
  Peptide Sequence Number=SeqID_150038
accaaggtcaaggcatcttaggggagacaacttctaagcccaaatatgataaggggaagacaatagaaaaacaaccccttaaggctagtatgcaagagaagactagctccatgaatagccaagataaggctactacttcaccttcctttagtgaaagtgaagaagcaaaagcggaagaatctagtgaagagatctacccccaagaagaaggacaacctataatggttaaggaggagtgtaaggagataagtgtctcctccaagag

SEQ ID NO: 58354 - DNA, 183 bp, Glycine max
  Peptide Sequence Number=SeqID_150039
atgtgtgtggaaatggctccgaaaaatctttccgcgaagagatctaggagggacgccacgactgaagggaccagtgccgctcccgaatttgatagccaccatttcaggagcgccgagcaccagcagcatttcgaggccatcaaaggatggtcgtcccagacgcgtccagctcagggacgatga

SEQ ID NO: 58355 - DNA, 240 bp, Glycine max
  Peptide Sequence Number=SeqID_150040
atgggtccggttttgtcagacccgccgagatccctcatgggagaacaccctggccgtgtgcatgctgctagagccggtgtcaccattaagcaatacttcggctccactctacaaagctcccgcaattcctccttcatccctcccaaagaacttgagcagctcactcaacaaatcagggaccagttggaggagtcaatcacagaaaaagtgacttggcagctcatggcatccttcaactag

SEQ ID NO: 58356 - DNA, 186 bp, Glycine max
  Peptide Sequence Number=SeqID_150041
actcatcttttccttgaagtggcgtctccttcctctcttcctttctccattccactgccattcatcttccaagaagcaaaggaatccattgatgaagaagatcctaggcctacaagctccaatggagcttacatcaaaattctcctttgcgctaagcgtgctaaagctgcgcttagaagtggataa

SEQ ID NO: 58357 - DNA, 435 bp, Glycine max
  Peptide Sequence Number=SeqID_150042
atgggatcaagtcaaatgccttcgcttaaaaagaggttctatcaagttaaggtcaagagcctagggaccaccagtctaaaggagttagggcagttaatgggtcagctccagcggcaagcttttcgcaaagattacggtaaaatctggaacttagccatgctgataaggtgcttcacatttgaggacttccagctagtgccgactgtgaaagagtttgaagaaatcctgggatgcccactgggaggaaggaagccatatcttttctctgggttctatccctccacgaccagagttgccaagttagtgaaaatctcagcacaagagttggaccgtgtaaagcaaaacaggaatggggtagtcggagtaccaaggaagtgtttggaggaaagggcaaaggccttggcaaatcaaggcgaatgggctttcttttattga

SEQ ID NO: 58358 - DNA, 653 bp, Glycine max
  Peptide Sequence Number=SeqID_150043
catgtttgcattctagtggagaaaacatcgagactttttcaagtctcacaagttatcaagaactacgtaggtctgagttcctcattggaggatacgtaggagcaagagccttgcttttgtcgaccacaccaccttttgctgtcatgacccaagagctggtagcccgcagagacaccttacggttatccgcacctcgtcattcagtgaccccaagtgtgattgatgagcagaggccaatgtggtcatctgcgccatttccggagatgtcagcatcttccgatggagacttttcaagtctcacaagttatcaagaactacgtaggtctgagttcctcattggaggatacgtaggagcaagagccttgcttttgtcgaccacaccaccttttgctgtcatgacccaagagctggtagcccgcggagacaccttacggttatccgcacctcgtcattcagtgaccccaagtgtgattgatgagcagaggccaatgtggtcatctgcgccctttccgaagatgtcagcatcttccgatggagacttttcaagtctcacaagttatccagaactacgtaggtctgagttcctcattggaggatacgtaggagcaagagccttgctattgtcggccgccccacaagatctgtcatactga

SEQ ID NO: 58359 - DNA, 705 bp, Glycine max
  Peptide Sequence Number=SeqID_150044
atgcacgagcatttgaacgacgcgtcgcaggcctctacacggcagctgggcggttatattacacttctccagtgttggatatacgagcactttcttacagtgcatacatgcgtcgttcatgatgcttatgatgaagggagcccacaggcctgcaggtggcttacgggtaaggctcatatgacggggatcaagggagccccgtatcggagacgtctggatgccctaactgtaactgacgtgtgttggatgtcctatgctgagcaccggggagtcaggggctttgacttgatatcgtcgtacaccagccagctcagatggggtcagattgtggtgtacgttcgacctgagcgggttcttcgacagtttggctaccttcagacggtccctccgccgccggtttgtgattctttgacgggtgatgatatagatgaccgatggctgcatttttcagaccatttggtgcctttaggggagctctgtgtagttcctggacaggtggcgccagactacatggagtgttttttttggatatcgcacccattcgtcacgcgcggaccgaggagactgctgagccgagacatctgcctccctctcatgatgaggagttcgtcgagccatccatccccgaggtttcagtcgcgtccgatctccctacgcattcagtggttgactaccaaggatgtcagggaatggctgaggatttag

SEQ ID NO: 58360 - DNA, 184 bp, Glycine max
  misc_feature (21)..(21): n is a, c, g, or t
  Peptide Sequence Number=SeqID_150045
aagttgtcatcatcaaaaagngggagattgtagaagcaaagcttcatggagaattaaagatgatgacaaaggtgatgacaaaaagctcaaagatcaatcaaagaacaactcaagtgaatcaagaacaattcaagagttcaagataagaatcaagaaaaattcaagactcaagaagaaagtttag

SEQ ID NO: 58361 - DNA, 567 bp, Glycine max
  Peptide Sequence Number=SeqID_150046
atggggaattcagaagtaggacacatgaatcttggagcaggaagagtggtttaccagaatctagtaaaactgaatatggcagtagaaaatgggaccctgggggaagaaaaagtcattcaggaagctttcgaatatgctaaaagggaaaataaaaaagtacattttatcggattggtttccaatggaggtgtacattcccatatcaatcacttaaaaggtcttttaactgcggctaaaaatttcggattgaatgaaaatgtttttgtccacgcttttacggaagagactgcgatccgcattcaggattgggattcatcaaagaacttgatgaacatatgcttgcacgaccgggaaactggcaacattgtcggaaaatatcctcacgttacctttttcttttccggtggtagagagaaagaatttgtaggggaaaggagtatttgctttaaacttccgccgaaacggctgaatctgtatgtatgttaccctgatgaccaactatacacagcattccacgaatctggacctattaataatgtaaaggagtttttgatgaagaagttttaa

SEQ ID NO: 58362 - DNA, 600 bp, Glycine max
  Peptide Sequence Number=SeqID_150047
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccttcatgagcatagaaagatgagtgtaagggtggcaagagagtgtaaagggtttggtgacttggctttagggttaagggtttttgtggagcagttgaaatgcaagagtgatagttttaatgatgtatcaaaattcagagcttgcacacgtcagggtggacgtgggaggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 58363 - DNA, 421 bp, Glycine max
  Peptide Sequence Number=SeqID_150048
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctttgggtaattggcctcatggatttgctggtcatattcaagtag

SEQ ID NO: 58364 - DNA, 291 bp, Glycine max
  Peptide Sequence Number=SeqID_150049
atgtcagccagtgatcatgccattctgagggacaaaacccatcaacccacaaagaagagcctgttggagctaacatcacacgatgctttgttggcacagaacaagttgctatctaagcaacttgagatcctaacggaaacacttggttgtaccatgtgtggtgaagctcatgagacaggccaatgcatccccactgaagaaaacactcgtgaaattcatttcatgggggaattagcagaggcaagggtatactcaaggaggattttcaggcttctagcaaggtccttataa

SEQ ID NO: 58365 - DNA, 296 bp, Glycine max
  Peptide Sequence Number=SeqID_150050
taccagctcagctctgtctgcagagccagggcttcgctccttttgcatgccctactccagatcagttcagggcagaggtcgcatggcccggagattggcctgaggcccaggcaggggaggctcccgacggtgcaggggacgcccacatggatgaggagatgacagatttactcgatttattgggaggaagcggagccacaaattttcggcgttatggctctcagttatttcgtcaccgttttgtgacttaccattttcatgcgtttctcgttcacctcgtggttagacgtaagtag

SEQ ID NO: 58366 - DNA, 569 bp, Glycine max
  Peptide Sequence Number=SeqID_150051
atgtgtcactttttaatgcatacgttggggcacctccaaaggcaagcattccgcaaagtgtacgaaaagattttagatttgaccacagcggaggtatttacgaaagtcgttgtatccctcgcccaatactatgaccagccgttgagatgcttcacgtttggggacttccaaatagtatcgactgttgaagaatttgaggagatattaggatgccctcttgggggaagaaaaccgtatcttttctccgggtttcttccctccttgagcaagattgcagctatggtcggagattcagcgagagagttggatcgtatgaagcaaactcgaaacggcgtagtgggcctaccacggaaatacttggaaggcaaggcaagggatatggcgagtcaagaagagtgggtcccgtttacggatatactagctttgctgatctttaaggttgtcctcttttcaaacatggacggtttggtggacctagccgtaattgatgctttccttgcatatcaccatagcaaggagagcccggtggtagctatcttggcgaacttatttgatatatttgaccgaag

SEQ ID NO: 58367 - DNA, 132 bp, Glycine max
  Peptide Sequence Number=SeqID_150052
ggtcagtatgacaacatgcttgatgcaatcctccctaggaagggaccagtcactagagccatgagcaagaggctccaagaggattgggctagagctactaaagaaggccctagggttctcatgaacctcagg

SEQ ID NO: 58368 - DNA, 870 bp, Glycine max
  Peptide Sequence Number=SeqID_150053
atgttcttctcctcaagtgtacggtggcatgctgggccgccgacagacgctcgcagcacagctcgtccatcatcttttgccccagcgcggtcaggcgcggcacggccaccagaacatccggctgtaccatgtcgctcagcatggtgcacgccatgtccatgccgtcttctgcgccgtactgacgcacaaaatgcccttccaggtgcaaggcaatcgtcatctgcagttcgtccagcgtgtacccgagtctcacccggtaaaaggcgcaggtatccagataggcctgcgccacggcgcgacggaaaacggcggtacggacttcaatcggtaaacaggattgggtgttcatgcggcgggtgcctccatgctggcaagaagttggggttcacaggtgttgacgacgtgtccgagctggtcagtcagcacggcaatgaccgacgcaaaggcagctttctgaacggcgtccggacactggccggaagtccgaatgcgagatggcgtaatggatttcactgtggaaacgggcagccagtgtgttcatgccacctcctgtacgggcagacgaccggcaaacgccagaatgtagtcacgcgccagcaaacgtcgggcgctgtgctcagagttggccacggtgcgcagcatgcacggggttgccgtcagcgcagagcggcgcacggccgcaaacagaaagcagaatgtaggatgagtcgggatgagggtcgtagccatggtggcagcctccttgaagtaaaggttattgctaccactgaagttcctacgcttatgggtggtagcccaaacgggggtaggaataccggccttcaagggaaccggccagcccgaaagctgccccgcctgagctaccattga

SEQ ID NO: 58369 - DNA, 369 bp, Glycine max
  Peptide Sequence Number=SeqID_150054
atggctgccagtgaccacgcaactttgcatgatacagttcatattcctaccaagaagagtttattggagctttcatcacaaaatgccttgttacaggttgcacactttgtggcggagctcatgggcggattttctggatttcaacatggccaaccttaccagcagcataatcaatggagaaatcaccctggtaatcagttcaataaagaccagggtgggctacctaacaggccacaacaacaagggcctagtttatttgagagaataacaaagctggaagaaactcttgctcagtttatgcaggtgtcattgactaatcataagagcacagagtcagccatcaaaaatctagaggtccaagtaggctag

SEQ ID NO: 58370 - DNA, 354 bp, Glycine max
  Peptide Sequence Number=SeqID_150055
atgtttaatacccattgccacggaatccgtaaagttccaggatgtttcgaaaagaaaacaacccaaaacacaaaagtggggggggtgaacttatcaaacacaggggatgcactcaggaaacttcatccagaacattgtaaaaggtggggtgaacttatcaattatggggtgcattcaggaatcttcctcaagaagcctctgggcgaaaaaacgtgtttccgtgaagaaaatccaagccgaggtgcttccgtaatgcttctgagacgtttctgtgagcaaatccgtgaagattttctgtcgttcttcaccattcttcatccattcttcattcgttcttcggtcttcaaccggtaa

SEQ ID NO: 58371 - DNA, 165 bp, Glycine max
  Peptide Sequence Number=SeqID_150056
atggaagaagaaggcggaagacaaaagagaagaggtgagaggaggcgtcatccactagggaataagccatggaagaaggagcttcaccaccaagatgagccttggataagaagcttgagaggatgctttaatggagcccaagaaagaggggggagcatgaattga

SEQ ID NO: 58372 - DNA, 132 bp, Glycine max
  Peptide Sequence Number=SeqID_150057
atgtcgaccaagcaaggtcctgttgctgaagacatgtttcactggcaggcaacaattatgggtcctccatattttgtctttttttttcttgattatctcataacagctcttattcctgaaactatgttttaa

SEQ ID NO: 58373 - DNA, 261 bp, Glycine max
  Peptide Sequence Number=SeqID_150058
ttagctcacaacagccctcgaggttgtcctcctagtcctataccaacaaggacaaagcctacatcagctgagtcgcaacctccagtagtagacctacctgcttctccggaggttgagatactatctcctccgccagctccaccggcaccacctttgatactcattcctgatgactcagatgctaaagctgctgctcctcctgactcaccagcctactacctagaggatggttcggacttttctgactggatggacaattga

SEQ ID NO: 58374 - DNA, 294 bp, Glycine max
  Peptide Sequence Number=SeqID_150059
atgacttcctcttcaagctttattctctgcatgtcttcgcacaggaaaatctcttataactctctggattcagacccttctctctctagaatctctcacatgcagaatctctttgagaaaatagccaaaatccttggaacttggacctttctctctctagaaatctctaaacatgcaaaagcttcgagaattgcccaaactctcctccacaatctgatttcaggcttaaataggtggctttattcttcctcgcgctcagccgaagagtgttgcgttcagcggttagctcactaa

SEQ ID NO: 58375 - DNA, 288 bp, Glycine max
  Peptide Sequence Number=SeqID_150060
gttggctctccaaattcaaagttgtccgatgaggagaaattcgaagctccggaggaagatgaagaagtccgagctctaaaggtagagctagggaaggcaagacttgccaaggagaagttcaaatcagctgctacacacatctggaaggagtgcatcgatttgcaagaggaaaacgcggccactacaaaagcccttgaacaagaaaccaaaagggcccgcaaggaggaatatggccgagagaaattccgaggagcattgtggggtagtaacaatgagctcaagctctga

SEQ ID NO: 58376 - DNA, 752 bp, Glycine max
  Peptide Sequence Number=SeqID_150061
atggctccgaggaagcttatcactaaaagggctaggaaggccaccgtaggggagggatccagtgcagcctcgcaagcggagattgagttttatggacatcattttcaaagcgaggagcatgagtgttgtttcgaagcgattaaggattggtctttccttaaagaaagacgggtccaactaaggacgcggtggacccaactgacagagcccatggctaagtatgaccctgagatagtcatggagttctatgcaaatgcctggcccatggaagaaggagtcatggataagcgttcctgggtgcagggccaatgggtcccctatgatgaagatgctatcaaccaattcctgggacatcctttggtcctagagaaggggcagcattgcgaatacaccaaaagaagaagccaagtctcagggaggcgggtgcggatcatgcgcactagcatgaccactttgacccagatctggatgatgcttttgctcaacaacatccttcccagtgaccataattatgatctctcgctgcctaaattccagttggtctatgctatcctgacccagatcagtgttcatgtagcacaacttatctcggatgccatctaccagtttgtaggtattgcacctctgagacacctagtggacccgaaaaagtccaacagggcactgagatttccagcattgatcacaggtctcttccaattctatgtggtaccgggttacgcccacaagctcatccggcctcccattaacag

SEQ ID NO: 58377 - DNA, 555 bp, Glycine max
  Peptide Sequence Number=SeqID_150062
agaccagttaccgagccagtcagatgcttgcctggccttgtctaactccccagtttcacaagcaagccaggcagatcaccttgttcagggatttcagagcgagtacttccaacaaaacgtctgcctagacagagcttccaaccacttggacccgatgatacacctgcaggtcatcctctgtgaatctgcaagacagggagagaaagacatgccggactcacaagagaaagacagccaatgcagtcagaatgccctattgagcgtcatgcctgaactcatgttccggagagtgcctgtcggatcacttatgcctatgcaaggagagagcaccgctaagggaaagttcaatcattgggaaggcctcactatctactggatttggtctaccgggcagctagatcggactggtagcatgctgagagtcctcgggtcagtcaagaaagctgccagttctattctacgagctgcttccaaaggtgagaaagcctgtttctctgagctaggacacatgtccggaaaagaatccgaggtctatgatgccgaaccgacatccct

SEQ ID NO: 58378 - DNA, 207 bp, Glycine max
  Peptide Sequence Number=SeqID_150063
atgcaaatgccttatactaggtgtcctatttgtccacagttcaaaggtgtctttggaattgccttactagaaactctattcaacaaatacatggcagttttcaaggaatacatccacaaagatacggttctattgcgcctttctgatacaccatttggttgtggtgtaccaaacattgtgtattatgcacaaatgccacgtttctga

SEQ ID NO: 58379 - DNA, 114 bp, Glycine max
  Peptide Sequence Number=SeqID_150064
atggcctcctcaaattctctatttcccgaaggaaactccatccctaggccacctatctttaatgatgaagtggaagacaaaggagaagaggtaagaggcggcgccatccactag

SEQ ID NO: 58380 - DNA, 288 bp, Glycine max
  Peptide Sequence Number=SeqID_150065
atggagacacttcagaaggtctgtaaggcatgggaggtgttgcaaaagaaggacaaggagctcaggggcagtaacaatgggcccatcggtggttaccataagtggttgaaagcccacgtgcaagaagttgaggcaccagaggaagacgaagaggtgcaggcccttaggacagcactcgagcaagcccaaacagtcaaagaaaggttcaagtcagcagctctgaagattcgtaaggagaatgccgaactgagagatataaatgtagctaccaccaaagccttggaataa

SEQ ID NO: 58381 - DNA, 584 bp, Glycine max
  Peptide Sequence Number=SeqID_150066
gagcaagagcctcgcttttgtcgaccacaccgccttttgttgccatgactcaagagctggtagcccgcggagacaccttacggttatccgcacctcgtcattcagtgaccccaagtgtgattcacgagcagagaccaatatggtcatctgcgccctttccggagatgtcagcattttccgatggagacttttcaagtctcacaagttatctagaactacgtcatgtgacgttgcacccttgtatgatacgcagagataccttacggttatccacacccttttgtcatccagaggcggcgggcccgatgacaagcagagaccaaagaccaagtttggtcattttgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 58382 - DNA, 300 bp, Glycine max
  Peptide Sequence Number=SeqID_150067
gtcaaaaggtctttctctattggtgttggtgcgattacctcctttggttaccgaaaggatgttgatggtcagtgggttcgcaaacaggacttgtcattgcctattcccgacgaacgtaccccatctcctccaccacaaaggactgattccacttctcttctgactgaagtactcacagagctccgcgaccttcgagcttttgtggatgagcgcttcgatgccatggacacccggattactaggcttgaagatgatatgagcttcatcaggcgttgcttcaatccccctgtcaactcttag

SEQ ID NO: 58383 - DNA, 897 bp, Glycine max
  Peptide Sequence Number=SeqID_150068
atggccggtgctatagttttcatcgggaacaacggaagctcccccaaagtcagcttctgtgaccttccggttatagaccaccttccagtcatggtacgccgcgcagtcgcgcagcgattcaatgcgcaccacgttctccgccacgccgttcatcatcagcacgcgctcgatgcccgtaaaccagtcctccgcctggttgagcgggaaccacaggttgctgttgatgccgctcagcagcggatcgttgcagatgtggataccccgcccgtatcgggtttcgctgccggtcactatcagttcgccgcgcagctcgcgcgtgacggcgcagcgcgccagttctgtgaccacatcatcccagcaccactctttgtcctccggcaccggcagctcgacgcagcgcagatgcttgttgcccgcccgggcggcttcgtcgccgttgtccaggcggataaagcagaattcgcccagcgcgcgcgtgatgtcggcctgcgtcaccttttgctgcgccgcgtccggggacagggtcgccagttgcgtctggcgaccgttgagaaggcaggggcaaccctgccttttttacgtctgtgtgtcgtcggactccatgcggaggctgatatccgtcaggcgtgccgccagtgcgccgctcgcccgcccccagatcacctcgccccggctgccgaactgcgcgtgcacaatatggctcgccacaatccacgcgcgaaacgaggacagcggcagtgcgctgtcctgcacggtatcggcaatctgttgcgccatgtcgtgcagcgtgagccgcaggtgctcgtgctcctcgcgggcgctgaggcggtgctttcccagctccgtcagggtcgccagactttctgccaggcccggagtcaggcccgggatttctga

SEQ ID NO: 58384 - DNA, 185 bp, Glycine max
  Peptide Sequence Number=SeqID_150069
atggataaaaacaacttaaccaaacactttgttcacaaagaactatgtaggtctgatttccttatcgcaattaaggaatacgtaggagcaagggaaacaccctcgctgccatctcttgtgacggacgcatggggtgctaatgccttccccgtgcgtaaatacaactcccgaacctttcacttaaa

SEQ ID NO: 58385 - DNA, 513 bp, Glycine max
  Peptide Sequence Number=SeqID_150070
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccaatgccccggggtattcccagggtacgtgcaagttgcgttaggatcataccactttgggaaagagggttggtatatcatcccgggagttattacggccatttggttggcgataagggacgacaagaggtcttcgtacgtcattgggagtggggtgaattctggaattagcttcgggggaaagttcctcattgcgttggaattgccggccgagagagtcgtggttggagccggagcttggggggcctccctctggatgggtgccttaggctgcacgggtgttgaattggaggagttcccggcgcgagctaaaaagctcggatga

SEQ ID NO: 58386 - DNA, 297 bp, Glycine max
  Peptide Sequence Number=SeqID_150071
atggtcttgaaagaggagttagctgcctgctcaaggtccaaaagaagtttgtctcagcggttatgcgagacagagaccaacatgtcagctattatcaccaagtaccaagaagaactaaatctagtcgcggcccatgagcatagagtggcggacgagtatgcccgagtgtggatggaccggtttgctcttaccttgaacgggagtcaagaacttccccgattgctagccaaggccaaagcaatggcggacacctactccgcccccgaggagatccacgaacttctcagctattgttaa

SEQ ID NO: 58387 - DNA, 416 bp, Glycine max
  Peptide Sequence Number=SeqID_150072
tccaaactcaggagcacaggtcgcttgagcaaatggaccaatggcttacactcaattctggatttacatgcgattctcctcaaatttcagccagcccgcatcaattagaccttgcaccttacgcttcaggcccctacaatgctcaatggaatgccccagggcttctccatgacaagcacacgttgcgttcgagtcgtattctcggagaaatggaggttgatgaaccttggttagggttatggctaccattgaattatcaagtagatatgggagcaagtggtgtttgtcatcggaagtgcggtaggttggctttgtggttgattttagggatggcctttgtgaataactgggcggtgggtaaggagaagacccactttgatcctttcgtcggtgaagaccatatcatcaaagcttga

SEQ ID NO: 58388 - DNA, 494 bp, Glycine max
  Peptide Sequence Number=SeqID_150073
cgctagggaatgacatttatggctctccgaatgaaactggagaatggagaattggcggacagcactacgcaataacttcgcgcggctctagactcgaaggtggaggacacatgtatagcgctaggaaattacattcatgggtctccgaaaaaagtagagaatggagaattggcgaacagcgctacgcaataaattcgcggggctccagactcaaagcgctagggaatgacattaatggctctccgaataaaagtggagaatggagaattggcggacagcactacgcaataacttcgcgcggctctagactcgaaggtggaggacacatgaatagcgctaggaaattacattcatgggtctccgaaaaaacgctaggcaatgacattcatgggtctccgaataaaaagtggagaatggagaattggcgaacagcgctacgcaataacttcgcggggctccagactcgaaggtggaggatgcctgaacaacgctag

SEQ ID NO: 58389 - DNA, 412 bp, Glycine max
  Peptide Sequence Number=SeqID_150074
atggtcaaacagagctgcctcgcacatcttgatatgtattgggaccaggggagttcgaacgtgccggacgttcaggatgacaccgtcttcatcaccatcttgtatcatgttgacagcaggcccatggatagcaagttggcccggactagttttgcacttcattctcaggacatagcagttttcaacgtcatgacctggggccccttggcggggagtaagtcagcatatttcatcgggattggatcaaagggtattgtggctgatggtattgctgtggaggatattgttgtggagggtattgttgtggagggtattggtgtggagggtattgttgtggagggtattgttgtggagggtattggtgtggagggtattgttgggggtaatgtggcctttgttggtgatatgatgg

SEQ ID NO: 58390 - DNA, 524 bp, Glycine max
  Peptide Sequence Number=SeqID_150075
gatacgtaggagcaagagcctcgcttttgtcgaccacaccgccttttgtcgccataactcaagagctggtagcccgcggagacaccttacggttatccgcacctcgtcattcagtgaccccaagtgtgattgatgaacagaggccaatgtggtcatctggccttttccggagatgtcagcattttccgatggagacttttcaagtctcacaagttatccagaactacaccctgaggtcatgtgacgcacacccctttgctaggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacggttatctgcacccctttgctatgcagacacagttgtgtccgatggcacgcagagaccaagtttggtcattctgcacccatga

SEQ ID NO: 58391 - DNA, 324 bp, Glycine max
  Peptide Sequence Number=SeqID_150076
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaacatcaagctggagtgctggaacattgcctgctgaacttgatatagtatga

SEQ ID NO: 58392 - DNA, 273 bp, Glycine max
  Peptide Sequence Number=SeqID_150077
atgtgccctaacccacatcgcactttttgtcgttttattcatcgtccttcttcatcagcagctaaggcatcacatccatctattaatatcgaaagaccaaaagaaatcaagagaaaaattggggaagcgaaaaagagagaaaatgaaagaaggaatggtttgtggtggccaggtcaaatacttggctttgatcacctttctacttctcatcttacttctccttgttcaggaactcccgttaagcttctcagaaaggaagattccaacaagtaa

SEQ ID NO: 58393 - DNA, 366 bp, Glycine max
  Peptide Sequence Number=SeqID_150078
atggtggcacgggttatgctcaagcacggatttgagcccggaataggtctaggtaaggacggcctcgggaatgccaacatagtcgatattaagggaaatccgtacaagtatggattggggtatgaacccgggaagccggggaggaggaatgtgccgtcaagacttcgggcggatagagtatggcccggccgtattagccagtgtttcaccagtgccggaatggtgtccgaggaagaagtggccgtagtaggagaggagttccctcaagacccgccaaatttggtgcaaccatgccatcccgattcccaagtggggaactggcacgtgataagccagtcagaggtctatgccgctgattcaatgtaa

SEQ ID NO: 58394 - DNA, 252 bp, Glycine max
  Peptide Sequence Number=SeqID_150079
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggccttaccccctccacacaatattcccgtttctatccttcatagtgtatttgttagaggggacctcgtgaggttcgagataggagaagatgaccttgaagcttcacagctatag

SEQ ID NO: 58395 - DNA, 534 bp, Glycine max
  Peptide Sequence Number=SeqID_150080
atggagagaagtatgatagatgttgccaatggtggagcccttggagacatgacccctactaaagccaaaaatttaattgagaagatggcttcaaactcccagcaatttagtgttagaagtgatgctattgtcattagaggagtgcatgaagtagccacgaattcatcttcatcagccgagactaagaagcttgaaggtaaactagattccttggttaacctggtaacccaactggccgtgaatcaaaaatctgcacctgtcgccagactctgtggtttatgctcctctgccgaccaccacagtgacctttgtccttctgtgcaacaatctgaagcaattgaacagcctgaagcttatgctgcaaacatctacaacagacctcttcaacctcaacaacaaaatcagccacaacagaacaattatgacctctctagcaacagatggtcgaatccttcacaacaacaacaacaaccttattttcaaaatgctgctggctcaagcagaccatacgttcctccaccaatccaacagtaa

SEQ ID NO: 58396 - DNA, 342 bp, Glycine max
  Peptide Sequence Number=SeqID_150081
atggccaccacaccccccgttttgttgaaaaatgggattccggggcttccgggacacccaacgttttttggagctgggttgcttctgggcgagctaacgtcgcctgggcgagctgggcggcaacctcctccccctttttcctataaaaaggctgaagggggctgttctaaggacccctcagccccctggctatgtatttcagctgttttgggtgaaaaaaattgtttccgtgaagaaaatccaagccgaggtgcttccgtaacgcttctgagatgtttccgtaagcaaatccgtgaaggttttcgtccgttcttcatccgttcttcattcttcaacgggtaa

SEQ ID NO: 58397 - DNA, 327 bp, Glycine max
  Peptide Sequence Number=SeqID_150082
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtggagcttgccgcccagatcgcccaggcgagctctgctcgcccaggcgagtag

SEQ ID NO: 58398 - DNA, 102 bp, Glycine max
  Peptide Sequence Number=SeqID_150083
atggattatggaaccctgcaaaggttctcaaaactcaaaagggactccatcgagaactacaatggaagaacccatatatcagcaacttgtcctctcttttga

SEQ ID NO: 58399 - DNA, 354 bp, Glycine max
  Peptide Sequence Number=SeqID_150084
atggaaagaaagcctcaagaggctaacattaacctctcatacttccatgggaaggaaaattatggctctcactcatattcaaagaaagaccaaggtcaaggcatcttaggggtgacaccttctaagcctaaagatgataaggggaagacaatagaaaagcaaccccctaagactagtatgcaagagaagactagctctacaaagtgctttaaatgtcttggaagaggacacattacttctcaatgccccaccaagaaaaccattattatgagaggccaagacatttatagtagccatgatgcggctactacttcaccttcctctagtgaaagtgaaaaagcggggatcctctag

SEQ ID NO: 58400 - DNA, 468 bp, Glycine max
  Peptide Sequence Number=SeqID_150085
atggggacgaggggttgcatcagctacaatcctgttcttgctataagacaactgggctaccctatgagaggggcgccactagaggatgagctcgtgcctgtcatttcacgaggtttcaataagaccaacgtggagacacttcagaaggtccacaaggcatgggaggtgttgcaaaagaaggacaaagaacttaggggcagtaacaatgggcccatcggtggctaccgtaagtggttgaaagccctcgtgcaagaggaagttgaggcacctgaggaagaagaagaggtgcaggcccttagggtggaactcgagcaagccctaacagttaaagaaaggttcaaatcagcagctctgaaaatccgaaaggagaataccgaactgagagatgtaaatgtggctaccaccaaagccttggaacgagaaaccaagagggcttgtagggaagaacacggccggaacaagttctga

SEQ ID NO: 58401 - DNA, 579 bp, Glycine max
  Peptide Sequence Number=SeqID_150086
atggataacgaagaaggagtgcaagaacaaatgaaggccgacctatcggccttaaaagatcaaatggcttctatcacggaggccatgctaaagcttcaaaaaactatagaagataatgctacggcggtcgcttccaattcagctagggaagcggaaccggtgctacagcctgcaataaacttgggccgagacagaaacacgacgggtttcaaccggaggtatattcctcaagcctacccttatggtttgcctccggacttcactccccgtaccgctcctgacgatttgagccaagcccctaccttcaaggggcagctccctcctcatgccgactatcctctgcaagaagatgaggaaggagatgcctatttaggccctctacttcccctcaaggatccagccccctatgagttgccccaaccaaacatagtccgccacgtcccgcctccatccgcacccgttaaggaaatcgttccttttgcaaaagacaagggaaagattgatttacttgaagagaggctgagagcggtagaaggcctcggcaactacccgttctcggatttagcggatctgtgtctg

SEQ ID NO: 58402 - DNA, 408 bp, Glycine max
  Peptide Sequence Number=SeqID_150087
catgagggtttttacttattgtggaatgcaagaggtgtagctgggggtgatactgagggccctccaaagtgtttggcatgggtataccaccaactgcttacccttcagtggcatatccgaggcaaggctcgaagtcggttagattgtggtggggaatttcatgtgtctcccccacggtttaagagacatgtgcatgatcagtttgggttgtcggctttcaatgagtatgggagcggagttattgacatcctcattgggaatgtatgccacattgggtggtgtatagttgggaggcaagccatatggtgggaaggcatgcttgttttgaatttgcgcataatggggggccgtccctacttcccaaatctttgcctaccatatttgaggttggatgattcatttggttga

SEQ ID NO: 58403 - DNA, 303 bp, Glycine max
  Peptide Sequence Number=SeqID_150088
atggtggtgcgagtctttgatggtactcggtgggaagtgatgggggaaatcggggggtcccattcagataggcccccgggggtgcaatgtggtgtttcaatgataatgtcgggtgaagaggatatgttagtgagctgcccctcctccgcaccgtacgtagaagaggcggaagaatcattggaaacagctttccaatcctttgaggtggtgagctgcgcctctgtggaaccaagtccgtcgctaccttctctctccaaagcggccataatggtggcgcgtgttatgctcaggaacggattttga

SEQ ID NO: 58404 - DNA, 527 bp, Glycine max
  Peptide Sequence Number=SeqID_150089
atgcaatcacagggacttgcactgcctccggagcctgaggttgctccttcagggcctcgtgtcggcacaaaggagagttgtgttgatccctcagggaacgatccaaagatgggtgactcaaacaagtgtgggctgtacatcgaagcaaatccgccccacctggttgcccttggaagactttatgagggatcaacagttcacaacattcctttgttgcctggccaagtgaaggttggtgttgaggaggttaaagatgcacaagctcccgttcttgtacccactgatgaggttaccttagtggggcagacacttaacaccttccttgcttggccgacacatctcatgaaggctttatcacaagcagttgtttctccagcaaaacctccacaaaggccggatcctgaggtcgatgatccgctatatttgatgacattgaccatcccagagcttttcttgcagcctttccaggttaactgggatgctaccatgtttggagtgtgtcatccaaacttcccgttgtacataaa

SEQ ID NO: 58405 - DNA, 252 bp, Glycine max
  Peptide Sequence Number=SeqID_150090
atggcatcgaaggtatcttgccttgggtataacaatatctctaagggctaccgtgtctacaacttgcaaactaagaaactcgtcatcatggagaagaacgttcttgatagtcgctcaactactctcaagaagaagatgaggaagaagacccaggtgaactacaccttcacctccatcacaacaacaagatcaagaactatcatcaccagagtctactccaagacgagtaagatctttggtggacatatatga

SEQ ID NO: 58406 - DNA, 192 bp, Glycine max
  Peptide Sequence Number=SeqID_150091
atggccaccctccattgtctcagggcacaggcacacccacgcaaaaaaatcccaaacatggttgacggaactggggaacgaggactattttttttggattctttgacgtccaaacatgagaaatggccgccctccattgtctccagggcacaggcacacccacgcaaaaaaatcccaaacatgggtacttga

SEQ ID NO: 58407 - DNA, 171 bp, Glycine max
  Peptide Sequence Number=SeqID_150092
atgaggaatctccttgggaaaaacatctttaaattccctgatatgaatggcagtggaatggagaaggaagagagagaggagacgccacttcaaggagaagatgagtctagaagaagctcaccaccatatgaggccatggataagagcttggaggaagaaggagatgaatga

SEQ ID NO: 58408 - DNA, 411 bp, Glycine max
  Peptide Sequence Number=SeqID_150093
atggttaaggaggagtgtaaggaggtaagtgtctcctccaagagattagctaagaaggaaagtcattttgaaataaagacaaatattaaagaaacttcccctcttagacaacctccacatcttttcctttgtaaaaagacacttgttagcactgtcacacctcttgggcttgatattattcctcaagtaaaggagttattggatgagggtttggttcgtaagagcttaaatccttgtgctttgttggtgaccaaaataggtattattaggcatcaaatccctaaaataggtgatatgatgaatgtgttgagtggtgcaaccctcttttgtaaaatcactcatacacccaatatcttcaagattcgtgtagatagggactcattagataggtgctcatatggcacaccttag

SEQ ID NO: 58409 - DNA, 402 bp, Glycine max
  Peptide Sequence Number=SeqID_150094
atgttggggaagcttgggaggattgatgggggacccggtgttgagagaaacgaggattgggctacgtgggagtacgtgagctcagttggagggtgggcaacaggggatgagtggtacctggagatatgtcgcgggggtcaggagaccttggggacgtcaggtggggtgctattgcccaaaaccaagcttgaccaatcccgacccaacccgggtgtcgcaacctacccttcggcgggagggcgacgcgtgacttgcgggatgcgtgttccacggaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 58410 - DNA, 535 bp, Glycine max
  Peptide Sequence Number=SeqID_150095
ccatctgactgagacaagtgtgcgagcggggaatgctgatgtgtatggattcctcgagccacagtccattcagagatctggacaatcacaatttgaatccgaaagttacatcaagagttggatacagagttcaaaacgagatgtttaccttggagcctatctgaatagtggacactggcaaatggtcgtcattctacctaaggaaaacctagttgtctggttttgttctttgcataacaggccagacaactaccttaagggaataattaacagtgctttgaaaggacttgatgatactccacaaccgaaatccaaggctgttgctaggtggattgttgttaagtgtaatagacaaaaaggaatcactgaatgtggctactacgtgatgcactggatgtccacgataatcttaggatctttcaggaataattgggagacgtattttaatgaagttagaccattggaagcagagagatttaaggcacttcgcatacagtgggcacaatattatctaaaagttagaaatcaaacatag

SEQ ID NO: 58411 - DNA, 357 bp, Glycine max
  Peptide Sequence Number=SeqID_150096
atgtctcaacatatctatcatacagttgtggattctcatctgactgaaacaagtatgcgagtagggaattccgatgtgtatcgattccttgagccacaatctattcagaaatttgggcaatcacagtttgactccgaaagttacatcatgagttggatgcagagttcaaaacgagatgtctgtcttggagcctacttaaatggcggacactggcaaatggtggtcattctgccagacaactaccttaagggaataattaacagcctaaatccaaggctgctcctaggtggattgtcgttaagtgtaatagacaaaaaggatgtagaagcaagcttcatgttgatgaatcaagattga

SEQ ID NO: 58412 - DNA, 159 bp, Glycine max
  Peptide Sequence Number=SeqID_150097
atggctaccattgcattatcgagtggatatgggagcaagtcaacatgggacaccggaattgggggatcctttgtggataactgggtggtgggtaaggagatgggttgttattggctgagtaatgacattgttgggttggtgggaaacttggccatatag

SEQ ID NO: 58413 - DNA, 599 bp, Glycine max
  Peptide Sequence Number=SeqID_150098
ttgccgctattagcgctgtcgctaaggtgatcccgatgctcccatctggcctcaagcaaatgaatcatccaacctcaaatatggtaggcaaagatttaggaagtacgggcggcccccatgatgtgcaaattcaaaacaagcacgccttcctgtcatatggcttgcctctcaactatacgccacccaatatggcgtacactcccaataagaatgtcaataactccactcctatacccattgaaagccagcaaccccaaactgatcatgcacatggcaagcagttggtggtatacccctacaaaaccctttggagggccctcagtatcacccacaactgcacctcttgcattccacagcggttaaaaacccttatgactatggcaggaatgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcggaagatgggggcatacgcaaaatatga

SEQ ID NO: 58414 - DNA, 577 bp, Glycine max
  Peptide Sequence Number=SeqID_150099
atggttatgggagatttcatcagcagactctccttccccgaaaacaccgagactttttcaagcctcacaagttatccagaactacgtaggtctgagttcctcattggaggatacgtaggagcaagagcctcgcttttgtcgaccacaccgccttttgttgccataactcaagagctggtagtacgcggagataccttacggttatccgcaccccttttgccattcagacacagtcgtgtccgttggcaagcagagaccaagtttggtcattctgcacacatgatacgcggagataccttacggttatccgcccccctttgccattcagacacagtcgtgttcgatggcaagcagagaccaaagaccaagtttggtcattctgcacacatgatacgcggagataccttacggttatccgcccccctttgccattcagacacagtcgtgttcgatggcaagcagagaccaaagaccaagtttggtcattctgcacacatgatacgcggagataccttacggttatccgcccccctttgccattcagacacagtcgtgttcgatggcaagcagagaccaa

SEQ ID NO: 58415 - DNA, 90 bp, Glycine max
  Peptide Sequence Number=SeqID_150100
atgaaggatgcaccagttgcagaccctaaggactacatacagccacctaggccccaggttccagtggcatttgacccccctccacatgtg

SEQ ID NO: 58416 - DNA, 438 bp, Glycine max
  Peptide Sequence Number=SeqID_150101
catgggataacaccacaggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggaatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgtt

SEQ ID NO: 58417 - DNA, 330 bp, Glycine max
  Peptide Sequence Number=SeqID_150102
atgttttccaagaagaaaggaatgatgagaatcatgaaactggccaaatacaggctaaaggcccaagtggagaaggacgaaggcccaagtggagaaggacaaagcccccgagtggagaaggatgaaggtaatccttgtggcgtctacccagacttatcttccttcattggaagtggcgtctacccagacttatcttcctttaccagaagtggcgtctaccccgacttatcttccttcaccggaagtggcgtctaccctgacttatcttccttcactggaagtggcgtcatccaaatcttcgtagtctgtatcaaacgatccgccccgtaa

SEQ ID NO: 58418 - DNA, 302 bp, Glycine max
  Peptide Sequence Number=SeqID_150103
acctaaagaaacttggttaccacaatgaccctttcatcatggcaaaacaagctagacaaggcaaaacaattggtgttaatgtagaagatgatgattcatacatggacacctatgttagtcctttgaccgctcaaatcactcctaacattgtcggagaagaagaagctgacgaagttcatgctaatcgtaatgatcatgatgaaggagaattgattaacatcatggcatccttaggacttcatacagctcatgtttgtcgccagtttcatcatccaccacccttaccttctttgccttctcac

SEQ ID NO: 58419 - DNA, 567 bp, Glycine max
  Peptide Sequence Number=SeqID_150104
atggtcattccacgggagaggcgtgtccagctcagggaggatgagtatacggacttccaggaggagatagctcgcaaacgttggacaccgctagtgactcccatggccaagttcgaccctgagatagtcctagagttctatgctaatgcctggcccacggaggagggagttcgggacatgcgctaccagttcctgggcgacccactaattttggaggaaggccagcagtgtgagttcagccagaggaggagcagggccgatggtttcgatgaggaagtcatcgcccaactgttgtgcataccggggcaggattttgcccggaccgctgcagggaggcgggtgcggatcatgcgcaccaacatgaccactttgactcagacatggatgacactcctgctcagcaatgtcttgcctagcgatcacaactccgacctccctttgcctaagtgccagttggtgtatgccatcctgacacagatgagcgtccacgtggcccaggtatggcgcctactaggcaccctctggacccagataagtccaacagggccctggggtttcaggcactga

SEQ ID NO: 58420 - DNA, 181 bp, Glycine max
  Peptide Sequence Number=SeqID_150105
ggccctgggttttccagcattgatcacgggtctctgccagtcgttcggggtcccgtcacacctagtaaggtgattcgaccgtcgatcacccgggccttcattgagaagtattgcacacctagacaggcacaggtatttacaacatttggttcgccagcaggcggccaaccacagggggcag

SEQ ID NO: 58421 - DNA, 438 bp, Glycine max
  Peptide Sequence Number=SeqID_150106
atgcatcttttcatgaacatagctgcttgggcttcacatataaacatgtatcatctcaatcatctagttaaaaagaacttagtaattggtattccaaaactcaagtttgagaaaaataaattgtgtgaagcatatcaaaagggaaacaagttaaaaactcttttcaaaatttatttggaccctcaagaactgagtttaggtggcaactactatggcttagtaattgtagatgattatttaagaatgagaaaggtcttaatattgtttcaattagaagtgatcatggaggtgaatttcaaaatgagtattttgaaaagttttgtggagaaaatggaattcaccacaatttttttgccccaagaacaactcaacaaaatggtgttgtggaaaggaaaaatagatcccttgaaggagctagaactcttcgggatcctctag

SEQ ID NO: 58422 - DNA, 153 bp, Glycine max
  Peptide Sequence Number=SeqID_150107
atgatgatacatcaacctttagcagcaatccaaaaacccatgacgggtcagaaagccctggggcgttccattgagcattgtagggctctgaagcgtaaggtacaaggtctaattgatatgggctggctgaaatttgaggagaatcgcgtgtaa

SEQ ID NO: 58423 - DNA, 666 bp, Glycine max
  Peptide Sequence Number=SeqID_150108
atgtactctatcgcaattggtatgagtatggcagccacagcggtggtttcacgacgggtgggagaaaaagatcctgatgcagcggcacatgccggaaacgctgccattgccatgcggagtttatggattgccaatatctgcaatatcatcctgtgtcctatattcattaacggctggggtatcatccctgcattcggactaactggagcggctatggcaacggttatcgggcggtcaatgggagtggtttaccagctattttgcctgtttaacggaaagcatcagctaaaaatcaaactccatcattttcgtattgactggccggtaataaaatcattggttgggattgcaactcctggtatacttcagtttgttatcgggtcatgcagctggatatttcttgctgagctggtagcaaccacgggtggtgatcatggatctgccggttatcagaccgcattgcgattgatgatgttctttatgctgccagcctggggtatgagtaatgctgccgctaccctggtagggcaaaaccttggagccaaacaatttcagcgcgctgaagattctgtcctggctactgtaaaatacaatgtcatcttcatgatcattgtcaccatattatttctcttttttggagattggctggttcatttttcacaatga

SEQ ID NO: 58424 - DNA, 891 bp, Glycine max
  Peptide Sequence Number=SeqID_150109
atggctatggtacaacccaaatctcaaaaactgcgcctcctcgtgacgcacttaggtctgctgatttttatcgcggcgatcatgttcccgctactgatggttatcgccatctccctgcgttcgggtaacttcgccaccgggagcctgatcccggacgaaatctcctgggagcactggaagctcgcgttgggcttcagcgtggaacacgcggatggccgcgtcacgccgccgccgttcccggtcctgctttggctgtggaactcggtgaaaatcgcaggtattaccgcggttggtatcgtggcgctttccaccacctgcgcttacgccttcgcccgtatgcgtttcccgggcaaagcgacgctgctgaaagggatgctgattttccagatgttcccggcagtgctctccctggtggcgctgtatgccctgtttgaccgcctgggccagtatgtgccgtttatcggtctcaacacacacggcggcgtaatcttcgcttatctgggcggtatcgcactgcatgtgtggaccattaaaggctatttcgaaaccatcgacggttcgctggaagaagcggccgcgctggatggcgcaaccccatggcaggcgttccgtctggtgctgctgccgctctcggtgccaatcctggcggtggtgtttatcctgtcgtttatcgccgccatcaccgaagtgcctgtcgcgtcgctgttgctgcgcgatgttaacagctacaccctggccgtagggatgcagcaatacctcaacccgcagaactacctgtggggtgactttgccgcagcggccgtactctctgccatcccgattaccgtggtgttcctgctggcgcagcgctggctggtcaacggcctgacggcgggcggtgtgaaaggttaa

SEQ ID NO: 58425 - DNA, 915 bp, Glycine max
  Peptide Sequence Number=SeqID_150110
atgaaaatgaagaaaagtctcgtcgcgctgtgcctctctgcggggctgatggcctgtgttccggcggtctccctggcagatgtgaatttcgtgccacaaaataccagcgctgcgccagtctatcccggcggcggcgctccagcaactgacctggacaccggcggacaacagctgaacgtgccggggatcaccgggccggttgccgcctacagcgtgccagccaatattggtgaactgaccctgacgttaaccagtgaggtggacaaacagaccagcgtatttgcgccgaacgtgctgattctggaccaaaacctgacgccttctgctttcttcccgagcagctactttagctatcaggagcctggcgtgatgagtgcagaccgcctgcaaggcgtgatgcgcctgacgccagccctgggacagcaaaaaatttacgtgctggtcttcaccaccgagaaagatttgcagcagaccacaaagctggttgacccggcgaaagcctatgcgaaaggcaccggcaactcggttccggatattccggacccgcttgcccgtcataccacggatggcctgatcaaactgaaagtctccaccaacagcgcctccagcgtactcgttggcccactgtttggttcctctggcccagggccggtgaccgtggggaataccgctgcacctgtctatgccgcgccagctgccacggcagccgcaccggtagcgaccgcagcgccggccccggcgaagaaagctgagccggtactgaacgacaccgaagagtacttcaacaacgccattaagcaggcggtgaagcgcggcgatgtcgataaagcgctgaaactgcttgatgaagccgaacgtttaggttcaaccactgcccgttccacctttatcagcagtgtaaaaggcaaggggtaa

SEQ ID NO: 58426 - DNA, 90 bp, Glycine max
  Peptide Sequence Number=SeqID_150111
atggctaagcaacttaacatcttgtcgcaacctacccatcggcaggtattagcaccctacgcgtccgccacaaggaacgacagcctttga

SEQ ID NO: 58427 - DNA, 642 bp, Glycine max
  Peptide Sequence Number=SeqID_150112
atgaccggccctctcgatgaggaaatctcttgctttctcataagggtggacccttggttactagtacctactgcctttagagggctgcacgccttcgcctttagaggactgcatgtcctcgccttaagagggttgcacgtcctccccttcagagggctacacgtcctcgccttcaaagggctgcatgccctcgccttcagagggctgcacgtcctcgccttcagagaactgcacgtcctcgcctcaagagggctacatgccctcgccttcagaggattacacgtcctcaccttcagaggattgcacgttctcgcctttagaggactattcgtcctcgcctttacagggatacatagggctccacatccacgccttcagggaactcaaggtcctctgcctttaatgcttaaccaaaacttgcactcccggttcctaggccacccccctgatctcagaggagggccaactgtgcgagcacaaccagaggaggaggtaggtctccagcttcgacgaggaggctatcacatagctactatgcataccggggcaagatttcgctcagaccacagcaaggagacgagtacggatcctgtgcaccaacatgaccactcttacgcaaatatggatgatgttgctacttag

SEQ ID NO: 58428 - DNA, 314 bp, Glycine max
  Peptide Sequence Number=SeqID_150113
ggtacatcctttgtggtacaagtagagggtacatctacttgggtttgactgagaacaagagagggtacatctcttgtggatcagttctagtggagggtacatccactaggttcaaagagaacaagggagggtacatcccttatggatctttgcttgcaaaaggatttttacaaggtgaaaagaggaagttgcaactcttagagctagaggaaatgaggatgaatgcttacaagtcttcaagattatacaaggagaaagtgaaagcctatcatgataagaagttgctcaagacggagtttaagctaggacaacaa

SEQ ID NO: 58429 - DNA, 222 bp, Glycine max
  Peptide Sequence Number=SeqID_150114
atggctagcgctgttcatgtgtcctccacctacgagtttggagccacacgtagtgattgcttagtgcaattctccaacctcgcctttttttcggagccccatgaatgccattgcctagcgctattcatgcatcctccaccaacgagtctggagccccgcgaagttattgcgtacaactgtttgccaattctccattctcaacttctttttggagccccatga

SEQ ID NO: 58430 - DNA, 297 bp, Glycine max
  Peptide Sequence Number=SeqID_150115
atgtcatctatatctgttagctgtgtgatagcctccctctctggttgtgctcgcacagttggccctcctccaatatcagggggtggcccaggaaccgttaaaaggaaactactggtgtggatatggagcccactgaaagtgaggacgcgtagtcctctaaaggcgagggtgtgtagccctctgaagttcaggacgtgtcgcctttcgaaggcgagggagtgtagtcctatgatggcaaggacgtgcaatcctctaaaggtgagggcatgcccccctttgaaaatggggaacatgtag

SEQ ID NO: 58431 - DNA, 399 bp, Glycine max
  Peptide Sequence Number=SeqID_150116
atggtggcccgagtgatgttggggaatggttacgagcccggaatgggtttagccatgaacaacggcggcaaaaccagcctgataagtaccagaggaaaccgtgggaagtttgggttaggctataaacccacacaagcggacataagaaaaagtgttgggggaaggaagagcggaagccaaagctcgcaattgggacgaaaagtcgaagggggcccgccctgccacatcaataggagctttataagcgcgggtctaggacacgaaggacaagttgttgcgatatgcgaagatgactctccgagtgggacggatttggtacgaccatgccctcctggtttccaactaggaaattggcaagtggaggagcgcccagacatttacgcgacaaacataatgtaa

SEQ ID NO: 58432 - DNA, 1219 bp, Glycine max
  Peptide Sequence Number=SeqID_150117
atgaaagcaagatctatcactgaatatccggggaaatcggaacaggcaaaatctattatgctaatgattcagaataatctggattatgcggtagcacaacatccccatgagctgataacgtatggtggaaacggagctgtttttcaaaactgggcacagtatcttttaacgatgaagtatttgtctgaaatgaatgatgagcaaacccttgtcatgtattccggacatccgatgggattatttccttcgcacaaagatgcgccacgggttgtggtaacgaacggaatggttattccaaactattctaagcccgatgattgggagaagttcaatgcgttaggggtttcccaatatgggcaaatgactgcaggaagttatatgtacatcggtccgcagggaattgttcatggaacaaccataacagtactgaatgctttcagaaaaataaataaagaaacaaaaggtggcttatttgtaacttcaggattggggggaatgagcggagcacaaccaaaagctggaaatattgcgggatgtattaccgtgtgtgctgaagtaaatcctaaaattacaaagattcgtcatgatcagaaatgggtaaacgaaatccatgaaaatgtagatgagctggtagcaagagtgagaaaagcgcaggaaaataaagagactgtttctttggcttatctaggaaatgtagttgacgtttgggaaaagtttgatgaagaaggtcttaagattgatatcggttcggatcagacatcgctgcataatccatgggcgggaggatattatcctgtaggacaaagttttgaagaatcaaatacgatgatggcggaaaatcctgaattatttaaagaaaaagttcaggaaactttaaggagacatgcagctgtcattaataaacatacagaaaaaggaacttacttctttgattatggtaacgcctttttattagaagcttcaagagccggcgcagatgtaatggccgagaatccgacattaggaagggaattcaagtttccaagttatgttcaggatattatggggccgatgtgctttgattacggttttgggccattccgttgggtttgtacgagtggaaagccggaagatcttcaaaaaacagatgatatcgcctgcaggatattggaagaaattcagcaaaattctccggaggagatccaacagcagatgaaagataatatccaatggatcaaag

SEQ ID NO: 58433 - DNA, 492 bp, Glycine max
  Peptide Sequence Number=SeqID_150118
atgagtcttcattcttcatctagtgttaatggtgagggttctactcctaaggaccccttgtataagatattagatgatttgagatcccttaagttgtggaaagaaaaacaagagagaaaagaaaaaggtaaaaaaagagtggaagaaataagtcaagatgaaagagagaaaataagagaggaagaaagaagaaaaataatgaaagaaatgaaaagagaaaaacatgtctcctatagtagtcatgactcttgcaagagtttaagtgaagaacttagcggctattatagagggcgtcatagtcacatactaaacatcactcccaaagaagagaaaaggatagaaggcctcaagaggttgaacaactctttgcttgccatcatattagcgaagagagaaaagttccattggctacccttagctttcaagggtatgccctctattggtggacttcccttgttaaagaacgaaggattcatggggatcctccagtag

SEQ ID NO: 58434 - DNA, 249 bp, Glycine max
  Peptide Sequence Number=SeqID_150119
atgactaggggaaattcatctgacttacaaccctttgatcctgagatagataggaaatttcatagattagttaggcatcattttgtaccttttgagcatcctgagcattctgttattggtgagactcagcattttgtggttggtaattttgaacatcctgattttgagcattatagttttgaacattctgattttgagcattatgagaacatggcccaacctccacccagtgagaggactcttagctaa

SEQ ID NO: 58435 - DNA, 469 bp, Glycine max
  Peptide Sequence Number=SeqID_150120
atgaccgaaccacaaaagctggaagagactctagctcaatttatgcaagtgtcaatgtctaaccaaaagaccaccgagtctgcaattaagaatctagaagtccaggcgattcaagcggaggaaagtagagttgatcagaaggtggagggatttaaacaacagatggctgatgaaccggcgcaggtactggttgatgatttagttgaacttgaagaaattgttgaggaagcagaagaaaagaagaaagaggctactcctattgaatgcaaggaggtaccttatccgttggtaccctcccggaaagataaagagcgacatttagccaaatttcttgatatcttcaagaaactggaaattaccttgccttttagaaaagcacttcagcaaatgcccctctatgccaaatttttaaaggatatgttaaccaagaagaaccggtacattcatagtgacaaaattgttgtggaag

SEQ ID NO: 58436 - DNA, 828 bp, Glycine max
  Peptide Sequence Number=SeqID_150121
atgtccgcttcgaagccatcgctcgaggcagaacagtcaactggtttccacgatggaaagaaggatacgaggggttgcattaactacaatcccacacttgctataagacagttagggcaccccatgaggggagcactgacggatgaaagcctgtctcctttccttgtgagagattttggcgcgcaaaattttaaggttatacaaagagtccataaggcatgggaaagcccattaaggaaagataaagaacttaggggcattcgtaatggcatcattggtcgttatcatgaatggctgaaagtttgtacacgaggtttagattggctcgccaagttaaagattatcaatgaagagaacttcgaagctccggaagaggatgaagaagtccgagctctgaaaaccgaactaggaaaagcgagacttgccaaagaaaaattcaagttggtcgctacagacgtccggaaagagtgtgccgggttacgagaagaaaatgcagctaccgcaaaagcccttgaacaagaaaccaagagggctcgcaaggaagagcattggtgtgacaaattccgtggagcattgtggggcagcaacagtgagctcaagcttcgaagggaagagagagaccaatcacgagcacatagcatggttttaaaagaagagttagccgtttgctcaaggtccaaaagaaacttgtctcagcgtttatgcgagacaaagaccaacatgttagctatcatcaccaagtaccaagaagaactaagtctagccatggcccacgagcatagggtggcggacgagtatgcccaagtgtacgcggaaaaaggaggctag

SEQ ID NO: 58437 - DNA, 216 bp, Glycine max
  Peptide Sequence Number=SeqID_150122
atgagttctggatgtttgctagtagatcccaacggtcacaatcttgggaggattgatggggacccggtgttgagagaaacgaggatatgggctacgtgggagtacgtgagctcagatggaggtgggcaacaggggatggtgggtttatgcgcgcattgtggatgtggaaaacttgttgtgcaccatcgcccgactgccaccaagtaccacatgtga

SEQ ID NO: 58438 - DNA, 283 bp, Glycine max
  Peptide Sequence Number=SeqID_150123
atgttcctccagaaggtggttgcttctggaggaagcaacctagcttgcctaggcaagctgggtggcaagcatctccttccttttcctataaataggggaaggagggaagaacaaaaaggttcaaccctcctggtatctgagattcacttaaaattagtaagaaaaattgtttccgtgaagaaaatccatagccgaggcgcttccgtaacgtttctgtgggtgatttcgcgaagattttcaaccgttcttcgacgttcttcgttcgttcttcggtcttcaaccg

SEQ ID NO: 58439 - DNA, 531 bp, Glycine max
  Peptide Sequence Number=SeqID_150124
atgcgtgctagagctagagtaatgggtgaaatagaggaggtgcaagagcggataaaggccgacatggaggccatggaagagcaaatggccacaatgatggaggccatgatgagcatgaagaatataatggaggtcaatgcggttgcagttgccgttaccaacacccttgctgagggagacaaagagttgggaagtactggcggcccccattttgtgcaagttcagaacaagcatgccttcccactatatggcttgcctcccaactatacaccacccaatgttgcacacacttccgatgagaatatcaataactccactcacatactcattgagagccaacaacctcaatctgataatgcacatgtctctcaacccatgggggagacacatgaagtaccacaccacaatctagctgactttgaacctcacctcggatatgccactgaggggcaagcagttggtggtgtacccctgccagacactttggggggccctcaatttcgccaacaaccacaaccctcacattttgcg

SEQ ID NO: 58440 - DNA, 1623 bp, Glycine max
  Peptide Sequence Number=SeqID_150125
atggtgctgagctctgctttgttattcaaaggtggtgaaattgagcaaacagaaaatgtagatcagcataataggggagaagagcttggtaaacagagttcagacacatcggtgtttgtgaactcagagccattgcgtgaggaacaaattcagaatgctgtgaaatttctgtcgcacccgaaagttagaggttctcctgtcatccacagacgatcgtttctggagaagaagggccttacgaaggaggagattgatgaagcctttcggcgtgtgcctgattcacctccaagtgtgcagacagctggcataaatcaaggtgaactgtctaatgtcgaagttgcagattggtcttctgtgtttttcattttcacctttggactgagtttaaactgctattacattgactcatggctcactgtaatactcacagatggacaattgaagccatcatcaaacattcagcagcaaggccaaccacaggctttgcagctgactgtaccagcttctactggtgttactactacgcttggaaccttatctcgccgcagttttcactggtcacatgcccttattgcagttggattactggctgcttcaggtgctggtacagttatagtaattaagaattctattctccctcggttaaaatcctggatacgcaatgttgtcctagaagaggatcatgaccaatcaaagagaacaggctcaaaaccaacattggcagaagaagctgcacaggctgcaaaagcagctgcagttgcagctgctgatattgcaaaagcaagccaagaattactgagttcaaaaattgaagagaagagatattttgtagaagttgtgaaccttttggataagcaagtgcaggaaatgaagttgatgactaatgcaataggaagattggaagcttctggtggactctctgtctcaaagcaagaagaccgcttagtcactcaaacaggttcaaagacacagcaactgatcgtgaatgggaagtcagactatgagtcccgatcagtgagatcttcatcccctcctgtatctgttgaaccatctagtgctcctcatcctaaatcatatatggagataatggccatgatccaaagaggggagaagccttctaacattagggaaattgatgattcagcccccaacccttatcagcaaccatcaaatcctcgcttagcacctagagccaagccttgggaggttagtcaggtgcaaaacacctcaacccaagtccttccgtatcaagtaaatggcaagatccaagataatggtgacaacacagtaccctggtggcaaacaaagaacgtcagaatcaaagagatcgataatgaaattgagtataatggagcacctgctgcatccagtccgcagccagtccaacgagcgtgggttcctcctcagcctcctcctatagcaatgccagaggctgcagaagcgatcagacgcccaaagcaggtagtccaaaaggaagtgacactggatgatcagtcagcagctcattcttcagacctcactaatggatccaaatccgaagatgcaatagaaggcaacgttgtcaactcacttgtcagctctggtgagatccaaaaccatgaagttggttacgaagagaaatga

SEQ ID NO: 58441 - DNA, 309 bp, Glycine max
  Peptide Sequence Number=SeqID_150126
atgtcgaggggtagtggattgaaagaagtggttggttgggaagaacagtgtagtgaacatcaagaaattgggggcacaatggtctcgaagctgattaatatggaagaaagggataaggaagaggctcaaaggaatttgggtgctgatggtgcaaaagtcattatagtaaacgtctactcgttgtgtgctgtaggtgactttaacaacatcacaagaccatcagaaagagttggtatcagtcaaagacaacaagatgagaggattgtaaaggaattcaatgagtggattgcagaatggcttaataaatga

SEQ ID NO: 58442 - DNA, 1548 bp, Glycine max
  Peptide Sequence Number=SeqID_150127
atggctggttctcttcaaaaccaacgacaacaacttcttggaattatcgaagaagaagaacaagagaaattgcagaaacagaaagaagagactgaggggaacaacaacaataataacaataacaagagtgacatggctcctacggcagggaattcgatccacaggtcgggttcgaggccgcaacttgatgtgagcaaagctgagattcaagggaatgtggaggagaagtatcccaccattttgttgcctaatcaatctgatgatttgtctcatcttgctcttgacattggaggatctctgataaagttggtgtacttttcaagacatgaagatcaatcatgggatgataaaaggaagagaagcatgaaggagccattggggctttctaatggtaacaggagaagcttccctattcttggtggaaggcttcactttgtgaagtttgaaacgagaaagattaatgagtgcttggatttcattcattctaagcagcttcactgtggtgggttggagtcacattattctgatggtgtgactgatcagaatggcataattaaggctactggaggtggagcatataagtatgctgaccttttcaaagaaagacttggggttagtctggacaaagaagatgaaatggattgtcttgtggcaggagcaaatttcttgcttaaggttgatggggatggtaaatttgagagggttagtgggacaaatgttggtggtgggacttattggggcttgggaagactgttaacaaagtgcaagagttttgatgagttgcttgagctgagtcagaaaggagataatagaactatggacatgctagttggggacatttacgggggtttggactattctaagattggcctatcagcttccactattgcttcaagtttcggaaaaacgatatcagaaaaaaaggaacttgaagagtacagacctgaagacatatcactctctcttctacggatgatttcatacaatattggccaggtgaggggtcatgcctataccatggacactatttcttttgctgtacatttctggtctaatggggaagcacaagcaatgttcttgcgtcatgaaggatttctgggagctttaggtgcatttatgagttatgagaagcatggtttagatgacctcatggtgcatcagttggtggaaaggtttccaatgggtgctccatatacaggaggcaagattcatggccctccacttggagatttaaatgagaaggcaacatctctatgggtcttagcagtaattagtgttcactccattacatttacaccagactattatcagtctattcagtctgttattccgatttcgtggatggagaagtttttgcagaagggaactgagattactgcacctgtgccaatgactccacttgctggaactactgggcttgggggttttgaagttcctttgtcaaaaggaagtactctgcgatctgatgcaagtgctctaaatgttggtgttctccatctagtaccaacgttggaggtgtttccattactagcagacccaaaattgtaa

SEQ ID NO: 58443 - DNA, 606 bp, Glycine max
  Peptide Sequence Number=SeqID_150128
atggagtcattccatgaggtatgcaaccttttttatcccatcccttctttccttgtcaagttttctgttacaaatccactgatcaaagcgatgaagatcataagagaggctacgtcaggacatgatttggcctatattttggactcatcttgtgagtgggatgatagtgaaacatcttctaggagatctttggaagagtttcctaaatgctcatctcaaattgccacccttaagctgtcggggaagtataggaaaatggtatcgatgtaccttccatatatacctaacaaggaggatatcccaatcagctttgagtatcatgtcaatcttagtagaaaaggctatcgttcactgatatacagtggcgatcatggcctgaatgttcttttcttgggaactgaagcatggataagatctttaaactactccattgtggatgattggaggccatggcttacaaatggccaagttgcaggatacacaagcacttactccaatcgtatgacatttgcaactgtgaaggcaagtctctcatattctccttgctgcccttctgggtcacacatagattccacttataagagaatattcaagattggtaattag

SEQ ID NO: 58444 - DNA, 585 bp, Glycine max
  Peptide Sequence Number=SeqID_150129
atggccgacaataacacacgcaaagctgccactaaccgcctggaggaagtagtccttcatttcacccaaggccaaaccaccctcaccaccaaccaccaagatctctccgtcaaggttgacgcgatcctcaaatgtttatctgctatgactatccctagcctaacaccaacatgcacactcatgtcccctactttccctcatccacacatcacattagacgttccccgttttgacagtcacaacccattgggctggatttttaagatctctcaattcttcaactatcaaggaaccccaaatgaagaacggagctctattcaagctcgcacaatccagcctcgccccaaatctccacaaagaagttcaggttatacaccgcaggcagccaaccttgccaagttgcaggaggacaagctcctcgactatcatcgtagatttaaaggtcccactacccatttgacacccattgtcactcatcacttcaactctaaacaacaccacgctcctaactcaaaggtgcagttaaagtacctcacacccgaggaacttgcttcttgttgtgagaaagggctttgctaccattga

SEQ ID NO: 58445 - DNA, 711 bp, Glycine max
  Peptide Sequence Number=SeqID_150130
atgggtgttatcttggctattaagcacatgagaaacaagggttggacaagcctttggctcgagtgtgattctactttggtagtccaagctttttccaacgatctcgcgtgccttgcccttacccttagacgcccccccggtgccttgtcgttacctctcttgctctcatcgtccatttacctccgttgtggtcgttgtcgtggtgctttcatcgttgtcatgttcccatcaccattgtgcgactatcgacgtcctagggtgaactcctccaccactgtagaagcatcattagaagggtttgagggttataattatacaacaacacttggaaggaaaagggttgtgttattacacaatgaagcttcttctctcaactccaattcaccgaaaaaagactatcacattgcccttgttagggcctttagaagggtaaaggacagagagatggaattacaagcactaagagatgaaattcaagcatccatgaagctggttcaaccatgcactggtatttggagtgataaatgtacttcaaggttcaatagaagacgaccgttcattttgaaaggatctctcttacgaacaattaaagggacccgaacaaaggccgctcttgtatttattattggattctacatgctggaccttgccaacaacatagtgcaagggcctgctcgagcacttttggatcagcagttgggagcatcctag

SEQ ID NO: 58446 - DNA, 642 bp, Glycine max
  Peptide Sequence Number=SeqID_150131
atggcaaagacttcttccataaaagttatcaatttaatgagaaaggtgtggatcaatggtgtggtgttcaccatacgtgtcgtgaaggatacgttttcttcagctatgtatggtgagggtgtgggagggagaaaagtagcatcgaagtcttcatcggaagatgagattgttgaggatgtttgcttgatgggatgtggggaacttgtgttaggtcaaaacgtcactgggatatcgcttgagaggaggatattgcgggttgggaggaaaaaggtgtttgttaggcctttattaaatttggcccaagaaagcgtaggatgcactaaagaccagttgggagtggtgtttgaagatgcgagccctagtcaaatgacggggcaagtggataaggcctctatcttggggacaaatgtggctagtggattatctaaggaagatttggaagggaaggcaaagggttcagttgtaaaggttgaaagggatcacaaataccttactatgttgaaggtaactagagatcctatggttaacatggctgatagggtgttggggggttgtttatgggtcatagggttgagtgcgagaggggggtcgagatgtgttgggggcagcagtggaagccatagggatatcataagaaaagag

SEQ ID NO: 58447 - DNA, 966 bp, Glycine max
  Peptide Sequence Number=SeqID_150132
atggagggaacgggatttggtgcagcggcaccgacgccattggttaggttgtggagaactgcgtttttgacgctgagggatgaaaccctaacggtccctcctcgcaattccacggcacaattgctcgataatctcattttctcccactcagacgcgttgctctccgccgctgccgaacttccttctcacgaggttttgtcagacattttgtttatcatggaattggttgctgcgacttcttcagatgaagaagattttactcgtatctatgcacagacttcacgcctgacagtggcttttgagatgcttggtgaagcaatctcaagagctgggccatccttccctgtattcagaaaaacaatggatgtcttggcattaaaaacccctgttgtggaagatagtgtcatgtccaggttctatgaatcttttctgtgctgtctacatctgatcctcattgatcctaaatgttcagtttcagatcatgtgtcagtttttgttgctgttctgcgaatgttcttagtttacggcgtttctggtagaacatcaggtctgcttgttggtcatgaggagaaggagcctaatagtatgaatcccaaggcaaacagggaacaactgaacaaatcagatcgtggtacatatagacctccacacttgcgcaaaagggacagcttgaatgtgaaactcaatagagctaggcattcccaatacatgtcagatagtgagtcttctacggttaatgttacatcttcagattcagagtttagtgatggagatggatcagctaaggagagtggcagagtgcagaactctagggttagagtagcttccataacttgcatacagcctctttacaatttgccatatcgtgttttatggcgctgtttgccatttccaatatggtgcccgctattaatgttgcgtccatggcatgtgcagcagctatggtggaaattgcgggtttgttga

SEQ ID NO: 58448 - DNA, 141 bp, Glycine max
  Peptide Sequence Number=SeqID_150133
atggaggagaagggatttggggatgaagggggagaggcgaagagtaggggtgggaataggccaggtcaggaacgtaataggaaagttaatggaaaaggaaacgttaaccagaataggaaagccaataaaaataatgagtaa

SEQ ID NO: 58449 - DNA, 708 bp, Glycine max
  Peptide Sequence Number=SeqID_150134
atggcgtctcaagagaatgcgttgctttctgcttcttcgtttccgaattcaatttctcacaagcttgatgattcaatttttctgctctggcgacaacaagttgaaccagatgcaccgattcctatgaggtttgggaatgcattcacgattatttccacaagaaaaacaatagccacagcttgtcaacttcgcactcagcttcgtgctacgacacttgcaggcaaatcaatgcttgaatttctgtcgcaaattctagcaatttctgattctcttgtttctattggaagcccagttatgcttcaagcgcatattgattctattcttaaaggtctttccccggattatcatctgattgttgcaatcattgaaagcaaatttgaaccccagcctattgatcaagttgaggcgcttgatccaaaaagcttctacaattttcgaggcagttctagccgtggaggtagctatagtggcagttttaactgtagtggtgatggtggtgccagtggtcgtgccggtagtggcagtggccttggtcgtggtgccggtcacttcactaatttccaatttcaggatgagtgggagaaggcagtagcagagaaaccagaaggaacagatggagctgaaagggaattagaggaaggtatttgggaaagtgaaggtgtagaggctgaaacaggaggggataggtcaggattgagactgaaatag

SEQ ID NO: 58450 - DNA, 510 bp, Glycine max
  Peptide Sequence Number=SeqID_150135
atgccgaacttaaaaggaaggttacagaaacagcttaatgctctttttgttgtctctgaggatcagtcacaatactgtgagctcgaaacaactgctttagtgccagaagacgatacagttgcagaagacatctctcctgtaagcaactcgtattctcatttatcagggagtgatggaaaaccagcagtcctagtagcttccttcatttttccttcactctatttacgcaaagtgctttccatcatttttgaggactctttgttaactgttgcaaacaatagtgatactctacccccacaattgggacagagagtctcttctgttgctaccctggtgcttagtcttgtaattccaatggtgactatgggtttggtctggccatggactggccctgcagcctccgcaactctcgccccataccttgttggtatagttgtccaatttgcatttgagcagtacgctcgatatcgaaagtctccttcatggtctgccattccattaatctttcaa

SEQ ID NO: 58451 - DNA, 681 bp, Glycine max
  Peptide Sequence Number=SeqID_150136
atggaggaagaagttgatccatcgataaagagggagaagcacaaggaaaacgaagtgatgaatgtgggctgcgaagacaattttcttgataacccaattacagatttgatcaagaaggaagtcgaagcacattgttttcaagattcagatttccataaaaagattgttatggtgaaacaaaaatcattcatgaaggtggttggaacaacaacggtgctgaaatcttggaatgccaacttgttgggtgagcctttagcattaaattttgttgcatctatggctgacagcttagccatggagctaagacagaaggaatgtactgagccagtcatgctgattaaagttatatggagtccacccttgtccctcccacaccgaagccaccggatctcagtttgcatgcagggtcacttggatagtccacagtgcattgagaggttcagaaaatatgatcatgattatgctcatcgtttgctggcaaaatatttctctaacaaaaacttcaatggaggcaacatatttgatttggaaataacagtaaatgatgaaatcataaagtcaagcaggtcatatgcagatcctgtagtaggttttgaagaccaatccagcaatggatcaactccaccagcagattcccaagctaacatccccaatgggaaacatgcggtgaagaagaactga

SEQ ID NO: 58452 - DNA, 2346 bp, Glycine max
  Peptide Sequence Number=SeqID_150137
atggctccaagcataagcaaaactgtggaactaaattcatttggtcttgtcaacggtaatttgcctttgtccataaccctagaaggatcaaatttcctcgccaacggccacccttttctcacggaagttcccgaaaacataatagtcaccccttcacccatcgacgccaagagtagtaagaacaacgaggacgacgacgtcgtaggttgcttcgtgggcttccacgcggacgagcccagaagccgacacgtggcttccctggggaagctcagaggaataaaattcatgagcatattccggtttaaggtgtggtggaccactcactgggtcggtagcaacggacacgaactggagcacgagacacagatgatgcttctcgacaaaaacgaccagctcggacgcccctttgtgttgattctcccgatcctccaagcctcgttccgagcctccctgcaacccggtttggatgattacgtggacgtttgcatggagagcgggtcgacacgtgtctgtggctccagcttcgggagctgcttatacgtccacgttggccatgacccgtatcagttgcttagagaagcaactaaagtcgttaggatgcatttggggacgttcaagcttctcgaggagaaaaccgcgccagtgatcatagacaagtttggttggtgtacatgggacgcgttttacttgaaggtgcatccctcaggtgtgtgggaaggggtgaaagggttggtggagggagggtgccctccagggatggtcctaatcgacgacgggtggcaagccatttgtcacgacgaggaccccataacggaccaagagggtatgaagcgaacctccgcaggggagcaaatgccatgcaggttggtgaagttggaggaaaattacaagttcagacagtattgtagtggaaaggattctgagaagggtatgggtgcctttgttagggacttgaaggaacagtttaggagcgtggagcaggtgtatgtgtggcacgcgctttgtgggtattggggtggggtcagacccaaggttccgggcatgccccaggctaaggttgtcactccgaagctgtccaatggactaaaattgacaatgaaggatttagcggtggataagatcgtcagtaacggagttggactggtgccaccacacctggctcaccttttgtacgaggggctccactcccgtttggaatctgcgggtattgacggtgttaaggttgacgttatacacttgctcgagatgctatccgaggaatacggtggccgtgttgagctagccaaagcttattacaaagcgctcactgcttcggtgaagaagcatttcaaaggcaatggggtcattgcgagcatggagcattgtaatgacttctttctccttggtaccgaagccatagcccttgggcgcgtaggagatgatttttggtgcactgatccctctggagatccaaatggcacgtattggctccaagggtgtcacatggtgcactgtgcctacaacagcttgtggatggggaattttattcagccggattgggacatgttccagtccactcacccttgtgccgaattccatgcagcctctagggccatctctggtggaccagtttacgttagtgattgtgttggaaagcacaacttcaagttgctcaagagcctcgctttgcctgatgggacgattttgcgttgtcaacactatgcactccccacacgagactgtttgtttgaagaccccttgcatgatgggaagacaatgctcaaaatttggaatctcaacaaatatacaggtgttttgggtctatttaattgccaaggaggtgggtggtgtcccgtaactaggagaaacaagagtgcctctgaattttcacaaactgtgacatgcttagcgagtcctcaagacattgaatggagcaatgggaaaagcccaatatgcataaaagggatgaatgtgtttgctgtatatttgttcaaggaccacaaactaaagctcatgaaggcatcagagaaattggaagtttcacttgagccatttacttttgagctattgacagtgtctccagtgattgtgctgtcaaaaaagttaattcaatttgctccaattggattagtgaacatgcttaacactggtggtgccattcagtccatggagtttgacaaccacatagatgtggtcaaaattggggttaggggttgtggggagatgaaggtgtttgcatcagagaaaccagttagttgcaaactagatggggtagttgtaaaatttgattatgaggataaaatgctgagagtgcaagttccctggcctagtgcttcaaaattgtcaatggttgagtttttattttga

SEQ ID NO: 58453 - DNA, 648 bp, Glycine max
  Peptide Sequence Number=SeqID_150138
atggcatcatcaagctcctacaattctccatgtgctgcctgcaaattcttgaggaggaagtgccttccggggtgcatctttgcaccttacttcccaccagaggagcctcaaaaattcgcaaacgtgcacaagatcttcggtgctagcaacgtgacaaagcttctcaatgaactcctccctcaccagagagaagatgcagtgaactctcttgcctatgaagccgaggcacgtgttagagaccccgtttatggctgcgtaggtgccatctcattcctccagagacaagtccaaaggctccagaaggagcttgattccgccaatgctgatctcctacgctatgcctgcaatgacatgcctccaccctctctttctgtgccaccacaaatgccccaaaggtcttttattgcaaggtttggtaatgaatcagcaagtggaggagggttctataggccttctcctacaaccaccaccaccacttactctttcccttattctcttccttggactgattctgaggatatcaatgatagaggaggagaaggaggagcctcacttggactctggctaggtgtgactcaagtgcaactctctataggcatgtgcagtgagcatgcggagttgacattctctgtcattgtttatgattaa

SEQ ID NO: 58454 - DNA, 420 bp, Glycine max
  Peptide Sequence Number=SeqID_150139
atggaaaaaaaggtcgagaaatttggtagaccggctccagagatcgaaggcttagtggctgccacaggattaagtcctttaatcacatgttcgttggacactggtgatcggggacttatgtctactttcatggagaggtggcataagaaaatcagtagtttccatccgtcggtaggagaggtgactatcaccttggatgatgtggcgtcgttgttgcattttcccattacagacgcgttccatacttttgagcctcttcatgtggatgatgtcatcttgctcttagtcaaatttcttgaagtaagtgctgaaaaggtaagagctgagacagtacaatgtcatggtgcatatgttcgtacaattccatggggcatatgtttgactatcctggctacgcgacgtatatcggagcaaatgtga

SEQ ID NO: 58455 - DNA, 210 bp, Glycine max
  Peptide Sequence Number=SeqID_150140
atggtggacgtggatgtagttaaagaacaagttccacaaaatcttgaacctaccaagtgtgatggttgggattggtacgagtgggatcatttgtcacaccctctgtttgggcctcttgagaaaatggtcaaagggagctttcgatccatttccaatttgattctggatgcacgtaaatttgtaaaacgtctaattcagaagcaacattga

SEQ ID NO: 58456 - DNA, 222 bp, Glycine max
  Peptide Sequence Number=SeqID_150141
atgttgctaagtagcaatgtcatccatatctgtgtaagagtggtcatgttggtgcgcacgatccacactcgtctctttgcaacggcacgggtgaaatcttgccccggtatgcatagtagctgcgcgatagcctccctctctagttgtgctcgcacagatggtcgccctccaaaatcagggggcagcccaggaactgataaaaggaaactactggccccttaa

SEQ ID NO: 58457 - DNA, 547 bp, Glycine max
  Peptide Sequence Number=SeqID_150142
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatcccctccacgacaagagttgccaagggcaaaggccttggcaaatcaaggcgaatgggctttcttttattgacatcttggcgcttttgatctttggagttgccctctttccgaatatggaagggttagtggacctagcagcgattgacgctttcctcgcctttcatcatggcaaggaaagcccggttgtcgccattttggccatgtatgacacgttcgaccggggatgcccatctatccgctacaaggtcaccgctcgtgcgtcgaaaaaggaaaggcgaattgggaccaactcttggctagcatggaggggcgtct

SEQ ID NO: 58458 - DNA, 210 bp, Glycine max
  Peptide Sequence Number=SeqID_150143
atggaggagtttgatgcacaggtggcctggccagaagaccaaccttcttcctctggagggggtggggcctccacaacccaggtgcttgtgactgaggagccaccagcaccagaaccatcaccagcagtagcagaggaggagaacactccagctcagaccccacagccatctccaccatctgctcctgctctagaggagactcaggcatca

SEQ ID NO: 58459 - DNA, 234 bp, Glycine max
  Peptide Sequence Number=SeqID_150144
atgaaagataagagggatgaggaagaaaaattagaaaaacaaaagaaaaagaaggatagtaaggtcttgtcttcaaaggccagggggaaggaaaaagagggaaaggacttcctccaagaagattttggtaaaaatggggtccaagtggaccctgagaaaatgcaaggccatcaacaagaagtatggccaccccatcaaaagtgtgggagactattaggagtttgcatgggttag

SEQ ID NO: 58460 - DNA, 129 bp, Glycine max
  Peptide Sequence Number=SeqID_150145
atggaagaaagctctcccaactacccttttgctctaagacacacaccctcaaaaagtcctccagggactgaatggtccgttcagtttggccatcagtctgaggatggctctcccaaaaccttgaggtaa

SEQ ID NO: 58461 - DNA, 222 bp, Glycine max
  Peptide Sequence Number=SeqID_150146
atgcaaggttgcctaagctaccgaaagccaatgattatgaaatatgcatctttgtggagatggttatcttttaattcagatattgttggaactgattcactcttggttaatgataatctatatttacttgatattgtagcttcctatgttgaatactttaatgtagaattgcatggaactaagtgtagaattgataatacaaactcaggagcattaaggtaa

SEQ ID NO: 58462 - DNA, 456 bp, Glycine max
  Peptide Sequence Number=SeqID_150147
atgcagaatgctcaggtggtcagtataggtgaaatcaacaatctcagacaggattgttactgcttaactgttggaacagttgatgaaatcattattgaagctccatggagttatgacagttgtcctaactgtacaaccacatttgatccatcaaaaggatggagcataatggggacaaaggaaacttctttctctgggatgcaacatgaatcaagctgtttggctggggatgatattaaggtgtttccaacgtgtgttgacgaaattttgttcaaaacttgggttgtcagatttaagtttcattcacaattacgccaatcatctgtgttggatgtgagtgaagaactccatcatattcaatcattgatagccacccttgggttgaaggaacaatcaagtaagggaaaaggaatagctgttgagccagaaagttcaccaccaatttttgttcccatg

SEQ ID NO: 58463 - DNA, 312 bp, Glycine max
  Peptide Sequence Number=SeqID_150148
atgattgatcagtggaacaatcgccatgcttttagggtcgacgcttatccccgacaagaaggcctattgagctttaactcggactacatggtctggctgaagttgcggagacattacaatacatggtgtctcctcaagggaggaatacatggacagttgatgatctcgtgccttatgtggagaaaattacaattttatccgaagagcaagagagaatcactgagccagtgtcacatggtcctgcatcagagcgtcaatttctcgcacagcattatcacattcttcaatcaagtgttgaaactcagggcatag

SEQ ID NO: 58464 - DNA, 423 bp, Glycine max
  Peptide Sequence Number=SeqID_150149
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcaggagcggggacctctagagtcgaccgcagcatacgcaagcctctccccgcgcgttggccgattcattaatgcagctggcacgacaggtttcccgactggaaagcgggcagtgagcgcaacgcaattaatgtga

SEQ ID NO: 58465 - DNA, 597 bp, Glycine max
  Peptide Sequence Number=SeqID_150150
atggtggcgctggggggcggcagggtggtggaagcgggctatgccaacgaatgttccgccgatcagctggcggcggcaatcaccccacgcaccgcggcgatccttggcgcgaaggcgattgaagggcctaccagcgggctggtgatcggcaagacccgctacgtcgagtgggtgaagcgccagacggcgggcattggccgcgcgatgaaggtcggcaaagaggggatcctcggcctgacctgcgccatcgaacactacctgacggcgaccaaagagagcggtgcggaaatggtggcgaagatgacgccgtttatcgacgcactcaataccctgaacggcgtcacggcgcgcgtggtctgggacagcgcgggtcgcgatatcgcgcgcaccgagattaagttcgacgaagccattactggcatcggcaccggcgagctggtgaatgccctgaagcagggcgaatacgccatttacttccgtggctacaaggccaacgaagggatcatcgaagcggacgtgcgcagcgtgaatgctgaccagttgaacattgtgtaccgtcgcattagtgaagtgttaggacaggagaataaggcatga

SEQ ID NO: 58466 - DNA, 150 bp, Glycine max
  Peptide Sequence Number=SeqID_150151
atgtcattgtcacttgaggacaagttaattaggcaagctttgaaaagtgttgtttttcaccttctcgctaagccaacctgttggcttagcgagcgttcgctaagcgcacactcctgggctaagtgcaaagaagactctggaagaagatga

SEQ ID NO: 58467 - DNA, 210 bp, Glycine max
  Peptide Sequence Number=SeqID_150152
atgggcgaggaagagaaaaaactagaggaaaacaaagtggaggagaaaaaagcaaatgaagaagaaaagaaagaagaagagaaaaaactagaggaatcaaaagatgacaaagaatccaaggaggaatctgtgctgccagaaatcgtgctaggcacaacctttgcaatgcatggacactttaagcacaatttccggcatcttttaagttag

SEQ ID NO: 58468 - DNA, 149 bp, Glycine max
  Peptide Sequence Number=SeqID_150153
atgaacccgggtatagggccccttttttactcaaacccgtgggtgcttagtgaaaaaatgtccccagtggagtcgccaactgtcgcaacgtgcccttttgcgggtgagcgggggcgaggctcacgggtgcgctttccaaaggaggaaag

SEQ ID NO: 58469 - DNA, 95 bp, Glycine max
  Peptide Sequence Number=SeqID_150154
atgggagaaagaaaaaaagaagaagaagaagaagaagaaggaaagaaagctcctgatcaaggatcgaaagaaaaaacgaagaaatgtgcagaaag

SEQ ID NO: 58470 - DNA, 216 bp, Glycine max
  Peptide Sequence Number=SeqID_150155
atggcgaggattcctgacaagattaggtctaatgatggatcaaaagagacgcttaagcttgctgttagaatcaccgatctttggttcgttgggacttccaacaagtctgagcaagcagaaatggtttttgttgattctgagtttgcatatttcagggtgatcaaattcatgatatttgtaaatcggaccacctcaagtcttggaaagctgatttga

SEQ ID NO: 58471 - DNA, 162 bp, Glycine max
  Peptide Sequence Number=SeqID_150156
atggttaaagcacgtcaaaagggggggaaaagagggaggtggttgccgcccagctcacccaggcgagctgggttgcttccagcagaaggcaccgtcttctgttggaacaccctggaaggtccaagtgggtctggttgctatttgcacacccctgtttactaa

SEQ ID NO: 58472 - DNA, 186 bp, Glycine max
  Peptide Sequence Number=SeqID_150157
atggggatcaaaaggtcttttaaggttgtaatggggccaaggacaaggcttgtattgagcttcaaaacaaggaaagggaaacaaggctcaaaagggctatcaaaggaattaattcaaggaagcatcaacaagaatcaagccaaggctattgtgcaagcaatcaatggggcaaaacacaccaaatga

SEQ ID NO: 58473 - DNA, 300 bp, Glycine max
  Peptide Sequence Number=SeqID_150158
atgttttggggagaagcattttaccttaaaggaagagccagacgggttgtctctaatagcctcacttttgagtgcctgagcccggtcattaacctggcctacattaggaagaactgttggaaccccgaggatctaacagtctctatcaaaggggctaggagggcaagggcaaggccagttgagcttccttctacttttggagctcctattctagcatccacttcagcaaccccttctgtcccagttcagacaaattttcagcattttgaagctatgcttcagagcattcatcaaggatag

SEQ ID NO: 58474 - DNA, 246 bp, Glycine max
  Peptide Sequence Number=SeqID_150159
atggatcaagctggcgaggaaaggaagttgcaactgagtgagttagatgaaatccgcctagaccctgcgagaatgccaaagttttacagagaaaagaccaagaaattgagatcaaaagcgactccacaaacaagagcttcaaggtcaacggacatcgacttaagccattcctcacgaaccccttctttagtgaacgtagtggtggaagagacttccttactccaccctactcttcctccaccatga

SEQ ID NO: 58475 - DNA, 522 bp, Glycine max
  Peptide Sequence Number=SeqID_150160
atggggacaaatcaaaacggcaaaaggttttatcaagtcaaggttaaaagtctagatgtcaccagcctcaaggaattgggacgattgatgggacccctccaaaggcaagccttccacaaagtgtacgggaagatcctagatttggccgcagcggaggtatttacgaaagccgttgtatccctcacccaatactatgaccatccgttgaggtgtttcacgtttggggacttccaaatggtaccaactattgaggagtttgaagagatattaggatgccctctcggggggataaaaccgtatcttttctccggctttcttccttccttgagcaaggttgcggccgtgattggagattcagcaaaagagttggatcgcatgaagaaaattcggaacggcgtagtgggcctgcctcggaaatacttggaagacaaggcaagggatatggcgagccaagagaagtggggcccgtttgcggatgttttagctttgctgatttttggggttgtcctcttccgaacgtga

SEQ ID NO: 58476 - DNA, 690 bp, Glycine max
  Peptide Sequence Number=SeqID_150161
atggtacgcacgctgcaaagcagcgccgcccgccacggtgagctgctggatggtctgctgccgccgctcaaagcctttgaaacgctgctggccgttcagcaaccgcgtgaggagcaggttaacgggctgttcacggacaccattgacctgtttgccgacagcgcccaggagaataccgcgcagttccagacaaaagacaaagcgcgtcttgcgcaccgggtctggataaaccatctgcgtcagtggagccgcaatgaagccaccgccgcccgtctggggctggaacccgccgtgttgcagcaaatcgtggatgtgctggtggtcaccagctaccggctggatctgcctcagcagctacagcgtattgtcgaagcagataagagtagtgcggcgcaactgcatgccgtgatgggcaatttcattggctggctgggttatgaccagacgcccgtggcgacacgtccggccagccgcatccgcaagggtcaggctatcttcgtcacgccggtcgtcagcagcgccggtccccgcctgacgcgcctgggggaacagcctgtgcatgcggccactgcgtacgtttacgactggctggttgcgctctatagccgcgccatagagaacattgattaccagcacccgcatgatgttcagccgggggcgcgcaaggctctgcaggcgttattacgctga

SEQ ID NO: 58477 - DNA, 210 bp, Glycine max
  Peptide Sequence Number=SeqID_150162
atgacgaagaacgaacgacgaacgacgaatgacgaagaacggttgaaaatctttgagaaatcacccacgaaaacgaaaataagggaggagcttgccacccagctcgcccaggcgagccaggttgcttcctccagaagcaaccgccttctggaggaacatcttggaaggccaaagtgggcctggttgctatttgcaccccctttttactaa

SEQ ID NO: 58478 - DNA, 213 bp, Glycine max
  Peptide Sequence Number=SeqID_150163
atgggtgcgctttccaaaggaggaaagatgcgcggagttgccaccaacgtttatttgtgggaaacgtcggaaaaaccgaagggaaccggtcaaaaggaaaattctaagttcaggagttgtatttacgtcgacaaaagcggggcttttgctcctacgtaccctccatcgaaggggaaatcagacctacgtagttcttccttatgcgtgaatcaa

SEQ ID NO: 58479 - DNA, 423 bp, Glycine max
  Peptide Sequence Number=SeqID_150164
atgaggctactacttcaccttcctctagtgaaagtgaagaagcaaaaggggaagaatctagaggagtgtaaggatgtaagtgtctcctccaagaggttagctaagaagaaggaaagtcattttgaaataaacataaatattaaagaaacttcccctcttagacaacctccacattttcttctttgtaaaaagacacttgttagcattgccacacctcttaggcttgagtttatttctcaagtaaaggatttgttggatgagggtttggttcgcaacaacttaaatccttgtgctttgttggtgcccaaaatagtgatcaaggggttccccatgaaccctaagagaataaaggtcattcctgagtggctgatcgaggccgtacccgaatcaaataaacatgaaaatgcagtaactaggaagtga

SEQ ID NO: 58480 - DNA, 193 bp, Glycine max
  Peptide Sequence Number=SeqID_150165
gcttagaagtctagatttcctcgaagaagctacaaaaagaaggattgaggaagttttctccaccgaatccttgagcaacgatggctcgtggtcgccaccgatggtcgtgggtggtggagaaggagatgttagggtatgggtgccgtttggagaggaggagagggtgaaaatcgtgtttttcacactgaagaac

SEQ ID NO: 58481 - DNA, 430 bp, Glycine max
  Peptide Sequence Number=SeqID_150166
gaaagaaagcctcaagaggctaacattaacctcccatacttccatgggaaggacaatgtagaggataacttagattgggaaataagggtagagcaaaaacttaaaagaaagtctactttaaaatcttatggctctcactcttatccaaagaaagaccaaggtcaaggcattttaggggtgacaccttttaagcccaaagatgataaagggaagacaatagaaaagcaatcccttaaggctagtatgcaagagaagactagctctataaagtgctttaaatgtcttggaagaggacacattacttctcaatgccccaccaagaaaagcatgactatgaggggccaagaaatttatagtagccaagtccaagatgaggctactacttcaccatcctctagtgaaagtgaagaagcaaaagaggaagaatcta

SEQ ID NO: 58482 - DNA, 360 bp, Glycine max
  Peptide Sequence Number=SeqID_150167
atgacaccggtaaaccgaaaggcaggaacaggagagcgcacgagggagccgccagggggaaacgcctgggggaattccgccccgttcgtagagcctttccgctcgccgcagtcgaacgaccgagcggtagcgagctcaccttttttctcctgccacatgaagcactgtcgtgactggacaccctggcatcagttacccaacatagtaatcgccagtatgcagcacatccgccctttagcgccagctggcgtaatacgcaagaggcccgcaccgatcgcccttcgcgcaacagttgcgcagcgattcattgaatgcagcgaatggcagacagcgtccgactggaatagcggcgcagtgtaa

SEQ ID NO: 58483 - DNA, 63 bp, Glycine max
  Peptide Sequence Number=SeqID_150168
atggaagagaagcggaaggcaaaggagaagaggagaggggaggcaccatccactagggaataa

SEQ ID NO: 58484 - DNA, 1082 bp, Glycine max
  Peptide Sequence Number=SeqID_150169
gcgcggtcgaaggcgatgcgtcgccgttggatcagcatccagcggcggatgatgtggtagacgaccagcagcaggaaccagatcgccaccgaggtttccaggcgcgccagcagcgcctgcgcggtggtgagataaccgacgctcgacgccagcgccgccagcagcggcgccgacagcagcagcccccagaaggcgctgttgagcatgttgtcgccggagccgtttttatccagatacagcgggatgccggcgcgtttgaggctgtgggtgaccagcgccagcgccagacacagcagaatgaagcacagccgccccagcgtgttggcgaactcgcgctctttcaggctatcgaaggtgatcagcgccatgatcagcggcacgatcagccagatcgacatcttgtagtagcgcatggcgcgcgaaacctgcttcgccggccagcggaagtgcacgatgaacaacccctgcgggtgggcgaaggcggcgcagatcatgcagatccacaggatcggcagcgtggcggtcacccctttgccgatcgcttccgccaccgggtagttccaggcgctctgcaggccgtagccgagcgcggcccacagcaccggcagcggcatcgccaccagaatcgaccagaacacggtgcgcaccgtcaggaagaattcgtcctgcgtcaccttgccgacgcggctgctggcgcgctcgaggaaggcgtggtagtgcttgcgcgaactgatgctgaaaatcaccagcagcagggcgccgaagatcgggatcagcgtttcgcggctggtcaccatcatcatgaaggcgccgccgagctgcgacagcgtgtccagcgacagaacgcgcgtcagatcgtgcgccacgttgagcggataagagaagttgatcggattgacgtccggcacccagaacagatagcggtgggtggcgtcgcgaatttcgttcaacgcttcgatcaactgggtgttggccaccttcagcttggtcagctcgaggatttgggtgtcgcaaccggacaacaacgagttcagcagctcgcgctgggtgcgcagctgggcatcgacgatgcgctgctcctg

SEQ ID NO: 58485 - DNA, 405 bp, Glycine max
  Peptide Sequence Number=SeqID_150170
atggttaaggaagagcgtaagggaggtaagtgtctcctccaagagacacttgttatcattgccacacctcttgggcttgagtttattcctcaagtaaaggatttgttggatgagggtttggttcgcaagagcttaaatccttgtgcttttttggtgcccaaaataggtattattaggcaccaaatccctaaaataggtggtatgatgaatgttttgagtggtgcaaccctcttttgtaaaatcagtcgtgcacccaacatcttcatgatttgtgtacatagggactcattaggtagtgataaaggggttcccatgaatcctaagagaataaaggtcattcctgagtggcccactccaccaagtgttgagaaaaaagcccagagtttcaagaatctcgggatgtga

SEQ ID NO: 58486 - DNA, 209 bp, Glycine max
  Peptide Sequence Number=SeqID_150171
ggtaggttgcgacagctccaaactcgaaagtggaggacacatgaacgaaaacgcaattcatggagctccgaaaaaagggggagaatggaggattgccttgagggcaatcatgaaacacagctccaaactcgaaagtggaggaaacatgaacgaaaacgcaattcatggagctcctgaaaaaagggggagaatggaagattgccttgagg

SEQ ID NO: 58487 - DNA, 319 bp, Glycine max
  Peptide Sequence Number=SeqID_150172
atggatgaagatgagtggatgtatgaaataatgtctgaacgagcagatatggattatgaaaatgcagaatcatgtggtgcgaatgaaccacatgttgattgttcggatgcattcaagacttctcagtgccgagaggatgttttgcagtgggctcgatctgtggcttttgaaaacggatttgtggcagtgattttaagatcagacacaaacacaggtagtagaggaaggagtacgtttgtgtcaattggctgtgaaaggagtggcgagtataagtgtaggaaaaaagaatttatcagaagagacactgggactaggaaat

SEQ ID NO: 58488 - DNA, 789 bp, Glycine max
  Peptide Sequence Number=SeqID_150173
atgaggtcctgggtgaggggtcagtggatcgcgtttgatgcagatgctatcggccagctcctgggatatccgttggtgctggaagagggccaggagtgcgagtatggccagaggaggaaccggtctgatgggttcgatgaggaggccatcgcccagttgctatgtataccggggcaggattttgcctggactgctgcaaggaggcgagtgcgaattatgcgcaccaacatgaccaccctgactcagatatggatgactttgctgctcagcaacatcctgcccaccgaccataattccgacctccccttgccgaagtgtcagctggtgtacgccatcctggcgcggatgagcatccatatggctcagttaatcgctgatgccatctatatttttgcaggtatggcgcctaccagacaccctttggatccagataagtccaacagggccctgggatttcccgcgctgatcacaggactctgccagtcgttcggagtccccgtggcacctaccaaggtgattcggccgcccatcacccgggcttttattgagaagtactgcacccagagacaggctcagggggatgctccacaggccgcgggcgcgtcaccaccacctcatcaggctggcccggctgggtcatttgacatggagcagtatttacggcatttgggtcgccagcaggcggccaaccaccgagcacatgtacagacccatgattgtctgtaccagatgagcctcagcatgcaaggccagggcttcgcttctttttcatgccctactccagactag

SEQ ID NO: 58489 - DNA, 117 bp, Glycine max
  Peptide Sequence Number=SeqID_150174
atgggtgtcaagttcctcgaagcggtcaagcgaaggttgcatgccatcaaacaatggtcctcggacgaaattaggataatgaatcatggttatggcataggagaattgctcatataa

SEQ ID NO: 58490 - DNA, 270 bp, Glycine max
  Peptide Sequence Number=SeqID_150175
atgggggtgcaaatagcaatcaggcccacttgggccttcagattcttcctccagaaggcggttgcttctggaggaagccaccttgctctcctgggcgagctggggggcaagcttctcgcccatttttctataaataggggagaagtgaagaagaaaaatgttcagcccttctggcgcttccgtaacgttcccatgggtgatttcgcgaagattttcaaccgttctttgacggtcttcattcgttcttcgtcgttcttcggtcttcaaccg

SEQ ID NO: 58491 - DNA, 252 bp, Glycine max
  Peptide Sequence Number=SeqID_150176
atgaatattgaggaatccattcatgttacttttgatgaatctaatgctatcttgtcaagaaagaatatgctagatgatattgcagaatctttagaacaaattcacattcatggacaaaattctaaaggaaaagggaaaggaagcaatgaagatcctccagaagaagccaaattaaataatgaacttccaatagaatggaaagcctcaaaagatcatcctctcgacagcattattggtgatatctcaaaaggg

SEQ ID NO: 58492 - DNA, 297 bp, Glycine max
  Peptide Sequence Number=SeqID_150177
atgcctgatatgaatgcattttacggacacgagagcccgggaaattatctcttcttacttgtgcatttgggggtgcagtgccccatgtgtacaattaagaagatttgggagccaatccagtccttgtgttcggactctcagccacttatgatagccgccgatgatcccattactgcttcccctaagctctctgtcctttcttcacgccgcatcccatgccttgcgaactccttggagtaccctcgcgttgtggtcgctgaaacctcgtgcgatgaaaggcgtgatgctttcgtctga

SEQ ID NO: 58493 - DNA, 480 bp, Glycine max
  Peptide Sequence Number=SeqID_150178
atggtcatagaccagtcccttttctttgaactcactcaattatccagtgatggtgtaccatttgaggatacacttgatgatgagtggaagtttgatttttctgtttttgatgcccgtcggatggtttgtaccaaccaagcggatatgaccggaaggcttcttgccggatcattggcattcgaatgccacatcatgcacaacttgattgtgcgtatcctacttcctagatcatccaaccttgcacaggtttctgaggaagatttgataattatgtgggttttcttaaccggtcatcaaatcgactgggcccatcttggacaacccttcccttgtgttcaggaatcctttacaacaagagaccctcggtctcttaatcccttttcagaagtaagaagaagagaagaagaaatctctcttgaaagagatagattgtacaatgaagatcaatcacaattccttattgagtatgcaagtgtttga

SEQ ID NO: 58494 - DNA, 839 bp, Glycine max
  Peptide Sequence Number=SeqID_150179
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagccttcatgcatatgaagagaatcactattggagccaccaatgactatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58495 - DNA, 786 bp, Glycine max
  Peptide Sequence Number=SeqID_150180
atggaaaaacggctttgccgcggccctctcacttccctgttaagtatcttcctggcatcttccaggaaatctccgccccgttccgcccaatacgcaaaccgcctctccccgcgcgttggccgattcattaatgcagctggcacgacaggtttcccgactggaaagcgggcagtgagcgcaacgcaattaatggaacaaaagctggtaccgggccccccctcgaggtcgacggtatcgataagcttgatcgcgatcggcgtgccggaggtgcagctcaatctctacggcgagtacgacctgccgccgtggctggtgcccggcatgagcctgaccggccgggtgatctacacctcggcgcagtactacgatctggccaacagccagaagatcccggactgggcgacgctcgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58496 - DNA, 195 bp, Glycine max
  Peptide Sequence Number=SeqID_150181
atgaagcttgcttctacagataaccgttgtttttggaatctgctactcaagtgcttgaaacagccagcatggaagatgaccagcactagaagatcacccttgaggattattcaagcagctcagtaccgcaattctttactagcattgcacgtcctgaagtgcaagctcacaacatcaactacccacattctttaa

SEQ ID NO: 58497 - DNA, 873 bp, Glycine max
  Peptide Sequence Number=SeqID_150182
atggaggccccgatgcgcccgtacacccttgctgcactgctgagcaccctgccgtgcgcggcccatgcgctggacctgccgccggtgcagtacccgacgctgccggcacaggctgccactgccgccggcttcgtgcccaacggctggacgcttgaatccagcatcgaaggcgatctcgaccaggatggccgcgctgatctggtcctggtactgcgccagcaggacccgcgcaacgtcatcgaacacgacggcttcggcccgtccccgcatgacagcaacccgcgcattctcgccgtggcgtggtcacggccaaccggctatgtgctggcggtgcaggaccatcagctgattccgcgcccggagaacccggtgatgagcgatccgcttgaagaagggggtgtcagcatccagcgtggcacgttgaaggtcgcgctgttttcattcgccagcgccggaagctggtcgatgggtaccaccgccttcactttccgctggcaggacggcgcgttcgcgctgatcggctacgaccaggattcggtgatgcgcaattccggaaagaccgaatcgctgagcgtgaacttctccacgcgcaaggtaaggcgcgtcgaaggcagcatcgacaacgacaaggacagcgtgcgctggcagccactgcgcggcacccgtcgctggacgctgcagacggtcggcgatggctgggcattcgatcccaggccggcaccgatgagccacggtcagatcgcgggcagcggcggttgcgccggcccggccaccaagcaccgtacgcagagcaaccacgggctcgatatcagcgttgccacgcgccagcgcgcggcacctgcagatggtggcgtccatcggaccagctcatag

SEQ ID NO: 58498 - DNA, 525 bp, Glycine max
  Peptide Sequence Number=SeqID_150183
atggaaaacgccagcaacgcggcttttacggttcctggccttttgctggccttttgctcacatgtctttcctgcgttatcccctgattctgtggataaccgtattaccgcctttgactggcacgacaggtttcccgactggaaagcgggcagtgagcgcaacgcaattaatgaaacagctatgaccatgattacgaattcgagctcggtacccgattgtccaatctttaagaaaagaatggagaagtttgaaaacaagaacattggagaaaagaaggcaaagaaggcctacatcatatgggatgataacgacttagaatcgtctgatgattctgaaaaaaaagtgattaatctatgtctaatgggcaaaaactatgaaagtgatgaagagagattggatataaaccagaaaaacaacaaaagttttataaaaatttctttcttccacacaaaaatattgcaaagaactgatccgaagatttgggatggaaagtgcaaagcacatggctacacctattggtactga

SEQ ID NO: 58499 - DNA, 207 bp, Glycine max
  Peptide Sequence Number=SeqID_150184
atggggatcaaatcacctgcagttgatcttctttgcatacaagaggaacagagcaacaattatccagttcaaaagaacaatgaatttacagtaacaaaggtatacacaaaagaatcaatgaatcaaacagaaaatgataaaaagcaatgccgtaaaactgaactaaactcctctaatgaattaagttccccgacaacggcgccataa

SEQ ID NO: 58500 - DNA, 228 bp, Glycine max
  Peptide Sequence Number=SeqID_150185
atggaggccatgaaagagcaaatggccacaatgatggaggccataatgagcatgaagaagataatggaagccaatgcagttacagttgtcgctaccagcactattggcaaagatttgggaagtacaggcggccccccttatgtgcaaattcaaaacaagcatgacttcccaccatatggcattcctccacaactatacgccacccaatgtggtgtacactcccaatga

SEQ ID NO: 58501 - DNA, 456 bp, Glycine max
  Peptide Sequence Number=SeqID_150186
atggaggaacttggtagctcaagtctgataccatctattgtttgcaggaatcgcacccacaaagacacccagtggactcggagaagtccaacaggaccctggggtttccagctctggttacgggcctctgtaatcttacagggtgcccgttccccccggcaaggtcacgtcatcatagggatcgcgcctgcaagacacccagtggacccgaagaagtccaacagggtcttggagttgtcaagctctaattatgggtctttggcatcaggcccccctactaatcgagctttcatcaagaagtactacgtctccaggcaggcgcagggcgaaacaccacatcagcctggggatggccggcagcgggcaacagacgcaccgccatcacctctagagttcaccttctgctcatccacaaaaaggtttgagtattgcctacaccacatggccgaccaatag

SEQ ID NO: 58502 - DNA, 269 bp, Glycine max
  Peptide Sequence Number=SeqID_150187
ggtgcggataccgtaaggtatctccgctcaggggccgtccagcctcagggtcagtagacaaagaaggggcggccgacaaaagcgaagctcttgctcctacgtatcctccaatgaggaactcagacctacgtgcggataaccgtaaggtgtctccgcgggctaccagctcttgggtcatggcgacaaaaggtggtgtggtcgacaaaagcgaggctcttgctcctacgtatcctccaatgaggaactcagacctacgtagttctggataa

SEQ ID NO: 58503 - DNA, 935 bp, Glycine max
  Peptide Sequence Number=SeqID_150188
gactacatgtcctcgccttcagaggactacacatcctcaccttcagagggccatacgtcctcgccatcagaggactacacgtccccaccttcagagggctacatgtcttcgccttcagaggactacatgtcctcaccttcagaggactacacttcctcgccttcaaagggtcatgtaccttcgcctttgtaggtctacacgcccttacctttagaggactacatatcctcgccatcagaggactacacgtccccaccttcagatggctacacgccttcgccttcagaggactacatgtcccccttttcaaagggctacacgccctcgcccttagggggcgacatgccctcacctttagaggactacacgtcctcgccatcataggactacactccctcgccttcaaaaggcgacacgtcctgaacttcagagggctgcacgccctcgcctttagagggctacacgtcctcactttcaagacggaggctatcacgcagctactatgcataccggggcaagatttcacccgtgccgctacaaagagacaagtgtggatcatgcgcaccaacatgaccactcttacacaaatatggatgatgttgctacttagcaaacattccgtccagcgaccgcaataccgatctccccctgcggaagtatcagttggtctgtgccgtttcgacatagggatcgtgcccacaaggcacccagtggactcggaggagcctaacgggaccctggggtttccagctctggttatgggcctcgatcagtcctaccggatgcccgtcccccagcgaggtcatgccattgacatagggatcgtgcccgcaagacacccagtggactcagagaagtccaacagggtcctggggtttccagctctgattacgagcctctatcagtttaacagagtgcctgtcatccccaacaag

SEQ ID NO: 58504 - DNA, 902 bp, Glycine max
  Peptide Sequence Number=SeqID_150189
atggggacaaatcaaaacggcaaaaggttttatcaagtcaaggttaaaagtctagatgtcactagcctcaaggaattgggacgattgatgggacctctccaaagacaagccttccgcaaagtctacgggaagattctagatttgaccgcagcgaaggtatttacggaagctgtcgtatccctcgcccaatactatgaccagccgttgaggtgtttcacgtttggggacttccaaatggtaccgactattgaagagtttgaggaaatattaggatgccctcttggggggagaaaaccgtatcttttctccggctttcttccttccttgagcaagattgcagttgtggttggagattcagcaaaagagttggatcgcatgaagcaaactcggaacggcgtagtgggcctgcctcagaaatacttggaaggtaaggcaagggatatggcaagccaagagaagtggggcccatttgcggatatattagctttgttgatttttggagttgtcctctttctgaatgtggacggtttggtggacttagccgccattgatgccttcctcgcgtatcaccacagcaaggagagtccagtggtggctatcttggcagatttgtttaatacctttgaccggagttgtgagaaaaacagtgcccggattgtctgttgtttacctgctctctgtgtgtggttggtttcacacctattccaacaagacacaagacacccgtgtccgcttcaaagctatcgctcatgcgccgaaaaaggaagagtcgattgggaccaacatttggctgggatagggggcagcgcgatcaattggtttcctcgctggaaggaaggcaaggaaggagttattttctcgtgtggggactaccctaatgttccattgatagggactagggg

SEQ ID NO: 58505 - DNA, 210 bp, Glycine max
  Peptide Sequence Number=SeqID_150190
agaccagagcttgaagcaggagccggtttgaaagcttgtgatgagtttgtgagtgattgtgagatcctagaggtgacggagacatcctcaccacttatgcatgctttgttagggtcattcaacagtggaaactggtctgactctaaagtccttgatagtacagggctaagttgtcgtactatcatgaggaatcggggtgcgatagcttag

SEQ ID NO: 58506 - DNA, 372 bp, Glycine max
  Peptide Sequence Number=SeqID_150191
atgactgttgcagacagtattaagacaactctccctaaattaagacatttccaaaaggattgcctaaagtgtaagtcttggttcgaaaagaatggtgagcttaatactcatagattccttacaatccaaaccatatgcccaaatgagaagttcattttcatagggaatgaagtgaaagctccagtggaaatagttgaaacttattgtttaaaacgcaacactggacatcgtttagatttactggaaactccttatggaaaacaagcaaaacatacaaagaaagaagctacaagaagcactcagcttctagaaattgtgcatactgatatttgtgaaccttttgatgttagttctttgggaaaggaaagataa

SEQ ID NO: 58507 - DNA, 219 bp, Glycine max
  Peptide Sequence Number=SeqID_150192
atggaaaaatccgacaagatgaatttccaagggaagaaagaaaagaaaggatacatcacttgggaagataatacaacaaacaaaggctatatttctccccaagaaaaagtgattctcaagtgtcgcaacctacccttcggcgggagggcgacgcgtgactcgcgggatgcgtgttccacgaaaggaatacgcgcggagtcgccaccaacgtttatttga

SEQ ID NO: 58508 - DNA, 851 bp, Glycine max
  Peptide Sequence Number=SeqID_150193
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggtcagccgccagtcgtagatggtctgcacggagacaccgaggtagtccgcgagctcctcgaccccgatcaagggctccagccccggcttcgtcgtactcatgccgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58509 - DNA, 495 bp, Glycine max
  Peptide Sequence Number=SeqID_150194
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgctttttgccgttacgcaccaccccgtcagtagctgaacaggagggacagctgatagaaacagaagccactggagcacctcaaaaacaccatcatacactaaatcagtaa

SEQ ID NO: 58510 - DNA, 171 bp, Glycine max
  Peptide Sequence Number=SeqID_150195
atggaggttgatgaaccttggctggggttatggctaccattgaattatcaagtgggttttgtggttgatttagggatggcctttgtggataactgggtggtggataaggagaaggtttgttattggctgagtaatgacattgttgggtcggtgggaaacttggctgtatag

SEQ ID NO: 58511 - DNA, 447 bp, Glycine max
  Peptide Sequence Number=SeqID_150196
atgactaggggcaatccaggtgatttacaaccctttgatcctgaaatagatagaacctttcatagattagttaggcatagtgtgcatcctggtcattctgtgcattttgagcatcctgatcattttgagcattctgttgctggtgattctgaatattctgattttgagcatttggctattaattttcatattgagaacatgtctcaatctccacctcgtgagaggactcttagggagatggcttcacctgatttcacttatgaaagcttgtgcattcaatatcctgatgagggtgttccatatgttctcaagattggactaatacatttgttgcacaagtttcatggtcttgtaggtgaagatcctcataagcatcttaaggagttccatattggttgttccaccatgaagtcccctgatgtccaagaagatcatatctttctacag

SEQ ID NO: 58512 - DNA, 297 bp, Glycine max
  Peptide Sequence Number=SeqID_150197
atgaccggccctctcgatgagtcgatctcttgctttctcataaaggtggacccttgggtactagtacttatcacctttagaggactgtatgtcctcgccaccagaggactgcacatcctcgcctgtagagggttgcacgccctctcctttagagggctgcgcggatcgcgcccacaagatgcccagtgggcccgaagaagtccaacagggccctggggtttccagctctggttacgggcctctgtcagtcctatagggtgcccgttcccccagcaaggtcatgccatcgtgacatag

SEQ ID NO: 58513 - DNA, 417 bp, Glycine max
  Peptide Sequence Number=SeqID_150198
atgtcctgcccagtgatcataactccgaccttcctctgccaaagtgtcagctggtatgccacctaccaggccgcagacacaccgccaccacctcatcaggctgatccagctgggtcatttggcacgaagcggtatttacagcacttggttcgccagcaggcggccaaccacagggggcaggtgcagatacatgagtgtctctaccaactcagcctcagtcagcagagccaaggtttcactccttttgcgtgccctacaccagatcagtttagggctgaggtcgcatggctcggagattggcctgaggcccaggtaggggaggcgcctgcagaggctcccggcgatgcagaggaggcccgcatggatgaggagatgacagatttactcgatttcttgggagggagtggagccacatga

SEQ ID NO: 58514 - DNA, 353 bp, Glycine max
  Peptide Sequence Number=SeqID_150199
atggtgagacccatgaatcctggaagtatcagcccattcattcccttgctccagcacacatggactccttgccatcctggaggctggaagtccaagctcatggtgccagcaaatgtaggtccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 58515 - DNA, 291 bp, Glycine max
  Peptide Sequence Number=SeqID_150200
atgtcggatacaatgtccaggacatcctgctcgaaaatactggaattgctaaaagcattgaagctgcaggatccacgatgtcggatacaatgtccaggacatcctgcccgagaatactggagttgttgtacaatgcaagataaaagtcaaattttcaggaagaatgatagatctcatccagcacaagaagttgcagcccagaaacgcacaatgctatataaacgtgaaggctgcacgagttctgtaccaagtccgggattgaagagttattttgtgagttttgggacttga

SEQ ID NO: 58516 - DNA, 225 bp, Glycine max
  Peptide Sequence Number=SeqID_150201
atgctggtgcgcatgatccgcacccgcctccctgcagcggtctgggcgaaatcctgccccggtgtgcataacaactgggcaatggcctcctcgtcgaacccattggccctgttcctcctctggctgaactcgcactacttgccttcctccaacactagcggactgagcgaaaaggctcaggttatcaaaaactgcacatggtttaaagcacaaagtgaggactga

SEQ ID NO: 58517 - DNA, 207 bp, Glycine max
  Peptide Sequence Number=SeqID_150202
gcgaatcaagtgggtgggaatgatccgagccccctatgtcaatttcagtaagtctcttggtcaaaagccggtacctaattcccctgctggtgggccgatcctcgcgaaggaatccgcagctattgaatcagctgttagaaagggacgaagtggcttagttgaacatagtgggacggaaggttcagaggcttcccgtccccggatggt

SEQ ID NO: 58518 - DNA, 816 bp, Glycine max
  Peptide Sequence Number=SeqID_150203
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattcaagttgtaggatcatttgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 58519 - DNA, 507 bp, Glycine max
  Peptide Sequence Number=SeqID_150204
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatctgctgcactgctgcaccctgccctcctgcctcctgcctgcgcgcctactacctagctgtcagccttaggaactcgccagtcaaactggcagttccctatgcatggccatatcgctgttgcaaggagcgattccttcagaatgaccaaactatcaagcttatcgataccgtcgacctcgagggggggcccggtaccagcttttgttccctttag

SEQ ID NO: 58520 - DNA, 444 bp, Glycine max
  Peptide Sequence Number=SeqID_150205
atgacccaagagctggtaacccgcggagacaccttacagttatccgcacctcgtcattcagtgaccccaagtgtgattgatgagcaaaggccagtgtggtctgagttcctcattggaggatacgtaggagcaagagcctcgcttttgtcgaccacaccaccttttgttgccatgacccaagagctggtaacccgcggagacaccttacagttatctgcaccctttcgttatccagaggcggcgggcccgatgacacgcagagacaaaatttggtcattctgcacccttgtgtcatccagaggcggcgggcccgatgacacgcggagataccttatggttatccgcacccttgtgtcatccagaggcggcgggcccgatgacacgcagagacaaaatttggtcattctgcacccttgtgtcatccagaggcgacgggcccgatga

SEQ ID NO: 58521 - DNA, 168 bp, Glycine max
  Peptide Sequence Number=SeqID_150206
atgaggtgtaataattggacccaaccttggtccatgggcttagaaatcttccttgaggttcatgagaacccttgggtcttcttcagcagctctagccctatcttcttggagcctcttgctcatggctctagtgactggtcccttcctagtaaggattgcatcaattag

SEQ ID NO: 58522 - DNA, 231 bp, Glycine max
  Peptide Sequence Number=SeqID_150207
atggagaattgcactagcaatcactacgcatggctccaaattgaaggtgggggacaccagttgagaatggagaattgcactaagcaatcactatgcatagctcccaaactcgaaggtggaggacacataaagaaaaagcaattcttggggctccgaaaaaggttgagaatggagaattgcactaagcaatcactaagcatagctccaaaatcgaaggtggaggacacatga

SEQ ID NO: 58523 - DNA, 708 bp, Glycine max
  Peptide Sequence Number=SeqID_150208
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtcatgttatttaggaacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58524 - DNA, 144 bp, Glycine max
  Peptide Sequence Number=SeqID_150209
atgcacggagtcgccaccaacgtttatttgaggaaaacgtcggaaaaatcggaaaggtgtggtctacaaactttaagtgtgaaaggttcgggagttgtatttacgcacggggaaggctttcaaaagtccacgcttaaccaataa

SEQ ID NO: 58525 - DNA, 222 bp, Glycine max
  Peptide Sequence Number=SeqID_150210
atgcatgatgtcggtaaggaaatgttcgatcggcgtcatgcggtgatgcttcttttttacacctcgaacggtcatctttcctggccgatgtcgactgtgatgagaatcatgaaactggccaaatacaggctaaaggcccaagtggagaaggacgaaggcccaagtggagaaggacaaagcccccaagtggagaaggatgaaggctcaagtggagaaggatga

SEQ ID NO: 58526 - DNA, 290 bp, Glycine max
  Peptide Sequence Number=SeqID_150211
cacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggagggacagctgatagaaacagaagccactggagcacctcaaaaacaccatcatacactaaatcagtaa

SEQ ID NO: 58527 - DNA, 211 bp, Glycine max
  Peptide Sequence Number=SeqID_150212
cttgggaggattgatggggacccggtgttgagagaaacgaggatatgggctacgtgggagtacgtgagctcagttggaggtgggcaacaggggatggagaccttggggacgtcaggtggggtgctattgcccaaaaccaagcttgaccaatcccgacccaacccgggcatagtcggcttgaaacgaggtcaggaagccatgagggcttctg

SEQ ID NO: 58528 - DNA, 291 bp, Glycine max
  Peptide Sequence Number=SeqID_150213
atgaaaacaaacccgctcgccaatcatggagggggagcagttaatgccgtcaagtcgggtaggccgcgcaggtctaagcctttaaaggatgtgatgacccccaggaggtttatctacgaggccctacaaaaggggggcgcaattccccatggtgggcatgaagaggattctggtttgttgcatcctggcgagctacataacatggaagcatgtttagcagtagaggaccttttgcaacagatgatagatcaaggccgactggaagtcggcgataagggaagggaagagtag

SEQ ID NO: 58529 - DNA, 282 bp, Glycine max
  Peptide Sequence Number=SeqID_150214
atgtggaaggagttcaactttgtccctcacttccatatgaagcccactaaggaacctgataccaagatagaagataaaatagtggttgtcatcatcaaaaagggggagaatgtaaatcatgcaagctttgatgatgtcgagaagaaatcacatgtttgtcatcatcaaaaagggggagaatgtgaatccttgattcaagatttcttcaagatcaagccttgcctcaaaatgaaaggtttcaagtcatccaaggcacatgtaatcgattaccaatacatgtaa

SEQ ID NO: 58530 - DNA, 285 bp, Glycine max
  Peptide Sequence Number=SeqID_150215
atggtggaaccatcgaagaagcgcaagggttctttgagtagaagccaacggcactccgaggttcaggatactccatttcctcctcctcattattgtcatcagaagaacaacgtacatggtgcactggatgatgattggaagtttgatttttctgtgcatgatgcccgccagttggtttgcaccaaccaagcggatatgaccggaaggttgctttccgtttcattggctcttaaaagccgcatcctccattatctaattgtctgtatcttactccccaaatcttga

SEQ ID NO: 58531 - DNA, 212 bp, Glycine max
  Peptide Sequence Number=SeqID_150216
attcccttgtcacgctgtcgcaacatgcccttcgcgggcgagcgagggcgaggctcacgggtgcgctttccaaaggaggaaagatgcgcggagtcgccaccaacgaaggtattagcacctctcacgtcgacaaaagcggagctcttgctcctacgtaccctccatcaaagaggaaatcagacctacgtagttcttccttatgcgtgaatcaa

SEQ ID NO: 58532 - DNA, 632 bp, Glycine max
  Peptide Sequence Number=SeqID_150217
atgggaacaaatcaaactggcaaaaagttttatcaagtcaaggtcaagagcctaggaatcaccagcattaaggagttggggcggttgatgggacctctccaaatgcaagccttccgcaaggcgtacggaaagattttagatttgaccatagcagagatatccacagaagttgttgtatcacttacccaatactatgaccagcctttaagatgcttcacgtttagagacttccaattagtactgactgttgaagaatttgaggagattctaggatgtcctcttgggggaagaaaaccgtatcttttcttcgggtttcttccctccttgagcaagactgtagttgtggtcagggattcgacaagagagttggatcgtgtaaagcaaactcaaaacggcgtagtgggcctaccacgaaagtacttagaatgcaaggcaagggatatggcgaatcaagaggagtgggtcccgtttatggacgtattagcattgctaatctttggggttgtcctctttccaaacatggatggtttggtggacctagctgcaattgatgctttccttgcatatcaccatagcaaagagagcccggtagtggctatcttggcggacttatttgacgcatttgaccgaag

SEQ ID NO: 58533 - DNA, 640 bp, Glycine max
  Peptide Sequence Number=SeqID_150218
atgccctcttttaaaaaatggttctatcatgtcaaagtcaagagcctagaactagccagcttgcaaaagctagggcagcgcatggaccaagttcaacatcaagatttccgcaaagcatatgggaaaatctgggatttggccatgatagaagtatctattgaagccatcacatcccccgctcagtactacgcccaatcactcagatgcttcacatttggggactttcagttggcaccaacaatagaaaagtttgaagggatcttgggatgccaactgggaggaaggaagtcgtatttgttttccggattctacccctatatggcaagagtagcaaaagtggtcaagatctcggcacaagagttaaaccgactaaagcaaaatagaaatggagtggtagggataacaaggcagcgcttggaggagaaggcaaaagctttggcagatcaaggagaatggacttcattcattgatgttttagcactattggtgtttgggatcgcccactttccaaatgtagaagggctagtggatctagcagcgatcgacgcttttcttgcttatcaccatagcaaggaaagcccggttgttgctattttcgccaatgcctatgacacattcgactggagatgcgagaagagaa

SEQ ID NO: 58534 - DNA, 333 bp, Glycine max
  Peptide Sequence Number=SeqID_150219
atgttggaagagaagtttgttactattattgatgctagtagcaatgaagagaaagttcattataaaacttgggcaagatctgatagactcagcctaatgttgatgagaatgactgttgcagacaatattaagacaactctctctaaaatcgaaagtgctaaaaggtttataggattagtgggagagtattctcaaacagctgataagtctgttgttgggacattaatgagtacattgaccaccatgaaatttgatggttcacatactatgtatgaacatgtcattgagatgacaaacattacatatgttagttcaggaagaaacgaggcttaa

SEQ ID NO: 58535 - DNA, 210 bp, Glycine max
  Peptide Sequence Number=SeqID_150220
atgtctcggaacttcacgtattgtgcaacaaagggtgccaagtacctcaaagcggtcaaccaaagagtggagaactgggttcttagatatatttatggcgcttgtgttgtcacattttatggggatattgatgtgatcctgactaggagcggatcgcttgatacaggctacagagatttggatgatgccacttccagtgaaggaagataa

SEQ ID NO: 58536 - DNA, 282 bp, Glycine max
  Peptide Sequence Number=SeqID_150221
gatagcaaaggatcattaaattgtaaacatcatgagccacatgatgagggaagcagtatcaaatcaatgctttacaagcttttggtcaatctgaggagtggtgtcttcatgctgcaaattgatgcatctgcagtatatgggtggaaaaagggtgggagtggaactttaaatggagaagacacttgtttgacagagagcttgagatggcaaattgtttccgtaatgatgttgctggcagctgtattcagattcacaaaaaagatgagtggatctggaaaatag

SEQ ID NO: 58537 - DNA, 402 bp, Glycine max
  Peptide Sequence Number=SeqID_150222
atgggtgatcaagaggagacacaggaacagatgaaagccgacatgtcggctctgaaagaacagatggcttccatgatggaggccatgttaggaatgaggcagctcatggagaaaaacgtggccaccgctgccgctgtcagttcggctgccgaagcagacccaactctcttggcaaccgcgcgccatcctccctcaaacatactcggatggggaaggaacacgctggggcacgacggcaaccctcatctgggatacaaccgagcggcttacccttatggattgccgcccaactactcaccacccgtcctgcaagacgatgcgggccatattgcttctcccgtccttgagagagagccaagttccccaagttccaactccaaacacaactcgcccggccggtaa

SEQ ID NO: 58538 - DNA, 795 bp, Glycine max
  Peptide Sequence Number=SeqID_150223
gagcaagagcctcgcttttgtcgaccacaccgccttttgtggccatgactcaagagctggtagcccgcggagacaccttacggttatccgcacccctttgctatttagacacagttgttgtccgatggcacgcagagaccaagtttggtcatcctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggctcgcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggcccgatgacaagcagagaccaaagaccaagtttggtcattctgcacccttgtatcatccagaggcggcgggcccgatgatacgcggaaatacccaagtggggctgacacagtcttctgcaccttttgttcctccgggaacaacaaagtcatttacatgcggaaatttcatggtcgcccgcgactctcgtcaaccgagaggagcgaaattagtgtcatacactgattttcggggacctttgcttgatgacatgcgaccattctttggtcctt

SEQ ID NO: 58539 - DNA, 277 bp, Glycine max
  Peptide Sequence Number=SeqID_150224
gaccatggctactccacctgcctcgcctcctcctcctcctcctcctacagacacatcaacgtctccatctaccttgaagcggacatgcaaggagaaacggctacgatcgttggccactagaccacctggggcagagagactagtggtcaacgtcgatcctgctaccggcaaggttgacggtccccacaagaagaaattaagaacatatttgaggatttttgctcgtgataagatcgacgtgacatacgagacctggaaggaagtccctgctacttag

SEQ ID NO: 58540 - DNA, 172 bp, Glycine max
  Peptide Sequence Number=SeqID_150225
atgtacccggtatcttgagaaaaccgactacataaatctgaaacatggtagaagaaacaatgtacacctagagcatcgtcttcctagcgagtttcagacaccagaatatggtatttggaaagacccaaaagaaggaaaaagttcaagagcttgcatagggagaaaaggttga

SEQ ID NO: 58541 - DNA, 297 bp, Glycine max
  Peptide Sequence Number=SeqID_150226
atggcttacgaacggggcggagatttcctggaagatgccaggaagatacttaacagggaagtgagagggccgcggcaaagccgtttttccataggctccgcccccctgacaagcatcacgaaatctgacgctcaaatcagtgttggcgaaacccgacaggactataaagataccaggcgtttccccctggcggctccctcgtgcgctctcctgttcctgccattcggtttaccggtgtcactccgctgttatggccgcgtttgtctcattctacgcctgacactcagttccgggtag

SEQ ID NO: 58542 - DNA, 639 bp, Glycine max
  Peptide Sequence Number=SeqID_150227
atgatgataacaaaagatgatgacaaaggtgatgacaaaaagctcaaagatcaatcaaagatcaactcaagtgaatcaagtgaatcaagaacaattcaagagttcaagataagaatcaagaagaattcaagactcaagataagaatcaagaagaattcaagactcaagaagaaaatctcaagaatcaagatcaagattcaagactcaagattatgcatgcgatatctaacaaggtgtgcccctttgccttatcctcatcttattacccttttccttcaacacttaaacatccctcttgattctgaaccctatgttccaatcaagagatcattccttataggcgcttcagtcatagcatcctttggttatattaaggagcatgatggctcttgggtaaagaagggtgctagaaatgttggtgaagaagaacatgagggagaagattcatctattctttcgaagattttggaaaggtttgatggtcttcaaacctttgttggtgagaggtttgatactttggaattgcaagtggatatgcacttcaatgaaatggagtcaagaatgacaaaggttgaagaagatgtatcttacatccggtcaagctgcgatcttccaccaccgtcgccaccatcatcttag

SEQ ID NO: 58543 - DNA, 318 bp, Glycine max
  Peptide Sequence Number=SeqID_150228
atgtctccgacaaaaccacctcaaaagccagatccggaggttgatgatccgctttatctgatgacattgaccatcccagagcttttcttgaggccttaccagaggtctgggcaattgcagtttgagactgaaagttacataaagagttggatgcagagttcaaaacgcgatgtctaccttggagcctacttgaatggtgctttaaaagttattgatgatgctccacggcctaaatcaaaggctcctactaggtggattgtcgttaagtgtaatagacaaaaaggaagtactgagtgcggctattatgtcatgcactga

SEQ ID NO: 58544 - DNA, 213 bp, Glycine max
  Peptide Sequence Number=SeqID_150229
atggctctttgttcactttgtgagaaagaagtctacccaaacctgaaatttcgaggtcccacacgtagagatgcgcttcacgactccgaaaatgccttcctttcgcgatttggagcagaaatgatgaccaaaggttggagctttgttggagcttcaatggaggatgagaggggagaagaaagctacgtgagagagagggagagagcttcttaa

SEQ ID NO: 58545 - DNA, 755 bp, Glycine max
  Peptide Sequence Number=SeqID_150230
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagtacaatcagagtgtgccacctgggtgattgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58546 - DNA, 396 bp, Glycine max
  Peptide Sequence Number=SeqID_150231
atggagaacaatgatggtttgtggtggctaatggtggctgtgggtgatggagaaactacacgaaagcaaaggctgaaatgcttaaataagagatgctctcaagaacggaagcttctagcacactccagacatcttctcaaagatcataacggtccgatcatggaaaagtgtcttgtgaagttgaaaaccaaatttcgagaagatccaacagttaacgaaggctgggcagcgtttttaccgaggcaacttcatgtagctttctctagaagcatcattaagaggcttttagaaccctccagatatcttctcaaagatcccaacggtcggatcatggacaagtgtcttgtaaagttgcagaccaaatttcgagaagatccaacggttaatgaaggctag

SEQ ID NO: 58547 - DNA, 272 bp, Glycine max
  Peptide Sequence Number=SeqID_150232
atggccataatgtcatgcttcgcatggggacattctaatgttcgggccactctggaagtttcgaaccaacaaggcttcgaatcatcgcttcaagttcctcgtggcgatagctgcattgatttcaaaccaaataggtcgaagatcggcttcctaatacgtcacgaggagtgtggtgaggaagagcgagatgggaaaccatggtacttcgacatcaaacagtatgtcgagaacaaagaatatccaccagggatttccgacaatgacaaaagaac

SEQ ID NO: 58548 - DNA, 261 bp, Glycine max
  misc_feature (238)..(238): n is a, c, g, or t
  Peptide Sequence Number=SeqID_150233
atgggtgaagtagaggaggtacaagagaaggtgaaggccgacatggaggccatgaaagggcaaatggccatgatgatggagaccatgatgatcatgaagaagataatggaagccagtgcagttgcagttgccgctaccagcactgttgctaaggtgaatctgatgccccaatctggcctcaaccaaatgaatcatccaacctcaactatggtaggcaaagacttgggaagtatgggcnggccccatgatgtgcaaatttaa

SEQ ID NO: 58549 - DNA, 507 bp, Glycine max
  Peptide Sequence Number=SeqID_150234
atgaagcacttcactgacaccctcatcagtgccaacataaaatgcagccccacctggccaatcagggacctcttttcccatggccacagccataggtatggaattcatacatatggaagtgagggaacagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58550 - DNA, 144 bp, Glycine max
  Peptide Sequence Number=SeqID_150235
atgggcttagcgggaaaggatgtgctaagcaccaacatcatttgttttaaagtctttggaagtgcgcttagtgcagcgctaagtgctgctgctgcgctaagccccaaatgcttactggaagttacaacttcaagttgggcttag

SEQ ID NO: 58551 - DNA, 510 bp, Glycine max
  Peptide Sequence Number=SeqID_150236
atgaccatgattacgccaagctcgaaattaaccctcactaaagggaacaaaagctggtaccgggccccccctcgaggtcgacgactaacccttgtggtgttactgctggtgaaatcatatgcaacagtggaggtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58552 - DNA, 788 bp, Glycine max
  Peptide Sequence Number=SeqID_150237
atgagagggctgcacgccctcacctttagaggactgcacgtcctcaccatcaaaagtctgcatgccctattcttcagaggattacacgtcctcgccatcagagggttgcacgccctcaccattagaggactacacgtcctcgccatcagagggctgcacgtcctcgcctgtagaggactacacgtccttgccatcagagggctacacgccatcaccttcagaggactacacgtccacgccatcagaggcctgcacgccttcgccttaagaggactacacgtcctcgccagcagaaggctgcacgccttcacctttagaggattgcacgtccttaccatcagagggcaccacgccctcagctacagaggactacacgtcctcgccatcggagggctgcaaacactaaccttcagaggactacacgtcctcgtcagtagacggctgcacaccctcatcattagaggactacacgtcctcgccatcagagggctgcacaccctcgcctttagaggacttcacgtcctcgccctcaccttcaaaggacaacacgtcctcaccatcagagggctgcacgccctcagcttcagaggactacacgtcctcgatatcggagggctgcaagacctcacatttagaggactacacgtcctcgccatcagagggctgcacaccctcccctttagaggacttcacgtcctcgccatcagagggctgcactccctcgccttagaggacttcaagtcctcgccatcagagggctgcacgccctcaccttcaaaggacaacac

SEQ ID NO: 58553 - DNA, 324 bp, Glycine max
  Peptide Sequence Number=SeqID_150238
atgccaatcaccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggtcacgtcatcatagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatag

SEQ ID NO: 58554 - DNA, 459 bp, Glycine max
  Peptide Sequence Number=SeqID_150239
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacgccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 58555 - DNA, 662 bp, Glycine max
  Peptide Sequence Number=SeqID_150240
atgaatttattgcctagcgctgttcatgtgtcctccaccttcgagtctggagccctgcgaattgattgcctagcgctgttcgccaattctcctttctccacttttattcagagtcccatgaattcattgcctagcgttgttcaagtgtcctccaccttcgagtctggagccccgcgaattgattgcctagcgctgttcgccaattctcctttctccacttttattcagagtcccatgaattcattgcatagtgctgttcatgtgtcctccaccttcgagtctggagccccgcgaattgactgcctagcgctgttcgccaattctccattctccactttttttcggagccccatgaattcattgcctagcgctgttcatgtgtcctccaccttcgagtctggggccccgcgaattgattgcctagcgctgttcgccaattctccattctccacgtttattcggagccccatgaattcattgccaagcgctgttcatgcatcctccaccaacgagtctggaggatcgcgaattgattacctagcgctgttcgccagttctccgttctccacttttattctgagccccatgaatttattgcatagcgctattcatgtgtcctccaccatcgagtctggagccctgcgaattgattgcctagcgct

SEQ ID NO: 58556 - DNA, 385 bp, Glycine max
  Peptide Sequence Number=SeqID_150241
gggaacattgatgttaacaggatatccagcattcagaagaaattaaatgaggtggaggacttagcttctaatcgtattttgactgatcaagagctcaaaatcagaaactcccttcagcaggagttatggaatgtatcaaatgcagtggaatcccttttgagacaaaaatctaggatatcttggctgaagaagggggactgcaattctgggtatttccacagaattataaattttaggagagctttcaatgctattccaggtgacaaatgccctgggccagatggccttaacttcaactttatcaaaaaattttgggatatcatgagaccagagtttagaaggtttgtagatgagttctatgcccatggcagctttcctagaggaa

SEQ ID NO: 58557 - DNA, 279 bp, Glycine max
  Peptide Sequence Number=SeqID_150242
atggcttacgaacggggcggagatttcctggaagatgccaggaagatacttaacaaggaagtgagagggccgcggcaaagccgtttttccatatgctccgcccccctgacaagcatcacgaaatctgacgctcaatcagtggtggcgaaacccgacaggactattaggataccaggcgtttccccctggcggctccctcgtgcgctctcctgttcctgcctttcggtttaccggtgtcattccgctgttatggccgcgtttgtctcattccacgcctga

SEQ ID NO: 58558 - DNA, 222 bp, Glycine max
  Peptide Sequence Number=SeqID_150243
atgcgaagtgatattccatcacaggtgatccagtggattctgtttctatcagctgtccctcctgttcagatactgacggggtggtgggtaacggcaaaagcaccgccggacatcagcgctggcaagagtagcggtcacgatgcgcgtaaccaccacacccgccgcgtttatcccctccaatccccattttctgaagagttcaggggcggtctcatccaatga

SEQ ID NO: 58559 - DNA, 216 bp, Glycine max
  Peptide Sequence Number=SeqID_150244
atgaagtcaggtgacatgcggggtaacattatggttacccgcacctttcgtcaaccaggggaaaacgagcccgttgatgcgcgaagactaacatcgtcttctgcaccttttgtcgtcctgacccgtgaagtcaggtcacatgcagggttacctcttggttatactgcacctttcgtcaaccaaaggcaactgagcccgttgacgcgcggagactaa

SEQ ID NO: 58560 - DNA, 306 bp, Glycine max
  Peptide Sequence Number=SeqID_150245
atggcgccttctcctgatgcacctcctcagatcagcttgaccaatggaatctccttccctcttaggaccgactcctttaagaatttggaaaggaccgataaagcgaggtgtgagttttcgggatttcaatgctcgaccaaccccagtccacagagtgactctcaagaatacaggatcactaacctcgaattccaagtctttcctcctcttatcctgataacctttctgcctactctaagcagtcctcatcctttcttggatcaactttaccttctcggtggtttgttgtaccacttcagatcctaa

SEQ ID NO: 58561 - DNA, 204 bp, Glycine max
  Peptide Sequence Number=SeqID_150246
atggaagagcttgcaaatccaggatttttattcaaatctaggatttttcaccacaattcaataaatatgattccaccaatattgatgcaatcctatcccgcaagggcattgggtagaagactccaagtagattgggctagagattcaagggaaggccgtagggttctcatgagccttagggtagattttgagcccatgggctaa

SEQ ID NO: 58562 - DNA, 501 bp, Glycine max
  Peptide Sequence Number=SeqID_150247
atgagcaaagaaccgttggaccatgtcgatcacattctggcgcaatggcgcagggagcgacccgatctcgatgtcggtcccatggggctgctcgggcgcctgaaccgtctcgccacccatctcggccgggaggtggaggcggtgctgctgaaacacgggctttcctcttccgctttcgatgtgctggcgacgttgcggcgctccggctcaccctacaggctctcccccggcgatcttttggacatgaccatggagagttccggcaccgtgaccaaccggatcgaccagctcgagaaagccgggttggtggagcgtatccataacccgaacgaccggcgcagcgtcctgatatcgttgacggaacgaggatttgccattgtcgaggaagcggcaggcgctcatttcgaaaaccagcaccgcctggtcgccgttctcagcgaagaagagcgtgcgacgctgaaccggctgctgaaacggtttttgcgggatttcgaagaatag

SEQ ID NO: 58563 - DNA, 306 bp, Glycine max
  Peptide Sequence Number=SeqID_150248
atgatattgcatgagtttagaaggcctaactctctaaaaataatccccagtggagtcgccaactgtcacaacctatccttcggcgggagggcgacgcgagactcacgggtgcgtcttccaagaaaggaaaatgcgcggagtcgccaccaacacttattcgagcaaaacattgtaaaaaccggaaaggtgtggtctacgaactttaagtgtgaaaggttcgggagttgtatttacgcacggggaagggtgttttcccttgctcctacatattccttcaattgtgataaggaaatcagacctacgtag

SEQ ID NO: 58564 - DNA, 243 bp, Glycine max
  Peptide Sequence Number=SeqID_150249
atgctaacatcttcgggaagggtgcagatgaccacattggtctctgtgtgtcaattaggcttggggtccccgaatgacggggtacggataactggaaggtgtctccacatgctaccagactcttgggtcatgatagcgaaagatggggcggtcgacaaaagcgaggcttttgctcctacgtatcctcaatttgtgatgaggaactcagacctacgcagttctttctttgtgagactaaaatag

SEQ ID NO: 58565 - DNA, 138 bp, Glycine max
  Peptide Sequence Number=SeqID_150250
atgccttatgcatccggtaccgaatcaagtgagcctagtccatctgacgaccgaggagtgaaaatgatgatggtcgcctgttggtcggccatgtgtcgtaggcaacgctccagcctttttgtggatgagttgaggtga

SEQ ID NO: 58566 - DNA, 643 bp, Glycine max
  Peptide Sequence Number=SeqID_150251
ccttcagagggttacacgccctcgccatcagaggactgcatgtcttcaccttcgagggctacacgccctcaccttgagaggactacacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgtcttgagaggactacacgtcctcgccttgagaggactacatgtcctcaccatcagagggctgcatgccctcacctccagaggactacacgtcctcgccttgagagggctacctcgccctcgccttgggactacacgtcctcgtcctttgagaggactacacgtcctcaccttgagaggactacacgccctcgccatgagaggactgcatgtcctcaccttcagagggttacacgccctcgccatcagaggactgcatgtcctcaccttcgtagggctacatgccctcacctttagaggactacacgtcctcgccaacagagtgttgcacgcccttcaccttgagaggactacacgttctcgccaacgtagggctacacgctcctcaccttttataggactacac

SEQ ID NO: 58567 - DNA, 183 bp, Glycine max
  Peptide Sequence Number=SeqID_150252
atgggggttccctttgccgacggccccttccttcgggcgttaaatatacccccccacaaaaaaaattctgttttctttccaggttttagcattcgttattcgctctcccttgaggagattctgttgtcctcttcttcgggggaaaggatgaggattttcttcatggaccaaggttcaaagtag

SEQ ID NO: 58568 - DNA, 254 bp, Glycine max
  Peptide Sequence Number=SeqID_150253
atggtgaaagttggaacctcttacgtgccgatcaacgtctcattttcgccaaaagttggcccagggcttcccgggggaggccggacacttattgatttgttagtgaggggcgctccgctttcgccattcggaaactgcggccaactgcttaatgaacggcaaccggggatcgaggcggcctcttgcgtattacgccctggcgcaaaggggatgtgctgcatacggcgattactatgttgggtaactgagccagg

SEQ ID NO: 58569 - DNA, 413 bp, Glycine max
  Peptide Sequence Number=SeqID_150254
atgggacctctccaaaggcaagccttccgcaaagtgtacggaaatatcctagatttgaccgcagcggaggtatttacggaagctgttgtatccctcgcccaatactatgaccagccgttgaggtgcttcacgtttggggatttccaaatggtaccaactgttgaagagtttgaggaaatattaggatgccctcttgggggaagaaagccgtatcttttcttcgggtttcttccttccttgggtaagattgtagctgtggtcggagattcgtcaaaagagttggaccgcataaagcaaactcgaaacgtcgtagtgggcctgccgcggaaatacttggaaggcaaggcaagggatatggcaagccaagagaagtggggcccgtttacggatatactagctctattgatctttgg

SEQ ID NO: 58570 - DNA, 399 bp, Glycine max
  Peptide Sequence Number=SeqID_150255
atggagtgcctagagggagtttgggagaccctcgaaggcaatgcgaggtgccgattccgggacacgattcgattcacggctacttcattggtacatccagaggaaccagcacgcacgcttcagcgcactatggagtggatattacctacacctactccatatcgactagtggagctagtccaagtgatagaggtgacgtcatctgaagaagaccttgaggaggacccagaggagctacctcctgagcctgctgtggatgctcttgactttccagagggtgatgaggacccactccctgatgtggattctccagaggacgtcatgtcagcatctgaggcagactctatggaggagagcggccctggagggatagcgactagtggagactcttcatcatag

SEQ ID NO: 58571 - DNA, 466 bp, Glycine max
  Peptide Sequence Number=SeqID_150256
gcttttcgtcttacagatagcaaaaaagaatgtgtatacggataaccactcgggtatttccgcccgtcagcgtgactcaaaagtcagtatgacagatcctacagcaaaaaagaatgtttatacggataacctctcgggtatttccgcccgtcagcgtgactcaaaatgtgagtatgacagaacttgcttttcgtcttacagacagcaaaaaagaatgtttatacggataaccactcgggtatttcctcccgtcagcgtgactcaaaatgtcagtatgacagatcttgtgagcgcggaagatgacggcgcattagacgacgttagtctctgcgtgctatcagaacttgtgagcgcggaagatgacatagcaaaaaagaatgtttatacggataaccactcgggtatttccgcccgtcagcgtgactcaaaagtcagtatgacagatcctgtgagcgcggaagatgac

SEQ ID NO: 58572 - DNA, 414 bp, Glycine max
  Peptide Sequence Number=SeqID_150257
atgcagcatctgatgaagcttctcgaacgtgatcaatacattcattggcatagattgaaggatgaagttgtggtgcgtgatctgttttggtgtcacccagatgcagtaaagttatgcaatgcatgtcatctggtgttttttatagacagtacctacaaaacaaacaggtttcatatcgataagaatgtgaaggcgaagtgcaaatctttaatcggggaaaaaaatgcgtgggactatgtaatggataactggggtactttggttgattgtccgtccgaatacgagttccatgagtcatatcagaagtttcaagttgcttgttcgccttggccgatgttcgttgactatgttaacgacacatggattatcccccacaaggaaaaatttattacagcatggacgaataagggttga

SEQ ID NO: 58573 - DNA, 165 bp, Glycine max
  Peptide Sequence Number=SeqID_150258
atggcgtgcagccctctaaagtttaggacgtgttgccctttaaaggcgagggcgtgcagccctctgaaggtgaggacgtgcagccctctgaaggtgaggatgtccagtcctctgaaggcgagggcatgcagtcctctgaaggcaaggacgtgtagtcctctgaat

SEQ ID NO: 58574 - DNA, 150 bp, Glycine max
  Peptide Sequence Number=SeqID_150259
atgaaagagaagaagaagaaagaagagaaaaatgaggccgaggcgctaccaaattgcgaccgtaatcgacttctacatcattcttcgttcgtcgtccgacttaaagaactacgtaggtctgaattcctcatcgcacctgaggatacgtag

SEQ ID NO: 58575 - DNA, 473 bp, Glycine max
  Peptide Sequence Number=SeqID_150260
tcaatggcgagaccaagaaacattctgctaactctgaaggaggcaatgccaatagttgttcgaccatcaaacaaatatacaatgcaagaagtgcataccattcttccatacgaggaagtgatactgaaatgcaacatctaatgaagcttcttgaatgggatcagtatattcattggcacagattaatagatgaagacgtggtttgtgatatcttttggtgtcaccctgatgcagtgaaggtgacaccaactgggatgacattctctgttggttttgcatatctgaagggtgaacgtcttaataatgtggtttgggctttagaacggtttcgaggtgcatttttaagacgtgatgtcctccctagagttattgtgattgacagagacctagcattgatgaatgcagtgaaaatttatgtcatggatgcctggggaactttggttgattgtccttcagagcagcagtttgaaatg

SEQ ID NO: 58576 - DNA, 999 bp, Glycine max
  Peptide Sequence Number=SeqID_150261
cgtgcccctgttgagctaagccgtagtgttatatttttgaggatggcatccaggaaaaggaaaagcaccacttccaggcctcaagctcagtatgatactaagagattccaatccttggaaacctggaaccgatacacagataacattctggaccggaggatccttctggaaaggaatgttaagatttatcataccaaatttgacgagtttaaggcagagctggaaaggtgtaacttacacaaacgtctcgccaatctccaagatggaagcatagatgtagctgtggtgaaggagttttatgctaatttatacagcccgaaagaccagagccccaagcaagtgaggggtgagacactgcctacctattccagacttacaaggatgaggattgatcctcaagagtttgctgcctgtctctgcatccctgttaacttcagagaggctagggaggtaagggctcgaccagcagatattccttcttcttccacaccaccagctccttccacttctgccactcctacaccatctcctcccatttctgccacccttgcaccagctgtggtagctcctccagggtccattctgtccgtagagcagttcattgagaaggatgcgtcttctgaggctatcatccctggagcttttaatttttcgagtgcaggagtagagatgagacctgatgaggttgttcctcctgagccaattatgccagctatacatgagactgttgaagcaggtgagtcacagttgaggcaggaggctgctactcctgagaggacatcacagaccccaaaaggtccactctcaccagggatggacctatcttttgctcagcaagtagcagatgctcctacacctatcatcgagatgctagaagaccctaccactccagtcctgagactatcatccactcctccagctaccccagttttacatctgacaaatgaagaggatatgcaggacacacagggcacacaggaccagtcacaggaattctaa

SEQ ID NO: 58577 - DNA, 228 bp, Glycine max
  Peptide Sequence Number=SeqID_150262
atgaaaacgtttcagtttgctcatggaaaacggtgtaacaagggtgaacactatcccatatcaccagctccccgtctttcattgccatacgaaattccggatgagcattcatcaggcgggcaagaatctgatcggtctggttataggtacatggagcaactgacagaaatgcctcaaaatgttctttacgatgccattgggatatatcaacggtggtatatccagtga

SEQ ID NO: 58578 - DNA, 948 bp, Glycine max
  Peptide Sequence Number=SeqID_150263
atggattacccgcaaatactttccccgattttagcattcctgcactgcccaacgccgcaggcgtggattgacgaagcccgtaaaccggaaaacctgccgctgctgttgaccgaccatatggtatgcgagctgaaagcggcgcaaaacgccatgctgctggtacgccgctacgtcgccgataaagatggcgccgacgagctactggaatgcctgaaaccgtacgaagactttacctatcgccgtgggccggagccggattttgtcgctctgcataaacggatcaacaaaagcgccatgccgcgaaccaacgacccgtggggcagccagttgctcgacagcatgattctgcttatcaaagaggagctgcaccacttctggcaggtgcgtgagatcatgctggcgcgggatatcccttacgtcaaaatcaccgccagcaactatgcccgcggtatgcgccgggaggtgcgatcccatgagccggtgatgctaatcgataagctgatttgcggcgcttatatcgaagcgcgctcctgcgagcgatttgccgcgctggcaccgtggctggatgatgatctacagaagttttatctgtcgttgctgcgctccgaggcccggcattatcaggactacctggatctggcgcagatgatagcggggggagatatcagcgagcgcgtacgccagcttggcgaggcggaagcggcattgatcctccgcccggagcccgagttccgcttccacagcggcgtgccgacgcgttgtagcccgcggtattcggcccctatagccccggtaagcgcagcgctaccggggaggcccacggtagcgaggcgttacagcgttttcaacatccgtacttcacaatcgacgtgccggtgcagcccagcggctcgtcaatatgctcaaacccgagatgctcatacagccaatcgcttctttcaaaaagcg

SEQ ID NO: 58579 - DNA, 327 bp, Glycine max
  Peptide Sequence Number=SeqID_150264
atggagtggttttttcgaatttcgcactcattcttcacgcagattgaggagactgctgagccgagacatctgcctccccctcatgatgaggagttcgtcaagccactcatccccaaggtttcagtcgcgtccgatctccatacgcattcagtggttaactgcgaaagatgtcaggggatggctgaggatttaggagcgattattgaggatttggagcgggtcatcaacctcaggatggtcactgaaagcactgacttatatgacatcatgactcgttgtctgaggagagctagaggtgacgccgcaaatgaaagtcttagactgtga

SEQ ID NO: 58580 - DNA, 213 bp, Glycine max
  Peptide Sequence Number=SeqID_150265
atgcctgttaaagataatcgagggaagtgggccccgaactacgaagggcctttcgttgtgaaaagggctttttccggaggggccctggagcagaatcgtcttaggcagtggtcaaatgccgggatggggctaaaggcagaaaccaatcaaggtaaaacggtaacgcggccacagtttgctacgcgatgtcgtttcctactttcaggtacttag

SEQ ID NO: 58581 - DNA, 316 bp, Glycine max
  Peptide Sequence Number=SeqID_150266
gctttttgtcatacagacagcaaaaaagaatgtttatacggataaccactcgggtatttccgcccgtcagcatgactcaaatgtcagtatgacagatcttgtgagcgcgaagatgacgcttttcgtcttacagacagcaaaaaagaatgtttatacggataaccactcgggtatttccgcccgtcagcatgactcaaatgtcagtatgacagatcttgtgagcgcggaagatgacgctttctcttacagacgaaaaaagaatgtttgtacggataaccactctggtatttccgcccgacagcgtgactcaatgtga

SEQ ID NO: 58582 - DNA, 297 bp, Glycine max
  Peptide Sequence Number=SeqID_150267
atggcttacgaacggggcggagatttcctggaaaatgccgggaagatacataacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggagttagtcttgaagtcatgcgccggttaa

SEQ ID NO: 58583 - DNA, 678 bp, Glycine max
  Peptide Sequence Number=SeqID_150268
atggggagctgctgccctggtgcatattgttggatatatgaacattttccgtcagttgtggagtgcattgttgatccggactatgacgaggtgtcaccacgtgcatgtcggtggattgcgacaaaggcgactgtgaagaccatatccacatcaacgtacaggcagcgtctggatcgactcaggattcctgatgtctgctggatgccttatggggagcatcgaccggtcttggagtttcatttgatttcatgcttttccgatcagctctgctgggggcccgttgctgttagacaccgaccagagaggtcatttgatgagatagacaacaggtggatgcactacttagaccatcttgagccagaaggtgagatgtgtgttgtgccaggtcagtgttcgcccgactacatggactggttcttcatcatttctcatccattcatgacagcggcacaaccatcagatccgccacgagatgcacctgcgacccaaaccaaacatatccctcatatccctcaggtcctggagccctatattcctcaggtcctggagccagcaacaacatcgacacatgctcgttctgatgaggacgagcccagacatgcagtgagacacatgaggtcatcgaacaatgccccaggattgccaggggtgtcacagaagaccgcattgtgtatgtga

SEQ ID NO: 58584 - DNA, 882 bp, Glycine max
  Peptide Sequence Number=SeqID_150269
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgagcggacgaggagctcgacggcgttgtccaggagcgccgagtccgagcccgacgggtcgagcgccggcgcgagcgcgggatcgagccccgcggcgcgctcgcgcgcctcggtccacgcgacattgccctcgatcgtgttgatctccccgttgtggcagaggaggcggaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 58585 - DNA, 622 bp, Glycine max
  Peptide Sequence Number=SeqID_150270
gagatggccccgaggaaacttgcctcaaagagatccaggaaggataaagcggccgaaggaaccagttccgctcccgagtatgcagtcatcgctttaggagcgctgaacaccagcagcgcttcaaggccatcaagggatggtcatttctccgggagcgacgcgtccagctcagggacgatgagtataccgatttccaagaagagatatcctcaaattttatgccaatgcttggcctacagaggagggcgtgcgagatatgaggtcctggatgctatcggccagttcctgggataccctttagtgctggaagagggtcaggagtgcgagtacagccagagaaggaactggtccgataggttcgatgaggaggccatcgcccaattgctatgtataccggggcaagattttgcccgaactgctgccgggagacgggtgcggatcatgcgcaccaacatgaccaccctgactcagatctggatgactttgctgctcagcaacatccagcccagcgatcataattccgacctccccctgccgaagtgtcagttggtgtatgccatcctgacacggatgagcattcacgtggctcagttaatcgctgatgccatctatatatttgcag

SEQ ID NO: 58586 - DNA, 222 bp, Glycine max
  Peptide Sequence Number=SeqID_150271
acttatcaaggtaatccttgtggcgtctatcctgacttatcttccttcactggaagtggcgtctaccgtgacttatcttccttcaccggaagtggcgtctaccctgacttatcttccttcatcggaagtggcgtcatccaaaacctccgtagcctgtatcaaacgatccgctcctactcaggttcacatcatctggtatcagagcttcggctcttgatacag

SEQ ID NO: 58587 - DNA, 666 bp, Glycine max
  Peptide Sequence Number=SeqID_150272
atgtccaaatcttgtggatttgggatgaccggccctctcgatgagtcgatctcttgctttctcataagggtggacccgccctcgccttgggtactagtaccctcaccttctagaggactacacgtcctcgccttcagagggccgcacgccctcgccttcagaggacttcacgtcctcacctttagaggactacatgtcctcaccttcagagggctacacgccctcgccatcagaggactgcatgtcctcaccttcagaggaccacacatcctcaccttcagagggctacacgccctcgccatcagaggactacatgtcctcaccttcagagggctacacgccctcgccatcagaggactgcatgtcctcacctttagagggctacacgccctcgccatcagaggactacatgtcctcacctttagagggctacacgccctcgccatcagaggactgcatgtcctcaccttcgtagggctacacgccctcacctttagaggactacacgtcctcgccaacagagggctgcacgccctcaccttgagaggactacacgccctcgccaacagagggctacacgccctcaccttgagaggactacacatccttgccaacagagggctgcatgccctcaccttgaagaggactacacgtcctcgccaatag

SEQ ID NO: 58588 - DNA, 282 bp, Glycine max
  Peptide Sequence Number=SeqID_150273
atgccgccgcacaatacgtttcataaccactacatgcaagtaaaagggtatcttaaggcttttcatctctggctagtaatcgattaccagaggcctccacaatgttccagtcccctttctaagcttggtaatccatcacaggttctcactgaccgactatgcccgggttgggtcgggattggtcaagcttggttttgggcaatagcaccccagctgacgtccccaaggtctcctgaccccccgcgacatatctccaggtaccactctgtggtcaacaaataa

SEQ ID NO: 58589 - DNA, 528 bp, Glycine max
  Peptide Sequence Number=SeqID_150274
taagcagcagatctccccttattgattttgggaaagctggtggccgcctggcctctctaaccggtgaaaagtggtgggtgtccactaacggccattcctggctcggctccgataacgcaattccggaaggagtcggtagttgggcactggatcccttcggacctggagaacgtgtgacgctgggtcggggtttggtgaaccaactggtcgctcctctagttgaagcctcccagttcaaatacgtcataaggcgtggaattagaccaaggggaatctccataggaactagtccctcagatttcgcacgtaggagatcgagacacagccccagggctatgaggaaagatgaaagcccggccagaaccacacgtgcaagtttccctgcatgtggctcgtccgtgataacttattcggatttgcgcgaactagcggaccgatcactaagtggggatgctccctccagcatgagcgaaccttttcgaacctggttaggaatgggcgtcactatcccagccctgatccagccag

SEQ ID NO: 58590 - DNA, 853 bp, Glycine max
  Peptide Sequence Number=SeqID_150275
atggccgaggtctccacggaggccatcgcttccctcgcccaatattatgaccagcctttgaggtgcttcacctttgcggacttccagttaacacccacggtggaagagtttgaagagatcctgggatttcctctgggaggaaggaaaccatatctcttctcaggattctatccctccttagctagaatttctaaaatagtcaaagtctcgacacaagaattggaccgcgggaagcaagtcaaaaatggggtggttggggtaccaaggaaatgtttggaagcaagggcgagagtcttggcaagtcaaggcgaatgggccccgttcatggacatcctggcacttttgatcttcggggtggtcttctttccaaatgtggatgggttggtggaccgagcagcgattgatgcttttatcgccttttatgaccgcaaggaaagcccggttgtcgctatcttagcggatctatatgacacattcgaccgaagatgtgagaagaacaatgcaaggatcatttgttgtatgccggctctctacatatggttggtttcacacttatttcgccaagagatgagacacgtttgcccgctagaaggccaccgctcatgcaccgagaaaaaagaggtaaactgggaccagcttttagcgaacaaagaaggagcgtctgtcaattggttcccccgatggaaggaaggaagaaccgggattattatttcgtgtgggaaatttccaaatgttcccttgatagggacaaggggttgcatcaattacaatcccgtcatcgctataagacaacttggttaccctatgagaggagcgccatcaaaggaaggcctcataccttttattatacgag

SEQ ID NO: 58591 - DNA, 423 bp, Glycine max
  Peptide Sequence Number=SeqID_150276
atggtgaaagttggaaccttacgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattcgcggggctccagactcgaaggtggaggatgcatga

SEQ ID NO: 58592 - DNA, 334 bp, Glycine max
  Peptide Sequence Number=SeqID_150277
gtcgactctagaggatcccgcgtactttgctatcggtgctggtgcagtgacttcttttggataccgtaaggatcggaatggtcaatggctgaagaaagatgcacttcctcctcaagatgagcgtactccttctcctcctcctcagcgagatgattcagccctcatgactgaagttctttccgagttacggggtcttcgttcttatgttggtgaacgtttcgactcactggatactcattttgccggaatggatatccgtctcacacagcttgaagaagatgtgggttacattcgtcagagtttcgatcttccaccaccacctccaccttcttag

SEQ ID NO: 58593 - DNA, 548 bp, Glycine max
  Peptide Sequence Number=SeqID_150278
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacgggaggaggctaggttagccgaaagatggttatcggttcaaggacgcaaggtgcccctgctttttcagggtaataagggggtagagaaaatgcctcgagccaaagttcgagtaccaggcgctacagcgctgagtaatccatgccatactcccaggaaagctcgaacgaccttcaacaaatgggtacctgtacccgaaaccgacacaggtgggggtgccctcctcacaaagggggtcgcagtgaccaggcccggggcgactgttttaccaaaaacacaggtctccgcaaagtc

SEQ ID NO: 58594 - DNA, 450 bp, Glycine max
  Peptide Sequence Number=SeqID_150279
atggcgaattcgtcagattccattgtgtcttccacaatggaatctgaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtatttataccaaatcccatcaatcgaatcgctttttcgagaaatacgagacatctaagtcatccaagtaa

SEQ ID NO: 58595 - DNA, 543 bp, Glycine max
  Peptide Sequence Number=SeqID_150280
atggtgaaagttggaacctcttacgtgccgatcaacgtctcattttcgccaaaagttggcccagggcttcccggtatcaacagggacaccatggatttagatttgtatgtgtgggacgaagggttgtttagacccacagtgtatgatggtgtttttgaggtgctccagtggcgtatctgtttctatcagctgttccctcctgttcagctactgacggggaatggtgttatccgtaacggcacaaagcaccagccggacatcagcgctggcaagtgtagcggtgctaatgacgctgacgcggcgcgtccctttcccagtcaggctgtcggcaactgtaatgaggaagcgcgggcgatcgaggtgttcccagtcgaacgtgtgtggcaggagaaaaaaggctgcacgggccagtcagaatatgtgaatacgactcactatcagggcgaattgtctgagctcctaccgctgggaagtgagacggggtccgcggcaaagccgtttttccataggctccgcccccctgacaagcatcacgaaatctga

SEQ ID NO: 58596 - DNA, 534 bp, Glycine max
  Peptide Sequence Number=SeqID_150281
atggctccgagaaagctttccgcaaagagatctaggaagggcgccacggctgaagggactagcgccgctcccaagtttgacagtcatcgtttcaggagcgctaagcaccagcagcgtttcgaagccatcaagggatggtccttccaccgagagagacgcgtccagctcagggacgatgagtacacagatttccaggaggagatagctcgtcggcgttggacgtcgctggtcactcccatggccaagtttgatctggatatagttctagagttttatgccaatgcttggcccacggaggagggcgtgtgggacatgcgatcatgggtaagggaccagtggattccttttaatgcagatgccctcagccagttcctgggatactcgctagtgttggaggagggccaggagtgcgagtatagattttgcccagaccgctgccaggagacgggtgcggatcatgcgcaccaacatgactaccttgacccagacgtggatgatgttgctgttcagcaacatcctgcccagcgatcataa

SEQ ID NO: 58597 - DNA, 336 bp, Glycine max
  Peptide Sequence Number=SeqID_150282
atgactagaggaaatccatctgacttacaaccctttgatcctgagatagataggacatttcatagattagttagacatcatttagtaccttttgagcattctgatattggtgattttgagcattccgattttgaatattctgagaacatggcacaccctccaccccgtgagaggactctaagggaattggctgcacctgatttcacctacgaaagcttgtgcatccaataccctgatgaggatgtcccatatgttcttaaaactggactgatccatttgcttccaaagtttctgatacgaaatcagagtgtggtaacggaagcaaacaaccaataa

SEQ ID NO: 58598 - DNA, 126 bp, Glycine max
  Peptide Sequence Number=SeqID_150283
atggggcaaaacacaccaaaagattatgatgatggatggctcgaattctcacaaaggaataacaaggatttcaagtcacaaaatgtcaagagacttttattttcagaacaattacccattacttga

SEQ ID NO: 58599 - DNA, 198 bp, Glycine max
  Peptide Sequence Number=SeqID_150284
atggagaattggcgaacagcgctaagcaataacattgcggggctccagactcgtaggtggaggacacttgaactgcgccaggcaatgaccttcatcgggctccgaaaaaattggaaaaaggagaaattgggaaacaccgctccccaaaaccttatagggtttccaaactccaaggtgggggactctgaaccaggtcag

SEQ ID NO: 58600 - DNA, 306 bp, Glycine max
  Peptide Sequence Number=SeqID_150285
atgattgatgcacaatccgtaagccgtgacatcccggatacatatcaaataaacactggtaatcgattacatgctcatgcacccaggcccacttggccctccggaatcattcctaccagagaggcggtaaatgcttttgaagatttggaagcaaccctgctgcctgggcgagctactcatgcctgggcgagctgggcaaaaccacctccctattttgctactaaatatcttggggaggaaggcaagaaggaaggggtcagccccttgagacttctctctcttgtcttgaatttgcttggaatctga

SEQ ID NO: 58601 - DNA, 891 bp, Glycine max
  Peptide Sequence Number=SeqID_150286
atggtagaagtctccacaaaggccattgcctcccttgcccagtattatgatcagttgttgaggtgcttcacctttggggacttccagttatcacccatggtggaagaatttgaagagatcctaggatgccctctagggggaaggaaaccatacctcttctcagagttctatcgctcattagctagaatttccaagatagtccaaacctcggcccaggaattagaccacaggaagcaagtcaaaaatggggtggttggaataccaagaaaatatttggaggcaaaaacaagaatcttggcaagtaaaggcgagtgggccccgttcatagatattcttgcactgttgatcttcggaggagtcctctttccaaatgtggatgggttggtggacctagcaacgatcaacgcttttcttgcctatcataaccacaaggaaagcccggttgtcgctatgctagccgacctatattacaccttcgaccgaagatatgaaaagagcaatacaatgattgtttgttgtactccagcactttatgtatggttagtttcacacctttttcgccaagaggtgaggcatgcttgctcgctagaaagccactgttcatgcacagagaaaggaggggcaaattgggaccaactcttagcaagcaaagaaggagcatctgtcaactggttccctcgatggaaggaaggaagaaccggagttcttatttcatgcggaggatttccaaatgttcccttgatggggacgaggggttgcatcagctgcaatcctgttcttgctataaaaccaacatggagacacttcagaaggtccgcaaggcatgggaggtgttgcaaaagaaggacaaggaacttaggggcagtaacaatgggcccatcggtggctatc

SEQ ID NO: 58602 - DNA, 494 bp, Glycine max
  Peptide Sequence Number=SeqID_150287
atgaggggagtgccaacagaagaaagtctctcacctttccttgtgagggatttaggcgcgcaaagtctcaaggtgatacaaagagtccacaaggcgtggagaagtccattgaggaaagacaaggagcttagaggcatctgtaatggcgtcatcggtggttatcatggatggctaagagttcacacgcgagggttagattggctctctaaattgaaagttatcgatgaggagaacttcgaagctccggaggaagatgaggaagtccaagctctaaaattagagctagggaaggcaagactcgccaaagaaaacgcggccactgcaaaagcccttgaacaagaaaccaaaagggcccgcacggaggaacatggccgagagaaattccgaggagctttgtggggtagcaacaatgagctcaagctccgaagagaggaaagagaccggtcacgggtgcatggcatgatcttaaaagaagagttagctgcttgcgcaag

SEQ ID NO: 58603 - DNA, 396 bp, Glycine max
  Peptide Sequence Number=SeqID_150288
atggcgaatcaagaggagtgggtcccgtttatggatgtattagcattgctaatctttggggttgtcctctttccaaatgtagatgattggctcgccaagttaaagattatcaacgaagagaatttcgaagctccggaagaagatgaagaagtccgagctctgaaaaccaaactaggaaaagcgagacttgccaaagaaaaattcaagttggttgctacagacatccggaaagagtgtgccgggttacgagaagaaaatgcagctaccgcaaaagcccttgaacaagaaaccaagagggctcgcaaggaagagcacggccgtgacaaattccgtggagcattgtggggcagcaacagtgagctcaagcttcgaagggaagagagagaccaatcatga

SEQ ID NO: 58604 - DNA, 228 bp, Glycine max
  Peptide Sequence Number=SeqID_150289
atggaaaagggtgagaaggtaaatttgactacttatacttctggaaaggataggaagaagtctataggcaccaataaaggaaggattccgactcaaccaacaattaaaaaggagtcaaagtatttcttttgtaaaaagaaaggacacatgaagaaggactaccccaaatttaaaagttggtttgagaagaaagggtatggaaagcctaaggaagccagtgggaagtga

SEQ ID NO: 58605 - DNA, 252 bp, Glycine max
  Peptide Sequence Number=SeqID_150290
atgaagaacagtggaaaaccttcgcgaaatcgcccacggaaacgtctcgaaagcgttacgaaagagcctcggcttgaattttcttcacggaaacaatttttctcactaattttaagggaaaacgggaggtcgttgccgtccagctcgcccaggcgagctgggttgcttccaccagaaggcggtgccttctgttggaaaatcctagaaggcccaagtggacctaattgctatttgtacacccatgtttactaa

SEQ ID NO: 58606 - DNA, 234 bp, Glycine max
  Peptide Sequence Number=SeqID_150291
atggccgcggttgtctcattccacgccggacacgcagttccgggtaggcagttcgctccatgctggactgtatgcacgaaccccccgttcactccgaccgctgcgccttatccagtaactattgtcttgagtccaacccggaaagacatgcaaaagcaccactggcagtacccactggaaattggattaataggagatagtcttgaagtcatgcgacggttaaggctaaactga

SEQ ID NO: 58607 - DNA, 249 bp, Glycine max
  Peptide Sequence Number=SeqID_150292
atggcagacaacacacgcatgaaggagcttacaggggatgtcaaaaggatcctgaagatgatggaaaaccgcaataaagaatatgctgctcggtttgagaccttagaaacaacactggagatgacactcaaggataaaactagagatcctgggagtatatcactggctatgaacaatcacccttttaagctaatcgagttcatggaaggacacaagaagctctattggattgctttgtgggaggattaa

SEQ ID NO: 58608 - DNA, 306 bp, Glycine max
  Peptide Sequence Number=SeqID_150293
atgaaggagaggcaagctagaggtgttggaggacctcagagaaaccatccttttagggggaatggtaacaagaggatgaagccgtatgctagcaacaaggggaagcaacctatggctgcctccaacatgagccagtcaagggggactggggtacaatgctttcagtgtggaggaccgcatattaagagaaattgcccacagctccagcagacacaggagaatcgttgttatgtgtgtggcaaggtgggccattatgctcgagaatgtagggtgacccggacccccgacagtgacggccaattctaa

SEQ ID NO: 58609 - DNA, 600 bp, Glycine max
  Peptide Sequence Number=SeqID_150294
gcatagaacatcaagttgatctcctccccggagcttcattgcctaaaagaccaacttacaaaagcaatccccaagagactcaacgtaaggatgcacatgccaaagttgagtatgtgaaaagattgtatgaccaagtgaaggtgcaaattgcaaaaaagaatgaaaactatgccaagcaaaccaacaagaaaaggaaggaagtggtacttgaacccggtgatgatcctggacatttgaggacaaatgttttccaagaaggagggaatgatgagaatcatgaaactgaccaaatacaggctaaaggcccaagtggagaaggacaaaggcctaagtggagaaggacaaagcccccgagtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgtaagattcacatcatctggtatcagagcttcggctcttgatacag

SEQ ID NO: 58610 - DNA, 198 bp, Glycine max
  Peptide Sequence Number=SeqID_150295
atgcgtggaagatttgtagaacttgtgagcagtgttagagagctggaagtgcacttacatggagacaacaaatgcctcagcaacctatgctattctatgaggtttggagtacctaaagcaatcgttagtaatcaaggaacccatttttgcaacaaatcaatgcatgccttgcttaaaaagtatgggattgtacacagg

SEQ ID NO: 58611 - DNA, 864 bp, Glycine max
  Peptide Sequence Number=SeqID_150296
atggcagaagtggcggatattcttagccgcccagaacagattgtgatcctgcccgacctcgctgccggttgctccatggcggatatggccaacctggccaaagtagagcgtagttaccgcgagctgaataaggtactcaactttgatgagaccatcacgccagtcacctatatcaactcggcggctgatttgaaagcattttgtggtgagcacggcggcattgtctgcaccagtacaaacgcgccaaaaattctggaatggggttttagccagcgcgaaaaaatcctgttcttccccgatcagcacctgggtcgctggagcggacacaaaatgggtatccctctggaacaaatgccggtatgggatccagacctgccgatgggtggcctgacagaacaacagatcaaggatgccaaaatcctgctatggaaaggccattgctccgttcaccagatgttccgcaaacagaatatcgaccagttccgtgcccaacatccagatggcaaagtgatctcccacccggaaacggcgtttgaagtctgtatcaactccgactatgtcggctctaccgaatatatcctgcgcaccgtcagcgaagctgaaccgggtagcaagtggctggtaggtacggagctcaacctggtcacccgcctggcagaagaaatgaaaccacaaaacaaactggtgcagtttatgagccatgttgtctgtgaatgttcgaccatggcccgtatcgacccgcaacacctggcctggtgcctggaaaacctggctgaaggcaatgtggtcaaccagatcaaagtgccagagcacgaagctaaactggctaaactcacactggaccgtatgctggcagtctcataa

SEQ ID NO: 58612 - DNA, 705 bp, Glycine max
  Peptide Sequence Number=SeqID_150297
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatgcaaaattcaccaatgttaatttggaagggactacaaaggcaacattgttgacaataattggaggaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58613 - DNA, 120 bp, Glycine max
  Peptide Sequence Number=SeqID_150298
atggaagacgcacccgcgagccccgcgtcaccctctcgccgaagggtaggttgcgacagttggcgactccactggggaaagtttttttttacaccgcattctaagcacccacgggtttga

SEQ ID NO: 58614 - DNA, 446 bp, Glycine max
  Peptide Sequence Number=SeqID_150299
tgaaggtgcaaattgcaaagaagaatgaaagctatgccaagcaagccaacaagaaaaggaaggaagtggtacttgaacccggggatgatcctggacatttgaggacaaatgttttccaagaaggagggaatgatgagaatcctgaaattggccaaatacaggctaaaggcccaagtggagaagggcaaaggcccaagtggagaaggataaagcccccgaagtttctctctgggttccttgttgaaccaattatcagacttatcaaggtaatccttgtggcgtctaccctgacttatcttccttcaccggaagtggcgtctaccctggcttatcttccttcatcggaagtggcgtcatccaaaacctccgtagcctatatcaaacgatccgctcctactcaaaaatatagaaatggcaataacggaagctacagggctccaaatgag

SEQ ID NO: 58615 - DNA, 561 bp, Glycine max
  Peptide Sequence Number=SeqID_150300
atggtgaaagttggaacctcttacgtgccgatcaacgtctcattttcgccaaaagttggcccagggtcttcccggtgctccagtggcgtatcatggtttctatcagctgttccctcctgttcagctactgacggggaattgttatccgctaattcggcacacaagcataccagccggaacatcagcgggcaatcggcgaaacctgtcgtgccattcgctgcattcaaggtgaatcggccaactgttgcgcgaagggcgatcggtgcgggcctttgcgctattacgccagcggcgctaaagggcggatgtgtgcatactggcgattactatgttggcactgtaacgccagggtgtccagtcgaacgtgcttcatgtggcagaaaaaagcgcacggtgcgtcagcatgaatatgtgatacagactcatataggcgcgaattcctcgctcactgagctcctaccgctcggtcgtcgactgcggcagcgctcagaactagtggcttaccccaacggggcggaattcgatgggtttcttctggataatgccaggaagacaccctag

SEQ ID NO: 58616 - DNA, 255 bp, Glycine max
  Peptide Sequence Number=SeqID_150301
atgcataggtctcctacaggcaccttagttcctttgaacttagaaatagaagctacactaagaaggaacagggctgagaggagaaggaaactattgcaagacagaacagttgcatccattctagaggaggagactcattttttttattcattatcacctgattcaccatcatcaagggaatccgctaatcaatattctgaagttgttaccatggcagatgagcatgaccagaggactacccttgaggactatcaa

SEQ ID NO: 58617 - DNA, 408 bp, Glycine max
  Peptide Sequence Number=SeqID_150302
atgtgtaaagcagaggaggtgcaagagaaggtgaaggccgacatggagggcatgaaagaaaaaatggccacaatgatggaggccatgatgagcatgaggaagataatggaagccaatgcggttacaattgccgctaccagcactgttgctaaggtgaacccgatgcccccatatggcctcaaccaaatgaatcatccaaccttagatatggtaggcaaagatttgggaagtagggacggcccccatgatgtgcaaaatcaaaacaagcacgccttcccgccatatggcctgcctcccaactatacaccacccaatgtggcgtacactcccaatgaggatgtaaataactccactcctatacccattgagagccaacaaccccaaactgatcatgcacatgtctcttaa

SEQ ID NO: 58618 - DNA, 926 bp, Glycine max
  Peptide Sequence Number=SeqID_150303
cctacacgccctcgcctttagaggactacacatcctcgtcttcagagggctgcactccatcaccttcaaaggactacacgtcatcgccttcagatggctacacgccctctccttcagagagctacacgccctctccttcagagagctacacgccctttcctaccgaggactacacgtcctcgcctttagaggactacatgactacacgtccatatcttcaaaagactacacgtcctcgcttaagaggactacagatcctcaccatcagaggactacacgttctcgccatcagaggactacacgtccaagcctttcaagggcaacaccccctcgccttcagagggctacaggtccttaccttcagtacgctggacaccctcaccttaagaggactacacgtcctcgccttcagagggctacacgtccccacctttagaggactacacgtcctccccttcagaggtctccacgccctcgcctttagaggagtacacgtcctcgccttcagaggactacatgtccacaccttcagaggagtacacgtcctcgccttgagatggctacacgccctcgccttcagaggacaacacgtcctcaccttcagacttctacatgtcctcgccttcagaggactatataccctcctctttatagggctacatgccctccccttcaaagggctacacgtcctcgccttcagaggactacacatcctcctcttcagaggactacacgccctcaccttcagaggcctacacgccctcgccttcagaggactacacatcctcgtctttagagggctgcactccatcaccttcagaggactacatgtcgtcgccttcagagggctgcacgccctctcctttagaggcctacacgccctttccttccgaggactacacgtcctcgcctttagaggactacat

SEQ ID NO: 58619 - DNA, 525 bp, Glycine max
  Peptide Sequence Number=SeqID_150304
atggaggccataaaagagcaaatggccacaatgatgaaggccatgatgagcatgaagaagataatggaagccaatgcggttatagttgccgctattagcgctgtcgctaaggtgaacccgatgctcccatctagcctcaagcaaatgaatcatccaacctcaaatatggtaggcaaagatttgggaagtacggcccccatgatgtgcaaattcaaaacgagcatgccttcccgccatatggtttgcctctcaaatatacgccacccaatgtggcgtacactcccaataagaatgtcaataactccactcctatacccattgagagccagccaaccccaaactgatcaggcacatatctctcaaaccatgggggagacacatgaaattccccaccacaatctagctgacttcgagccttggctcggatatgccactgaagggcaagcagttggtggtatacccctgcaaaacactttggagggccctcaatatcatccacaaccacaaccctcacgttccacagcg

SEQ ID NO: 58620 - DNA, 854 bp, Glycine max
  Peptide Sequence Number=SeqID_150305
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcgtccatcgttgcagttagtatgcaagatactaacctcaactcaggaaatttagtaacatataaccttatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58621 - DNA, 63 bp, Glycine max
  Peptide Sequence Number=SeqID_150306
atgtatcaccatgaaggttatcatttactactgctaattggcgttgctgtggaagcgctttga

SEQ ID NO: 58622 - DNA, 276 bp, Glycine max
  Peptide Sequence Number=SeqID_150307
atgcatatgaggatcaaaaggtcttttaaggttgtaatggggccaaggacaagaaaggggaacataggctcaaaggggctatcaagggaattaattcaaggtatgctcatttggctaaaggcttataagaacaaaatgcctaaatcatctcccaacatgcatgtgaagcaagaagtatcaacaagagtcaagccaaggctattgagcaagcaatcaatggggcaaaacacatcgaataaaatagatgatgatggctcaaattctcaccaagggtaa

SEQ ID NO: 58623 - DNA, 198 bp, Glycine max
  Peptide Sequence Number=SeqID_150308
atgtcagtgaaaaacctcgtcgggcacctaggaggagaccagtcagggtcaccgtgttttgctagaatgctccaatcatgtgggattggcacaagcttaaaggagcactcaaatcgggtgacccccaaggcctacactccgaagagtccttcagggcctctccctcctgattcaggtccaacccagaaaacattttag

SEQ ID NO: 58624 - DNA, 191 bp, Glycine max
  Peptide Sequence Number=SeqID_150309
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcaagctgtccctcctgttcaagctactggacgggggtg

SEQ ID NO: 58625 - DNA, 246 bp, Glycine max
  Peptide Sequence Number=SeqID_150310
atgtcatttccaaggtatatagttgaagtgatggttaatcacaagggcgaacataccaaatttttgctctgggaccatgaatgtgcagagttaattggtcaatcagcggatgaagtcaataggctcaaaatagaagatggcaatgctgatttaaatgtctctcctcaagcactagataggctattgggttgtttccttgcattcaaagtcaagccatgtttgcaagatcgagagtccaatacttga

SEQ ID NO: 58626 - DNA, 324 bp, Glycine max
  Peptide Sequence Number=SeqID_150311
atgcgtagtgattgcttagtgcaattctccattctcaatatttttcggagacccatgaattgcgttttcgttcatgcatcctccacccacgagtttggagccatgcgtagtgattgcttagtgcaattctccattctcaaccctttttcggagcccatgaattgcgttttcgttcatgcgtcctccacccacaagtttggagccatgcgtagtgattgcttagtgcaattctccattctcaatctgttttcggagccccatgaattgttttcgttcatgtgtcctccacccacgagtttggagccatgcgtagtgattgcttag

SEQ ID NO: 58627 - DNA, 738 bp, Glycine max
  Peptide Sequence Number=SeqID_150312
atgtctgcttcagagaaagttgcaatcgtaaccggtgcatcccgcggaattggtgccgccattgccaggcagcttgctgcggacggctttgccatcgtggtgaactatgccggcaacgcagaggctgctgccgccgtggttgaggagatcgaagctgccggtggcagagccatcaccgcgcaggcggacgttgctgatgccagccaggtaaaacgcatgttcgatttagccgaatctgcgtttggcgctattgatgtgctcgtcaataatgccggcgtaatgatgctgtctccgctggccagcgccgacgatcagagttttagcaagcagatcgacatcaatctgaagggaacgtttaacaccctgcgcgaagcggcaaaccgcctgcgttctggcgggcgcatcatcaacttctccacgtcggttgtcgggcttaagcttgagaattatggcgtctatgccgcgaccaaggcggccgtcgaaacactgacaaccatcatgtccaaagagatgcgtggacgcagcatcaccgtcaatgccgtcgcgcccggtccgactgcgaccgacctcttcctcaacgggaaaagcgatgaactaatcgcgcgcatgtccaaaatgaatccgctggaacgcctcggcacgcctgaggatatcgccagtgttgtttctttcctcgccggaccacagggcagctggatgaacggacagatcctgcgcgccaatggcggaatggtctga

SEQ ID NO: 58628 - DNA, 405 bp, Glycine max
  Peptide Sequence Number=SeqID_150313
atgtcatcaatagcaacatcaacaatatatcgcatcccattagtcaaaaacattgttttcttgaaaactagcatgcaacagggacaggcatacatccccatagttaggttccctgaccccaactatggtatcaaaatggtaaattataagaaactcccatcacctatcgtgagctctccgttagttcctctttacgtcactcagaggtctctctcgttcatgcttgtcagtccaaacacaagtctctatatgccaaattcaaggaaatttaatatagatttcataaacaaagtaatgacaaacattcagagtcaaatacccctgtcaaaatgtaaagggctgaggggtgtttcggattctacaaaaaggaaacatcattttgaaattccgatcacaccaatgtga

SEQ ID NO: 58629 - DNA, 114 bp, Glycine max
  Peptide Sequence Number=SeqID_150314
atggtagaaatcaaccaaggtaagacgatgaccggtcacgattggccgcatatttttgtctcctgcttgcaggttagctcgcctgggcgagcaacccctgcatttaaaatataa

SEQ ID NO: 58630 - DNA, 45 bp, Glycine max
  Peptide Sequence Number=SeqID_150315
atggaggagatacatggagaatatgatgaagaacaaggaattaaa

SEQ ID NO: 58631 - DNA, 420 bp, Glycine max
  Peptide Sequence Number=SeqID_150316
gaacgtcctaatttgaagttggtgtcacatgggaggaaggtgacattgattgggaggccagtgcttgagattgaaggactggttggtgccacaggattaagtccactgatctattgttcagttgttactggcgatcctggacttatatccgcatttgtggagaggtggcacaacgagaccagcaccttccaccttccggtaggagagttgacaatcacattagatgatgtgtcgtcactcctccatttgcctatcactggcgcgttgcacaactttcatgctctttctgcggaggagacgatatttttgttgaccgagttgcttgaggtgtctgctgaggaggctagagccgagacagcacgatcacgtgggacatacgtactgctgggatgggttcgagacatttatgagatgagatga

SEQ ID NO: 58632 - DNA, 507 bp, Glycine max
  Peptide Sequence Number=SeqID_150317
atggctgcaagtgatattgctattctcagagataaagcccacataccaacaaagaaaagtcttctggaacttacatcgcaagatgcgttgttggcacaaaacaagttgctgtccaagcaattggaagcattgtccgaaacactaaggtgtgccatctgtagtggagctcacaattctggctgttgtatccccaatgaagaaccagctcatgaagtcaattatatggggaaccagccaagaaaaaatttcaatgcagatggatattctggatttcggcatggcgaaccatataattcacagcagggacaatggaggaatcaccctggaaatcagttcaacaaagaccagggtggtccatctatcaggccacaacaacaagtgtctagtctctatgagtgtaccacgaagctggaagagactctagctcagtttatgcaggtttcaatgtctaaccataagagcacggagtccgccattaagaatctgaaggtccatgtgggccagtga

SEQ ID NO: 58633 - DNA, 528 bp, Glycine max
  Peptide Sequence Number=SeqID_150318
atgttgtacaactctcactttgcccgcgagctgcgcgctattccagggtttatagctaaacttatcattgtcgagaatcaattctccccggtcagcaatgccgactggcggtacacgttgtcctttttcaatgttgtgagcgcaagcccacagaggcagcagcaggcaagctgcgcaaggatagtgatccgaccacttggtcatgcgcttttaatgataagtgcgatcaatgtggttttcccgcaagcgcgatgccagtttgcgggtcaacgcacatatccacgaaaaaacgacggcttatactgccctcagtggcggtttgcaaagattattctgaataattgtaatcaaacggtggcgaagtacgtgaagatcctgttccgtggacggttgtatatcaaggatgttggcgcttttgagtttgataagggcaagatccttgtcccaaaagtgaaggacaaacagcacctgtctgtgatgtccgaagtcaaccgtcaggttatgcgtctgcaaactgagatggcttaa

SEQ ID NO: 58634 - DNA, 93 bp, Glycine max
  Peptide Sequence Number=SeqID_150319
atggaggaggaacatatggcttgcttggaccagcagcattctggaaataagatttggatgattcctccaacctggattgtatctattgcttga

SEQ ID NO: 58635 - DNA, 262 bp, Glycine max
  Peptide Sequence Number=SeqID_150320
ggatcgtgcccacaagacacccagtggacccgaagaagtccaacagggtcctggggtttctagctctgggatcgcacccgcaagaaacctagtggaccagaacaagtccaacagggtcctagggtttccagctctgattacgggtctctatcagttccacggagtgcccgtcgcccctggcaagttcatcaagccccccattaaccgggctttcatcaagaagtactgcacccccaggcaggcgcaggacgagacaccatag

SEQ ID NO: 58636 - DNA, 724 bp, Glycine max
  Peptide Sequence Number=SeqID_150321
atgctcggcaaagtgcttggagataccatcaaagatgcgttgggggagaacatcctcgaccgcgttgaaaccatccgcaagctgtctaaagcttcccgtgccggtaacgaagccagtcgtcaggagctgttaaccacattgcagaacctctctaacgatgagctactgcccgttgcacgtgcattcagccagttcctgaacctggcaaacaccgctgagcaataccacagcatttcgccaaacggcgaagcggccagcaacccggaagtcattgcccgcacccttcgtaaactgaaagagcagccagatcttaacgaagccaccatcaaaaaagcggtagagtcgctttcgctggagctggtgctgaccgcccacccaaccgagatcacccgtcgcaccctgatccacaaaatggtggaagtgaataactgcctcaagcagttggataataaagacattgccgactacgaacgtaaccagctgatgcgccgtctgcgccagctgattgcccagtcctggcacaccgatgaaattcgcaagcaccgcccaagcccggtcgacgaagccaaatggggctttgcggtggtggaaaacagcctatgggaaggggtacctaactatctgcgcgagctgaacgagcagctggaagagaacctgggctaccgcctgccggtcgactttgttccggtccgtttcacctcctggatgggcggtgaccgcgacg

SEQ ID NO: 58637 - DNA, 722 bp, Glycine max
  Peptide Sequence Number=SeqID_150322
tcctcaccttcagaaggcctcacaccctcaccttcatagggctacacgccctcacctttagaggactacacgtcctcgccttcagagggctacacgtccttaccttcagaggactacacttcctccccttcagagggctacacgccctccccattagagggctacatgccctcaccttcagaggactacacgtcctcaccttcagagggctacacgcccttgccttcatagggctacacgccctcgccttcatagggttgcacgccctcgccttcataggacttcatatttgcgccttcagagaactcaagattcgagggcgaccaactgtgcgaccacaaccagagagggaggctatcgtgcaactactatgcctactggggcaagatttcaaccagccgctgcaaggagacaagtgtggatcatgcacaccaccacaacttcgatctccccctgccgaagtgtcagttggtctgtgccatcatgacataggcctctgtcagtcctatagggtgcccgtccccccagcaaggtcatgccatcgtgacatagggatcgcacccgcaagacacctagtggacccgaagaagtccaacaaggtcctggggtttctagctctgattacgggcctatgtcagttctacggagtgcccgtcgcccccaacaaggtcattaggccccctattaaccacgatttcatcaagaagtattgtgccccttag

SEQ ID NO: 58638 - DNA, 539 bp, Glycine max
  Peptide Sequence Number=SeqID_150323
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagttttccattttgcactttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 58639 - DNA, 496 bp, Glycine max
  Peptide Sequence Number=SeqID_150324
atttcccgccttgatcacaggactctgccagtcgttcggcgtccccgtcgcacctagcaaggtgattcggccgcccatcacccgagcttttattgagaagtactgccagcagagacaggtccagggtgatgcaccacaggccgcggacgcgccgccacctcatcaggctggtccagctggattgtttgatacagagcagtatttgcggcatttggttcgccagcaggcggccaaccaccgggcacatgtacagacccatgattgtctttatcagatgagtctcagcctgcagagccagggctttacttcttttccgtgccctactccggaccagttcagggcagaggtcgcatggcctggagattggcctgaggcccaagcaggaaaggcaccagcaggggcaccagcagaggctcccgacgaggcagatgaggcccgcgaggacgaagagatgactgatttacttgatttcttaggagggagcgggaccacatga

SEQ ID NO: 58640 - DNA, 725 bp, Glycine max
  Peptide Sequence Number=SeqID_150325
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccattgctctctctcgagattctaccactgcacgtcgactggatgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58641 - DNA, 339 bp, Glycine max
  Peptide Sequence Number=SeqID_150326
atggtcgagaatcttcgtgtaacctaccttcggcgggaggggagcgtgactcgcaggaggcgtgttcttcacgaaaggaatatttccgcggagtcagccaccaacgtttatttgagagagagagaacgtcggaaaaacctggaaagacgcgacttctacttcgaacttctccccctatttatagaaaaggttcgggaggcttgtcatttcccagctgccggggcaaggattagcccacacgttccgtcccagggcaaggcagcctttgaatctggagggcccaaggcctttggaaactcctacgaattcctcaatgcgatgactgttttctttccgtaa

SEQ ID NO: 58642 - DNA, 609 bp, Glycine max
  Peptide Sequence Number=SeqID_150327
ggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgctgctaaggtgaacccaacgtccccatccggcctcaagcaaatgaatcatccaacctcaaatatggtaggcaaagatttaggaagtatgggcggcccccatgatgtgcaaattcaaaatgagcacgccttcccgtcatatggcttgcctctcaactatacgccacccaatgtggcatacactcccaataagaatacccatgaaattccccatcacaatctagccgacttcgagccttggctcggatataccactgaaaggcaagcagttggtggtatacccctacaaaaccctttggagggccctcagtatcacccacaactgcacctcttgcattccacagcggataaaaaccctcatgactatggcaggaatgggaaagttggatcatctaaaggaaaggctcagggccattga

SEQ ID NO: 58643 - DNA, 312 bp, Glycine max
  Peptide Sequence Number=SeqID_150328
atgaaactggccaaatacaggctaaaggcccaagtggagaaggacgaaggcccaagtggagaaggacaaagcccccgagtggagaaggatgaaggcccagaggcagagacactatcaagactattaattgttgctgaaggcccaagtaatccttgtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccctgtaa

SEQ ID NO: 58644 - DNA, 549 bp, Glycine max
  Peptide Sequence Number=SeqID_150329
atgactggaaggcttcttgccggttcattggcttttgaaagccgcatcctccattaccttattgttcacatcttgcttccgagatcttcaaaccttgctcaggtttctgaagaagatctcattgttatgtgggcctttcataaaggtttacaaattgattgggcacatcttgttagatatcgcatgcataaggcattgcgattgaatgctccattgccttaccctcatcttgttacccttttccttcaacacttcaacatccctcttgattctgaaccttatgttccaatcaagagatctttccttataggcgcttcagtcatagcatcttttgaaggacatgatggagaagattcatctctcctttcaaagattttggacaggtttgatggtcttcaaacctttgttggtgagaggtttgacaatttggaattacaagtggatatgcgcttcaatgaaatggagtcaagaatcacaaaggttgaagaagatgtgtcttacattcattcaagctttgatcttccaccaccgccaccaccatcatcttag

SEQ ID NO: 58645 - DNA, 948 bp, Glycine max
  Peptide Sequence Number=SeqID_150330
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctccttccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 58646 - DNA, 66 bp, Glycine max
  Peptide Sequence Number=SeqID_150331
atggggcacgttgaaacatggatgccaaggtggccaatgcatcaaccatttggttctcttctcgag

SEQ ID NO: 58647 - DNA, 4479 bp, Glycine max
  Peptide Sequence Number=SeqID_150332
atgttgtatgttttctcactcctccaacctattttccttcatgccttatccgcctccatccaccttttcttgctcgtgtcggtgtctctgcattggctttggaacaaagtcacattcacaccaccagcagccagggaagaaaaatctaaggaggagaaacacagacccaatagcaataacaccctcttcaaaacgaccgtgttttgttctcttgctgtttctgctttcagtttcgtcctctgtttgttcaattacttctactggtacacaagtggctggtcagagcaaaatctcgtgacctttttggatttggctctcaaaacacttgcttggggcgttgtttctgtttccctgcacaatggtttctcattcttcttcactgaaaaaaaaaggttcaggttctcattcttcttcggagcttggtgcaccttctacctcgttttttcttgctattccttcgttgttggcattgttgttctccccgagagaccaattcagtacttggtttccgatgttgtttccacttgtgcggggttcttcttctgttacgtggcttattttgtgaaaaacaagggatgcgctaagggtattgaggagcctcttttgaatggtgatgcaaatgttcctaatgaaaaagtggccaagggtggggacactgttacccctttctcacatgctggagttttcagcgttcttactttctcttgggtgggtcctcttgtggctgttggcaacaagaaaaccttggaccttgaggatgttcctcaactagacaccaaagatagtgtagttggcgcttttccgagtttcagggataaacttgaagctgattgtgatgcaaatgcaattaatagtatcaccacacttaagctagtgaagaatttagcaaagtcagcttggaaggagattctcttcacagcttttcttgcattgttgaacaccctggcttcatatgttggtccttatcttattgatgtttttgttcagtaccttgatggacgacggcagtatgaaaaccagggctatgtgctggtttttgtgtttttctttgcgaagattgtagagtgcctttcccaaaggcattggttctttaggttgcagcaaattggaattcgaatgcgagcgctgcttgtcaccatgatctataacaaggccctcaccctttcttgtcagtcaaagcaaggccacacctctggggaaataatcaatttcatgactgttgatgctgaaagagttggtaacttcagttggtacatgcatgatttgtggatggtggcgctgcaagtcgtgttggccttgttgattttgtataagagccttggccttgcttcaattgctgctcttgttgcaaccgttgttgttatgttggcaaatgttcccttgggatcattgcaggagaagtttcaaaataagttgatggagtcaaaagatacaagaatgaaggccacatccgagattttgaggaacatgaggatcctcaaactacaaggatgggaaatgaagtttctatcaaaagtaatcgagctcaggaaaactgagcaaggctggttaaagaaatatgtttatactgcagccatgaccacatttgtgttctggggtgcccccacatttatatctgtggttacttttggtacttgtatgctgatagggatcccccttgaatcaggaaagatcttgtccgcacttgcaacattccggattcttcaagagcccatttataatcttcctgatacaatttcaatgatagcacagactaaagtttctcttgataggatttcatcattcctttgtcttgatgacttacggtctgatgttgtagagaagcttcccaggggcagttctgatacagcaattgaagtaattgatggaaccttttcttgggatttatcttcccctaacccaaagttgcaaaatataaatatcaaagtttttcatgggatgagggttgcggtttgtggtactgttggatcgggcaagtctactttgctttcttgtgtactgggagaagtaccaaagatatcaggcattcttaaggtttgcggaacaaaggcctatgttgctcagtctccatggatacagagtggtaagatagaggataatatattgtttggtgaacgcatggatagggaaaggtatgagaaggtacttgaagcctgctccctaaagaaggatctggagattttgtcatttggggatcagactgtcataggagaacgtggaataaacttgagtggtggacagaaacaaagaatacaaattgcacgtgctctttaccaagatgctgatatatatctatttgacgatccttttagtgctgtggatgctcacacaggttctcacctcttcaaggaatgcttgctgggccttttaagttcaaagacagtggtttatgtcactcatcaagtggagttcttacctgctgctgaccttatattggtcatgaaagatggtaaaattactcaatgtggaaagtataccgatctgcttaatagtgggactgatttcatggaacttgttggtgcacacaaaaaagctttgtctacactagattcattggatgaagtggcaaaatctaatgaaataagtaccttggaacaagacgttaatgtctctagcccgcatgtttttaaggaaaaagaggcaagcagagaagaaccaaaaggccagcttgttcaagaagaagaaagagagaaaggtaaagttgggtttctggtgtattggaattatatcacaacagcatatggaggagctctggtacctttcatattgttggcccagattctttttgaagctcttcaaattgggagcaattattggatggcttgggcaacacccatctcaacagatgtggaaccacctgttggaggaacgacacttatagtagtctatgttgttctggccgttggaagttctttctgcgtccttgtcagatcaatgcttcttgtcacagttggttacaagacagctaccatactattcaataaaatgcacttctgcattttccgtgctccaatgtcatttttcgattccactccaagtgggcgagtccttaacagagcttcaactgaccaaagtacagtggatactgacattccttatcaaattggctcatttgccttctctatgatccagcttctgggaattatagcagtgatgtctcaggttgcatggcaagttttcattgtctttatacctgtgatagcagtcagcatctggtatcagcaatattatataccgtcagctcgagaactatcacgtttagttggagtctgcaaagccccaatcattcaacactttgctgaaacaatttctggtacttcaaccattagaagttttgatcagcagtcaagatttcaggaaacaaatatgaaactgactgatgggtattctcggccaaagttcaatattgctggtgccatggaatggttgtgcttccgcttagatatgttgtcttctatcacatttgcattttccttaatattcttaatttctattccaacgggaatcatagatccaggcattgctggtttagctgttacatatggacttaatttgaacatgatacaagcttgggtgatatggaatctctgtaatttggagaataaaattatatcagtagaaagaatacttcaatatactagtattccttgcgagcctccccttgttgtagaagacaatcggccagatccttcttggcccttgtatggtgaggttgacatacaagatttgcaggttcgttatgctccacatcttccacttgtgttgcgtggtcttacatgcaaatttcatggaggaatgaaaactggcattgttgggagaacaggaagtggtaaatccactctcattcagacacttttccgaattgtagagcctacttctgggcaagttatgattgacaacatcaacatctcttcaattggacttcatgatttgaggtctagactaagcattattcctcaggatccaacaatgtttgaagggacagtgagaaataatctggaccccctggaagagtacactgatgaacaaatctgggaggccttggataagtgtcaacttggagatgaagttagaaagaaagaaggaaagcttgactccacagttagtgagaatggtgagaattggagcatggggcagaggcagttggtctgccttggtagagtgctgcttaaaaaaagcaaggttttggtccttgatgaagccactgcatcagtcgacacagctacggataatttgattcagcaaactcttaggcaacatttttctgactctacagttattaccattgcgcatcgaataacttctgttcttgacagtgatatggttctgcttcttagccaagacattgctgcaggacttattgaggagtatgacactccaacaactttgctagaaaataagtcgtcttcttttgctcaacttgttgcagagtataccatgaggtccaaatccagttttgagaaatctgttgatcactga

SEQ ID NO: 58648 - DNA, 234 bp, Glycine max
  Peptide Sequence Number=SeqID_150333
gttaaaaagaggctaagtcatgaagtgctaaaagggacagttgagcttagctcatcagttgggctaagtgtgcatccatcgctaagcgcagattcaacagcatcaatatcaaggtcgcgcgctaagtgcggcagttatcttcagccaggctcagcgcatgactggcgctatgctcaaatccacttactcgcgctaagcgcgagggtggcgctaagtgcaacgtcgtggatttag

SEQ ID NO: 58649 - DNA, 750 bp, Glycine max
  Peptide Sequence Number=SeqID_150334
atggctccgaagaaactcccgaccaagaggtcgaggaaggaggatacaggctctgaagagaggcgagtccagctgagggacaaagagtacgttgagtttcaagaggaaattgcctggaggcaatggactcagcttatatcacccatggctaagtttgatcctaagatagtcatggagttctatgccaacgcctggcctacagaagagggagttagagataagtactcctgggccagcattgtgagtttagccaaaggaggagtcaggcctccggtttcgatgaggaggctatcagccggttgttgttccagggcaggactttgcccgaagcgtagcggggagacggctggtctacgccatcctgactcagggattacgcctctgagacacccaatggactcggagaagtcctacaaggccttggggttttctactctgatcatagacctttgccagttctatggagtgccgccagctgcaaatgcaccattgccgcctctacatgagataccatccttggggtccatctccgatcacctgaggagattagagctccaaatgcataggtacatgcagcatgtgtctagccagcaggcggctaatcacaggggccagttcggggccatagttgcctggcctggagatgagaccgattttgagacaagggcaagatccgcaggagcccctggggatgacgagggagctcaagtggatgacgacatggctgacatgctggatttcttcacttaa

SEQ ID NO: 58650 - DNA, 1716 bp, Glycine max
  Peptide Sequence Number=SeqID_150335
atggaagaagacttcgacatccccggcggcgaggaaatggatctcggcgaagacgaggtcggcgaggagagggagatcggctctggcggcctcaagaagaagctcctcaaggaaggtcaaggctgggaaacccccgaagtcggtgacgaagtccaagttcattacacggggactttgctcgacgggactaagttcgattcgagccgcgacagggattctcccttcagcttcacgctcggacaaggaaatgctgaaaacactttctttttgctttcatcatttcctgtacaaagcattgaaagcaggaaattaagtgaaaactgtgggcaagtaattaaaggatgggatgaaggtattaaaaccatgaagaaaggtgaaaatgctattttcaccatccctcccgagctagcttatggtgaatctggttcccctcctactattcctcctaatgctacactccaatttgatgttgagctgctgtcatggactagtgtaaaggacatatgcaaggatggcggtatatttaagaagataattactgagggggagaaatgggagaaccctaaggatcctgatgaagtattggttaagtatgaagttcatctagaaaatggaaagcttttagcaaagtctgatggggaggagttcacagtcagagagggtcattattgtcctgcattgtcaaaggctgttaaaaccatgaagaagggagagaaagtgcttttgacagttaagccacaatatggatttggtgagaaggggaagccagaacaaggggatgaaggtgcagttccaccaaatgcaacattgcagattactcttgaattagtttcatggaaaactgtttcagaagtaactgatgacaagaaggtcataaagaagatcctcaaggaaggggaaggatatgagcgtccaaatgagggggccattgttaaagtgaaactaattggtaagctacaagatggtaccgcttttttgaaaaagggccatgatgaagaagagaagctgtttgaattcaaaacagatgaggaacaagttgttgatggacttgatagagctgtattgactatgaagaagggtgaggttgcgttgttgaccattgcacctgattatgctttcggtacatcagagtcccaacaggagttggctgtagttcctcctaactcaaccgtgtattttgaagttgagctagtgtcatttgagaaagagaaggagtcctgggatctgaacactgaagagaaacttgaagctgctggtaagaagaaagaagagggaaatgtcttgtttaaagctagtaaatatgcaagagcttccaaaagatatgaaaaggccgtgaagtacatagaatatgattcctcctttggtgaggaggagaaaaagcaggccaagaccttgaaggttgcctgcaatctgaacaatgctgcttgcaagttgaagttaaaagactacaaagaagcagagaaattgtgtactaaggtgttggaccttgagagtacaaatgtgaaagccctctatagaagggcccaagcacatatgcagttgactaacttggatttggctgaacttgacattaagaaagctcttgacattgaccctaacaacagggatgtcaaattggagtacaggactttgaaggaaaaggtgaaagagaataatagaaaggaggcgcaattttatggaaatatgatcaacaagatgacaaagattggttcctga

SEQ ID NO: 58651 - DNA, 558 bp, Glycine max
  Peptide Sequence Number=SeqID_150336
atggagttgaagatgaggtggcatgaggctacaagtaatgaagaactcgcagttcactttgctagttattctggagcattggctaatccacttttggcttttgaatcagcactgaacacattaaatagctcccttttagaggaatttgttgctatgcttatgggaagaggtgggtcgttctcagctagagggcctggaaaaagggatgcactcaaggctgtagaaaaggaattgccttatattgctagcatgggtatatatgttgttagcaaaaatgtgatgttagaccaactccataagaagtttcctggtgcaaatgactttggtagtgaagtgattcctggtgctacttctattggaatgtgggtatgtgttccttttggttattgtcacaacctactcttcgacgggagggcgaggcgaaataaaaaaagtgtgtcttctcatgaagaaaacgcatggagtcgccaccaacgtttattcgagaaaaacattagaaaaaccaaaaagaggtttttggattttgaaaataagggttcgggagttgtttacacatag

SEQ ID NO: 58652 - DNA, 297 bp, Glycine max
  Peptide Sequence Number=SeqID_150337
atgaattggtctactccatggtttaataccttggtcgttaatgtcatgggaagaaggtatggcaaagtgattcataagaaagacagctgttctcaaatcgttatgcttggccatgagaagttgacaaagttttcattaaaggtggcagcagcgacagtgcaggtttttggtagtgtgcatgaaggagatagggttgatgtcacccctagtcagagtggtgcgaaggagatgtgcctcgctaaaaatgctttgattgaggaaggaggcaattatggagagtggatgatagccaaatga

SEQ ID NO: 58653 - DNA, 387 bp, Glycine max
  Peptide Sequence Number=SeqID_150338
atgggtcgtattagaactggaaggttcaatgttcttgacaacattaatacacgcatcaagttttcaagaccacttgtgatggaagcttgcttgagaagcttctatggaggctggatctttgagcttcagagaagaggtgagaggagacaccatccactagggaataagccatggaagaaggagcttcaccaccaagagagtgccttggataagaagcttagagaggaggcttcaatgaaggaaaagaatgagagagagggggggcacaaaattgaaggagaaaaagagggagagaagttgaactttgaagtgtgtctcacaagtttcacattcatcaaagttatgacaagtgttacacatgcttctatttatagcctaggtcactaa

SEQ ID NO: 58654 - DNA, 138 bp, Glycine max
  Peptide Sequence Number=SeqID_150339
ttcgggttggatcatcgagtaaggaatacgaactgctggtagtcatcggacaagtggttgctgaagtagaagaaggtgacggcgataaagaagaaaaaaaaggtcttgaatgtgaggagtgtccggagaaaattgcca

SEQ ID NO: 58655 - DNA, 615 bp, Glycine max
  Peptide Sequence Number=SeqID_150340
atgatctttgggttctcaaaagctgaaaaactcactcacgagcaacgtagcgcggccggaaggtttgatgtgaaggagtcaaggtgttgcgaaactcacttagaaactcacccacgagaagctagcgcgggaggtttcattcagacgtactcacgaaggagaagaagaacacgcgggacaacttttataatatatggttcacgacggccgtctttatggttcacgacggcacgttctctctccctcttagccactctctcacgccacacacgctctctcttcctctcagccactctcacgcacacgacactagcgctctctccctctcagcacagtagctctctctccctctcagccactttcacgcaccacacacgtagcgttctctcacaagaacagaccctgcactgtaggttttctattattaatgagagtcatcactgtgtgacactggctgcatcactagctgcacagcagggaccaacatctatggctgcatttcaaaattggaacggggtcaggaccttgggagttcctaaggagctcatgactgcacatggcagacaccgtagttatagcttcatattaggcctaggtttcagtggtgtttgctga

SEQ ID NO: 58656 - DNA, 632 bp, Glycine max
  Peptide Sequence Number=SeqID_150341
aactccggaatacgttccggaagaacgtgttctggaatgtttccggaagaagggtcttccggaaggcaaccttcttccagaagaagtagctgttctgtatttgaagatttggtggtcccgtgaagcagagaagataaatagtaaaaagctatttccggaagaaattttaactagaggaggaagtagttccggaatgagaatgttggatttccggaagaagttctttcggaagttactaagctcaattccggaaaaagtggttccggaagtgttttccggaactacttcttccagaattggcattagtaacttccggaagaagttcttccggaatatggacgaagatcaatggacgtatgactgtgcgatgtcacaagaagttgatatggattatgattatgataatgaagaagaatgtggtgtgaatgaaccacatgttgattgttcaaatgcttttaatacgtcccaggtatttggtactcgagatgatgttttgcaatgggctcgaacagttacccatgaaaatggatttgttgcagtgattatgaggtctgacacagataccgacactgggagtaggaaatgtggttgtcccttcaggcttcgtgggaaaccagtgcatggaggggaag

SEQ ID NO: 58657 - DNA, 151 bp, Glycine max
  Peptide Sequence Number=SeqID_150342
atggctagaacacgaggtttaggtcgtgctataggtaaacttataggcagagatagacatgatgaccatgatgcagctgatgttcccgagaggcgtaggcctactgcctcagcccgtaggcaacgggttcatcagatgaatgcggatgcac

SEQ ID NO: 58658 - DNA, 846 bp, Glycine max
  Peptide Sequence Number=SeqID_150343
atgactaatagagtctttggaggttatttatatgcaaaaaactttactgtctggagaaaggctggaaaaggtggagaactgacacatgatgaaaccacaatcattgctggagcgcttgaactctctgagaagacatccagtgatgccatgactcccataactgatatattttccattgatattaatgcaaagcttgatagggatttgatgaatctaatattggagaaagggcatagcagagttcctgtctattatgagcagcctacaaatattattggacttgttctggtcaagaatttattgacaattgacccagaagaagaaatacccgtgaaaaatgtgaccatccaaagaattccaagggttccagaaacgttgccactttatgatattttgaatgagttccaaaagagccatagccacatggctgttgttgtcagacattgtgagaagacaaggcaacagtcttccaacaataatgccgatgggctaagaagagatgctgaaagcaaggagcaaaagttggctgaacaatgggctgcaaaacacttgcaacttactaagtttctagaacaggctgtggtgaacgaagattctactggggatgtaattgctttacaacatcaaattcgacttttgaaggtggaagagctttctatcctcaaacgacgtcagaatgtctctaggtctttgtcattttctttgtcatcgatcagagatataaaacaatcactagaactcgaagactgttgcctagaaaatgcaactgacatggttgaccaacatgaagataacatgccggattatgaatccaagggcatcagaatgtcccacaaacaggtatag

SEQ ID NO: 58659 - DNA, 255 bp, Glycine max
  Peptide Sequence Number=SeqID_150344
atgcgctttagcggcaaatcggatttccgtggaatatattggaacgaagaaaaagtggaacaaaaagcaaccgcaggggaaatccaacaaagacattctcatttagatcctatcgaagagcacatcatggctgaagagccaaaaagagtcaccctcgaagattattcaagttctaatgtgccacaatttttcactagcattgctcaaccagaagttcaagcacaaaccattacatatccacaatcattgatttag

SEQ ID NO: 58660 - DNA, 159 bp, Glycine max
  Peptide Sequence Number=SeqID_150345
atgctgaagtggaaggggcctcagatctcttacccctggacttcttgccagatagggagattcttcctcgcactcaactgcaagagtggtgcgctcagcggatggctcgctaagccggaagattggcttagcaagaagctaaaaatcagcacttcataa

SEQ ID NO: 58661 - DNA, 249 bp, Glycine max
  Peptide Sequence Number=SeqID_150346
atggcgaggctcacgggtgcgctttcacggagtcgccaccaacgtttattcgtggaaaacgtcgggaaaaccgaaggaaaccggctgaagatcgatgtagaacgaatgaagaatgtcgaagaacggttgaaaaccttcgcgaaatcactcacgaaaacgttacggaaacgttacggaagcgcctcggcatggattttcttcacaaaaataattttcctaagcaaattcgaaagagagagaagtgcctaa

SEQ ID NO: 58662 - DNA, 607 bp, Glycine max
  Peptide Sequence Number=SeqID_150347
atgggtcagctccaacgtcaagccttccacaagacctatgggaagatatgggacctagctacggtagaagtctccgtgaaagcaatagcatcctttactcagtattatgatcatcccctaaggtgcttcacatttagggacttccagctagtaccgactgtggaagaatttgaagagatattgggatgttcgttgggaggaagaaaatcatatctcttttcagggttctacccctccatggcaagagtagcaaaggtagttaaaatctcgatacaagagttagaccctgtgaagcgaaataggaacggggtagtcagaataccaaggaagcatttggaggaaaaggcaaaggcattggcagataaaggggaatgggcttcatttattgacatcttggcattgttgatatttggtgtcatcctttttccaaatgtggagggattagtggacctagcagcaattgatgccttccttgcttatcaccatagcaaggaaagcccgatcatcgctattttggctgatgtctatgacacgttcgaccgaggatgtgaaaaaaggggacaagaattgtttgttgtacaccggcttctcgatggggtggcttgtg

SEQ ID NO: 58663 - DNA, 843 bp, Glycine max
  Peptide Sequence Number=SeqID_150348
atgggagggcttgctgaatactgtgttgtgccagcaaatagagtctctgtattaccaaactcattgccatatacagagtttgcaattctaggatgtgctatttttactgcttacggcgccatggctcatgcacctcaagtgtgtcctggtgattttgttgctgttattggaagtggaggtgttggttctagttgtttacagatagctaaagcctttggtgcctcagatataattgttatggatgtacgggatgaaaagctacagaaagcaaagacatttggtgctactcacactttcgacccagacatagtcctagaattttatgccaatgcttggcctacacaggagggcgtgcgggatatgcgatcttggggccaagagtgcgagtatggccagaggaggaaccgggccgatgggtttgatgaggaggccatcgcccagttgctgcgtataccgggacaggattttgcccggaccgctgccgggagacgggtgcagatcatgcgcaccaacatgactaccctgactcagacatggatgacgttgctgcttagcaacatccttcccagcgatcataattccgacctccctctgccgaagtgtcagttggtgtatgccatcctgacacgaatgagcgttcatgtggctcagttgatcgctgatgccatttatctatttgcaggtatgccacctaccaggcactggtcgttcggggttcctgtcacacctagtaaggtgattcgactgccgatcacccgggctttcatagagaagtactgcatagctagacaggcacagggtggtgacccacaggccctagacgcatcgccgccacctccttag

SEQ ID NO: 58664 - DNA, 699 bp, Glycine max
  Peptide Sequence Number=SeqID_150349
atggctcgcacaaagcgatataggcagatgacctctacagcggcccaagaaatatcagacaaaattgactctttaaaagaacagatgacgcacagaagctttgttctgcatggtcgtgatgacatattgaacacggctattggccggccagatcatccaggtcgtgtacgtgtggcagggacaagtgtaacaatcagccagtattttggacaagcatctcgtggctcaaacagttcttgtacatcaatcagtcaacaacaattggctcaaatcatcggtaacttgaaggaagagttgagaaaagaagtagaggaagaaaacaaaaacttacaggaagtgtggaggaggacggtagaagaggaaaacaaacacagtttggaaataattaaacaagagttgaagcaagcaataaaattagagttatcccaaattgcatcacaacactcaccgccgcttgaggcacctgatatacaagtgcttgtacgtagttcaggaccagtgtactcaactagtggcattgggaaaaatgtgtatgacagtgcatccaccatacacaatgtccctaatgcagatgatgtggttagggtgagtgttgtcaaagtttaccatggtgacgctgaagtcccttttcctacatcagagattcaatatgacagacaggccgttggcacattcttgggtggtcgacaaatcttgtga

SEQ ID NO: 58665 - DNA, 420 bp, Glycine max
  Peptide Sequence Number=SeqID_150350
atggcaacacccccaaggacccctccacattcagatatgcctttggaggctacatctaggaagactagacaatcgacccatcttagaagtttgactgttcgaggtttggatcagccgcaaccaacggttaacgtcaatcctgcaactgggagaggatcagggccccaaaaagaaaagtttcatagttatttggggggcaaatttgacatccctgaaggtgacaatgccaaaaagaaggtgatgtcaacgatcgctaccagatggaggcaatttaagtcgtccctaatgacaaaatatgtttatgctgacaatgacggtcatcagaatgatgatccttctgttaagtatggtattgatgcagcaacatgggtagaattttcaaaaagccagcaaacccctagctggcagaaaaaggcttaa

SEQ ID NO: 58666 - DNA, 261 bp, Glycine max
  Peptide Sequence Number=SeqID_150351
atgaactatggttggtgctcaagttttcgaaaggattcattttgtctgaagcaagaccaagccttaggtttctgggatcttgtccaaattccggatataaccgatcaattttctcccattgtggagaatcagctggatgtcaaagcaaaccgtcaattattctgccatctgcatgtcatcgaagtttgtagtgtgataccccacatgttgggcaattgtgcatttccgcaaactgatttccgtacaaaatacagtcattag

SEQ ID NO: 58667 - DNA, 570 bp, Glycine max
  Peptide Sequence Number=SeqID_150352
atggacggtttggtggacctagccgtgattgatgctttccttgcatatcaccatagcaaagagagcccggtggtagctatcttggcagacttatttgatacatttgaccgaagagtagattgggaccaacacttgactgggataggaagcagaacaatcaactggtttcctcgatggaaggaaggaaaggagggagttctcttctcatgtggggaaagcctgttaaggaaagataaagaacttaggggcatccgaaatggcatcatcggaggttatcatgaatggctgaaagttcgtacgcgagggttagattggctctccaagttgaaaattatcaacgaggagaacttcgaagctccgaaagaggatgaaaaagtccgagctctaaaaacaaaactaggaaaagcaagacttgccaaagaaaaattcaagttagtcgctacaaatgtctggaaagagtgtgccgagttacgagaagaaaatgcagctaccgcaagagcccttgaacgagaaaccaagaaggctcacaaggaagagcatggccgagacaaattccgtggagctttgtag

SEQ ID NO: 58668 - DNA, 562 bp, Glycine max
  Peptide Sequence Number=SeqID_150353
gtaccccaattactaccacaatggtcatgtttatgccaccatgatcaacatccttggaacatcagggagactcaatgacatgagggatgtgattgagcagatgaaagaggattcatgtgaatgcaaagattctgtttttgtgtctactatcaagacatatgcgaatgtcgggctggataggaatcgagatgtagttgcaccaaaactgaaagagcttcttcaatatgtcgaaggggtgagagttaacggtgaaagatcacttggaaacaatagaagggcacgtttcaatgcattatatcaagttccagaatattgtgacatcgacaaaattaaggggaagtttgatggcaaaactgtcatcattacgattccaacaattccggggaaagtccctaagaaagaaacacaaccaactgaacaagaaccacccaaagaaccatcacaagaagcaaaatcaaatccagaggaagaaaaagaaggtactcctccttcacatgataatcaagaaagtaaagaagaggctggccatgcgacttcaacttcaaacccaccaaatatttga

SEQ ID NO: 58669 - DNA, 513 bp, Glycine max
  Peptide Sequence Number=SeqID_150354
atggttatggcaccaatatctagggcttctactagacaaagagctgatggaaagccctttctagctttgggaggttcatccgatattataagcatatggaatctagaaaagaaaaggctccaattagttgtaagagaggctcacgatagtgtgatcacttcactacattttgttgcaaatgaaccagtgccaatgagttcatcaacagacaactctgttaacataagaactattttgaagttgcacacattgatgtggaatccttgggataagaaagcaaaagctatgtctgatttcggtgatgatgagtataagtacatgctttgtgtagaggctgctgctattgaaaagcctatctctttgaatcttgttgagggatggaatggaagactagaactttcaactgtttcttctagttattgtagtggaaaattgatcccaaaagagttattcaaggaagctgaaagatcatcgttgtgttttgtgtcctgtatatgtattaaatgcacttga

SEQ ID NO: 58670 - DNA, 336 bp, Glycine max
  Peptide Sequence Number=SeqID_150355
atggtggtcattttgcctaaggaaaatattgttgtctggttttgttccttgtataacaggccagacaactaccttaaaggaataattaacaagtcagtgttgtttttcaatacatttgcattaccattactcagcaacatcaatattttaatgttccttgtattcaatagtgctttgaaaggacttgatgatactccacaacctaaatccaaggctggtgctaggtggattgttgttaagtattttaatgatgttagaccattggaagcagagagattcaaggcgcttcgcatccagtggacacagtattatctgaaacttagagatcaaacttag

SEQ ID NO: 58671 - DNA, 1674 bp, Glycine max
  Peptide Sequence Number=SeqID_150356
atggaaaaccaattctttctcaatgctggtgtgccccctcagctgcattttgagccttcaccacacggtcaccaaccttgtccaccaccctcttggcaatcatcactgtcttctgccatggatgttcaagtcaccgttttgaattgttcaactgagcagacccaggattgcttctacaacaccaccccaacatgggacaagtcaacggatcatggccttcagtttgattcagctctgagttcaatggtgtcctctcctgcagcctccaattccaacatatcaagtgagaattttgtcatcagggaattgataggaaaattgggaaacattggtggtggtggtggttcagatgagatctcacctcattctcagcctttggttggtgcatctttctacatcaattgcaataataatagcaccaacacttcatgttatagcacccctttgagttctcctccaaaggtgaacacgatcaagatccccacaatggtgaaccacttggtgaaggagggcatgcccccaagtttggagacaccaatgtccttgaattccactgtggctaaattctcagctgatcctggctttgctgagagggctgcaaagttttcatgctttggaagtcggagtttgaatggcaggaccacccaattgggactcaacaatgctgaattggctcagagatcttcattggtggaaaatgggaagcggctccctagagtctcaagtagtccatcactcaaagtgcttgaatctcaaatgggtactcaggagaacaaaaattctccattgcaagacctaatggaattggccaattctcaagaggaatccacaatctctgaacagaccccaaatggggacactggggtgaagccttccccttatgtgaattctaggaaaagaaaaggtccatccaaaggaaaagccaaagaaacttcagcctctattaacccccctatggctgctgaagctagtgaagactggaatgcgaaacgcagcaagcctaatgccggtgaggggaatgaaaatggccaagttaaggcagaggaagagtccaaagggggtaatagtaatgcaaatgatgagaaacagaacaagagtaactcaaaacctcctgaacctccaaaggattacattcatgttagagcaagaagaggtcaagccactgatagtcatagtcttgcagaaagagttcggagggagaaaatcagtgaaagaatgaagcttctccaagatcttgtcccaggttgcaataaggtcacgggtaaagcactaatgcttgatgaaattataaactatgttcagtcattgcagcgccaagttgagtttctgtctatgaagttggcttctgttaacaccaggctggattttagtattgagagtctaatctcaaaagatatatttcaatcaaataattctttggcacacccaatattcctgatagattcctcagcaccacccttttatgggcaacaccctcagccaaacccagcagtccacaataacattcctaatggaactatgacccacaactcagtggacccattagatactggtttgtgccaaaaccttggcatgcatttaccacacctaaatgattttaatgaaggtggttctcaggctcaaatcaagtacccctatgaaaatcaagctctgatcaccattcattacggctga

SEQ ID NO: 58672 - DNA, 165 bp, Glycine max
  Peptide Sequence Number=SeqID_150357
atgggtgctactactagttacgataattacttgaatttggtggggaagtttccttctatagagaaagattgggatttgcaacttctgcctattacctctgttaagcctctttctgaatcctatcaccgtcccaggtccaggataagccttgttaatttgaattaa

SEQ ID NO: 58673 - DNA, 634 bp, Glycine max
  Peptide Sequence Number=SeqID_150358
atgccgagaaggtctcctagaagggtgaaaacctcaaaaatgtgtttgtgtggtttgaagaaaggagtgagtggcaacccttgtcctcgatttttgaccttgtctactcctgatgttgatgagtttgaaagatggcaaaaggagattgaagaggtagacatacaagtggaaggttcggaatttggatccttatctggcaatgttggtcgtactggggataaacttgcactgaatgtgaccactaaacaaggaaagacattaaaggatgtacaaggagatgtattccatgaggtggtggaacatgcttgtgggatggaaactctacaaatgggagaatatttttccaatgtatcaagtggaattgatacttacaacattagagagccacttggtgtatgtgctggtgcttctgtaatgcttgcagaattggcaatggaagctggtttgcctaatggtgtcttaaatatagttcatggaacccatgctaatatgggggccaaaaatcatgtggttgtaatgcctaatgcaagtggcaatgctactgtaaatgctttagttgctgcaagttttggtgctgctggtcaaaggtgcatggctctcagcagtgttgttttgttgggggctcaaaactatg

SEQ ID NO: 58674 - DNA, 234 bp, Glycine max
  Peptide Sequence Number=SeqID_150359
atggccaaccattctacatctcttattaatggcattcccatcaacgaggcatctaaccttgggtggcagcaggctcaaggtattgatggctccagagttcagaaggtgttggaatcagttcacattgcagctaacaaaaacacagttccaggagatgtgttatctatggttcctggtggtatcagaatgggaactcctgctcttacttctagtggatttcagaaactaacttaa

SEQ ID NO: 58675 - DNA, 303 bp, Glycine max
  Peptide Sequence Number=SeqID_150360
atgaaattggatttcaagtctgtcaaccaaactggtcatttacttgaagagccatgtggttatgacttcccaagttcagtccattttagaggtttgctatttatgtcccaagttctaacttcccagtttttttatgtgcttgtagtacaagagagacattgttctccagcaactcttggtctttggaagataccaaccggattcattcttcaggcagaggagatatatacagcatctgtaagagcagtgaaggaggaaactgggatcgatacagatttgattcaagtgatagcattcaggtaa

SEQ ID NO: 58676 - DNA, 237 bp, Glycine max
  Peptide Sequence Number=SeqID_150361
atgaagctaagtccaaaaattcatttgttgcacctaaagtgtcaaggagttggacatattacttttcaatgtccaaataaaatagccatgatattgttggataatggagacatagagagtgagagctcaagtgatgatgaaatgccaccattggaggattgcaatgatgttgatatcgctgaacctgtaaatggagatgtacttgttactaagcatgctcttaacatgcaaccctag

SEQ ID NO: 58677 - DNA, 318 bp, Glycine max
  Peptide Sequence Number=SeqID_150362
atgggtgccaagtacctcgaagcggttaagcaaagggaatatgaaagaaggcgcagaagattcaaaaaatacaatggctgcccccacttactgtctcgtgggggttatgatcttcttgacaaaaaacttatggacgagaagaggaagcatcaagaacatctagctgagtttattgaaaatccatcactcggcatcgaccctccatcccccgtgtcgagacatctcaagtggaagatggcccgcacaaagccttatgggcaaatgacctctgcagcagcacaacaaatatcagacgaaattgattctttagaggaatag

SEQ ID NO: 58678 - DNA, 360 bp, Glycine max
  Peptide Sequence Number=SeqID_150363
atgagtcagcaagcaccatggttgagggttcttggtaatgttggatttaagttaccaggacttgccttgtcacccttaaccatgtttgtctattttagtcaattccctgaagactctgagataccaagacctaaatatgagactgaatgggtcactgtggaaaccttagtgttggctcttttctcagacaaggcctcgatgcttattgttgttcatcaaaagagcaaaaaggcatgcaggatttttccaggtgaagaaatgacagttgctaaaggctacttgagcataattgaatctttgctttctgtgctaccacctggtttggttcagttgggaagaaaagtcacaacaattgaatga

SEQ ID NO: 58679 - DNA, 306 bp, Glycine max
  Peptide Sequence Number=SeqID_150364
atggggtgtagcaaacaaatgctcacctccgccataggatggcccaaaatctaccctaaggctgatgagaaccctagagccttctcctgcatccctggccaaatcttcctggagtctcctagtcatggctctggtgatgggtcccctccttgggaggattgcattaggtctccttttctctatggtgagccaaccacactgcttcctcttatgtttctcaaaagcagatctggtgttgtagatttcatttttctagaggctaggaatccaaatgaaccaatatgttgtgtggggtgtcaaagttaa

SEQ ID NO: 58680 - DNA, 294 bp, Glycine max
  Peptide Sequence Number=SeqID_150365
atgaatcaagatttattcaaagatgttttgatgataacaaagatgataacaaaagatgatgacaaaggtgatgacaaaaagctcaaaggtcaatcaaagaatgagttcaaaatgttcaagatagaatcaagaacacttcaagattcaagaggaaagttgaattcaagaatcaagaataaaggttcaaggatcaagcttcaaagatcaagatcaagattcaagattcaagatttaagattcaagagaagacttaatcaagataagtatgaaaaggttttttcaaaaactgagtag

SEQ ID NO: 58681 - DNA, 288 bp, Glycine max
  Peptide Sequence Number=SeqID_150366
atggccaacatttaccaaaaatacgcttggctgacattagccgaaaaatatcttaggccgacatcaaccgagaaaaacatagtcgatggtacatctacttgggttgttgtgactgagaacaagagaaggtacatctcttatggatcagttctagtggaggatacatccactaggttgttcaaagagaacaagggagggtacatcccttgtggatctttgcttgtaaaggattttacaaggttgaaaagaaatctcaaggatcacaagtcgcttggggactggatgtag

SEQ ID NO: 58682 - DNA, 753 bp, Glycine max
  Peptide Sequence Number=SeqID_150367
gggtgaagacccctgtggttctatctggaaatcgcgatgaacgcgctaagtgtacctgtgtgcttagcctgttcattgcaactgtcaaaattttggatttccagatgaacataagtgatgatcccgctaagcgtgtctcgctaagcctgacatgtcaggctaagcgccactttgcttctgtaagttttcctttgaataaggctaagcgcgctaagcgcgccctgtgcactaagcctgagtgttattctgttgaggctgagctaagtgcgccatgctggggcttgggagaggtatacagacattgtggtgcctcgaaagctactaccagagaggaatgtggcattgctattgtgaaggaattttatgcgaacctcgatgactccgaggataaatcacctaagcaggagttggctgctaagctctgtatcccagggaggggattcgagcttaatgctgatgggcagcctttgaagatactgaggaagaacatgacaactctagctcagacatggagcgttctttccttttctaacctcattcctacctcccacacttctgatatcacatttgacagggccaggttgatttatggaatcattcagaagatggatatgaaccagggctatattatttcagctcaagtttctctgatcgcccagcatgactcttctaggcttgggtttccagccttaatcactgctttgtgcaaggccaggggagtcatttctgattcattgacattggagaccctcg

SEQ ID NO: 58683 - DNA, 693 bp, Glycine max
  Peptide Sequence Number=SeqID_150368
atggcttccgcttcttccagttcaattcctcaatcatttcccaactttgtggctgaaaaacttgatgatttcaactatcttcattggcgtcaacacgttgaaccggtttgggataaaattcatgagcattttagcctacacacgaaaactcgagcaccacagctccacactgccatgagagcagttactcttgacgggtttgtgaatgaacttgctagtgttggtgtacctgttcatcacaaggaatacgttgaagcgctacttgaaggattgccgtcagattacgcgtcggtggtttctgttatcgaaagcaaaaagcgaactccgtccatcgcagagattgaagcattgctctacagacatgaaactcgactcatgcgctacaacaaagaagcacaggtgatgaactctgcttcgataaactacatgcaaacgcctataaaactggtgattctagtggttctcgcgcctatctcatactctactggttcagtcagaacctcaaacacctgggttaatccgaattctaagaatcctaatccaaatcatagtcaacctagggccatgctcactagttcaacctctcaagggaatgagctagctggtaccacctggataggaagatgggggttccattgctggagaagtacccaagactgtactgcatttctcaacaacttattcagcagctag

SEQ ID NO: 58684 - DNA, 627 bp, Glycine max
  Peptide Sequence Number=SeqID_150369
gttgagggtcaaactgaggaagtgatctttgatcacctacacgccaccgcattccagtacactcctcttggaagaaccattcttggacctgctcagaacattaagacaatcaccaaagcccatttgcagagctacattcagacacattatgcggctcctaggatggtgatagctgcatctggagctgtcaagcatgaagacattgttgaacaagtgaaaaagttgtttaccaagttgtcaacagatcccactaccacatctcaattagttgctaaagagccagctatttttactggttctgaggttagaatgcttgatgatgatattcccctagcacaatatgctgtggcttttgaaggggcatcttggaaggatcccgattcaattcctctcatggtcatgcaagctattttgggttcttggaataagacagcaggaggtggaaaacacatgggttcggagttagcacagcgaattggcattaatgaagttgctgagagcattatggctttcaacaccaattacaaggacacgggtctttttggtgtttatgctgttgccaagcaaataaatcagtacaagtatatacatcctagagtcattttgtgcagagctatggtgtcctaa

SEQ ID NO: 58685 - DNA, 225 bp, Glycine max
  Peptide Sequence Number=SeqID_150370
atgtctataactctagataatgtcattttagtaagtaaaggtcaagctgttgtagaagcaagtttcatgatgatgaaccaagcaattttgatgatgccaaaagcccaagtgattgattcaagattggttcaagacttcaagatcaagcatcaagaatccaatccaagattcaagattcaagagaagaaatcaagaagcaacaagtcaagacttcatataggataa

SEQ ID NO: 58686 - DNA, 231 bp, Glycine max
  Peptide Sequence Number=SeqID_150371
atggcagcggaatggagaaggaagagagagaggagacaccacttcaaggagaagatgagtctagaagaagctcaccaccataggaggccatggataagagcttggaggaagaaggagatgaatgaagggagagggagagaagagcacgaaattttgtgctctaagagagctctgaactttgaacccactaatccaagatcaattccaagattctccactaagtgtgcttag

SEQ ID NO: 58687 - DNA, 921 bp, Glycine max
  Peptide Sequence Number=SeqID_150372
atggaaattggtacacataagctcaaggtcaagggcccaataagcacgagcggtccccatgtggtgcaaaataagaattcttgcccaccgtgcggcttacctcccaactatacaccacccaatgcagtgcacgtgcccaataagaatgccaaccactccattccccttaagggccagcaaccccagttggggcatgcaccctttgctcagcttgtgggggatgcccgtgaagagccccgatatcatgctctgggtgagttcgaaccataccctacttatgctactgagggaccaacatttagtggcatgcctcagcccaatgccgtgggagctccacagcatcacccgcaacaacctttgcatttctcggtagggagactacctccggccatggaagaaagagagaagttggatctcatagaagaaaggctgagggccattgagggggtcggtgattatccatttgctgacatggcggagctatgcttagtgcccaacatcgtcatccctcccaaattcaaagtgtcggacttcgacaagattgaggtaggcttgagaaggggaaagttcgattatgccgcttcagcaagtataaccaataggaggtctggaacaggtgcagccaagacgaagaagggagacacccatgtcgtgacttcagcacccacatggcctaaatcccaacaaacccttcacaactccacctaccaatattccccgcatcaaccaaattattcggccaacatcggaaaccctcccaatccgacacctgtccaacaaagattgctcgctcaaccccaaaggccttccccaaaaaattgtttcccgcacaatctcgacccactgggaacaccaatcccaacacaagcaccaacccgaggaggaattttccagaaagaaaaccctcggaattcaccctaa

SEQ ID NO: 58688 - DNA, 192 bp, Glycine max
  Peptide Sequence Number=SeqID_150373
atggagttccagcagaagataaaggagaagagcatattccctttaaatgtcacaagaatgaaaagtatgactctagcacatgggaaaagaatatgccacaagaatatgtcaaaggaatattccaagaatatgcgaaaggaatatttcaagaatatgccaaaggaaggaaaactacacacacctctccagtaa

SEQ ID NO: 58689 - DNA, 183 bp, Glycine max
  Peptide Sequence Number=SeqID_150374
atgtctcagaacttcacgtattgtgcaaccaagggtgccaagtacctcgaagcggtcaaacaaagaaagccatatcaattgtacttcatcaaaaggatctacttcagtatggatcctttcttagctaacatcagaatcaccattctgatgtatctttggaatgctcatcagaaaggttcctaa

SEQ ID NO: 58690 - DNA, 549 bp, Glycine max
  Peptide Sequence Number=SeqID_150375
atgaggacttgcattgcatgggaaccaataatcttccaagacggatgcatgagatggatgaactataaaagaaaatggttgaagcaaagagttcacaaaatttacaaagcacccaagattctaccaattggacaaatgatatatattcaaaagtcaaaggacctgaaaaaaagaggacgtgtgcgttgtcttggcaagcttccacatcaagcaagttcatctcaatgctcttatgcaaacaatagaattcaaaagttagagaatttgcttgaaaaccttgtagatgtgcttaaagtgcgatttgcagaagatccacaaattaatcaagtcttagaagcaatagatcaagaggaacatgatttaaatggtataagtcattttccttgtatggaagaggccattcatgagagatttaattacaataagcctgacactacaatgtcaaagttggatgtgtcttttgcaaagatgaagatagaggatattgttaagtctattgctgcgtcgagtcagaaccaacttgcatccaactcactagttgatgattaa

SEQ ID NO: 58691 - DNA, 165 bp, Glycine max
  Peptide Sequence Number=SeqID_150376
atgggcttaaaggagaactcaaacccggtgaccctcaaggcttacactctgaagagtccgtcagggcctctccctcctgattcaggtccaacccctaaaataatttttcatgcagatactgctcatgaattatacaatacccccgacctcacactcgtgttttaa

SEQ ID NO: 58692 - DNA, 204 bp, Glycine max
  Peptide Sequence Number=SeqID_150377
atgtcattgcctagcgctgttcatgtgtcctccaccttcgagtctggagccccgcgaatgtcattgcctagcgctgttcgccaattctccattctccactttttttcggagacccatgaatgtcattgcctagcgctgttcatgtgtcctccacccaaagagtttggagctatgcttcatgattgccttgtgtggaccctctag

SEQ ID NO: 58693 - DNA, 156 bp, Glycine max
  Peptide Sequence Number=SeqID_150378
atgggttgtcatcatcaaaaagggggagattgtggaatcaatgccttcaaaggtgattttgatgatgccaaagaattcaagaatcaagagaaagattcaagagaagtttcaaatttccaagaatcaagaatcaagaataatcaaatacaagattaa

SEQ ID NO: 58694 - DNA, 827 bp, Glycine max
  Peptide Sequence Number=SeqID_150379
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataaccgacatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58695 - DNA, 935 bp, Glycine max
  Peptide Sequence Number=SeqID_150380
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattttacaggactaagcattaaacaatgccttatgttcggagataagttaagtagagatgatgctttccaaaaccattacaaggctaatgtaggggaaaatgtagaggactatgcagaacgaatagctacaatgctatcagatgcttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58696 - DNA, 180 bp, Glycine max
  Peptide Sequence Number=SeqID_150381
atggatgattacataatccgtaaggttccgcaacattacggaaagaaaacaagtatcgttacgaaattcgatgttcctccaaaaggcggttgcttctggaggaagcaacctagctcacctgggcgagctgagctcgcctgggcgagttgggtggcaagcatctccttccttttcctataa

SEQ ID NO: 58697 - DNA, 483 bp, Glycine max
  Peptide Sequence Number=SeqID_150382
atgaaggaggacttgaagaaattcagagatatgaacaaatatggcaccaactcccaagataatgtagtaaaaagtgttaaagatgaagatgatgtgtttttggcaacaaatgatgaggttgctaaaacaaaatgggtgatggattctgctgcctcaaagcacatttgcaaagatcgagagatgtttgatactttgaaaatcgttggagaattcggtcattacaagttagggaatggtggaaaagggaaggttgaaggcataaggagtgtgaagatgaatctctatgatggtgctattcgaactttctcaaatgtaagggtacaagtatgttggttcaaagtggggatgaaaggtgtacaaggggagacacttggtgttaggaaccatgatagcaaagtgaagaagaaagtgaagttttctaatgttgtggaagtgttgggagatacttccgttggagggagagtttgttcactttcaaattga

SEQ ID NO: 58698 - DNA, 387 bp, Glycine max
  Peptide Sequence Number=SeqID_150383
atgatgagaatcatgaaactggccaaatacaggctaaaggcccaagtggagaaggacgaaggcctaagtggagaaggacaaagcccccgagtggagaaggatgaaggcccaagtaatccttgtggcgtctacccagacttatcttccttcaccggaagtggcgtctacccagacttatcttccttcaccggaagtggcgtctaccctaacttatcttccttaaccggaagtggcgtctaccctgacttatcttccttcactggaagtggcgtctacccagacttatctttcttcactggaagtggcgtctaccatgacttatcttccttcactggaagtggcgtcatccaaaccttcgtagcctgtatcaaacgatccgccccgtaa

SEQ ID NO: 58699 - DNA, 732 bp, Glycine max
  Peptide Sequence Number=SeqID_150384
atggggaatcaacctagaggtaatttcaatacaagtggatttccaggacttcagaacaaccagcagtatcaacaacagagacaatggcaaaatcaccctggtaaccaattcaacagagaccagggtggttcatctacaaggccacaacaacagatgccaagtctctataaccgaaatctagctcaattcatgcaagtgtcaatgtctaaccaaaagagaattgagagtgtaattaagaatctggaagtccaggtggtccagcttgcaaagcaattagctaaaagaccatcaaatagctttagagcaaacacagagaaaaatcctaaagaagagtgcaaagctgtgatgactaggagcaaaatggtgattcaagcggaggaaagtagagctgataagaaggtggagggatttaaacaacaactggctgatgaactggcattagaaccggttgatgatttagttgaacttgaagaaattattgaggaagcagaaggtgatgaagaaggagagacaccaataagagactgtcaagagagaataaagaagaaggaagaaaaagaaaaagaagaagaaataaaagaagaagaagaagaaaaagtaaaaaagttgaaaattgaaaaacaaaaagaaaaggttgttgagtttgaaaagaaggaaggcaagagtgaggctaacattgaaaagaagaaagaggctacttctattgaatgcaaggaggaaccttatccattg

SEQ ID NO: 58700 - DNA, 153 bp, Glycine max
  Peptide Sequence Number=SeqID_150385
atgggtgaagtagaggaggtacaagagcaaatgaaggccgacatggaggccatgaaagagaaaatggccacaatgatggtggccatgatgagcatgaagaagataatggaaaccaatgcgattgcagttgccgctaccagcgcagttgctaag

SEQ ID NO: 58701 - DNA, 222 bp, Glycine max
  Peptide Sequence Number=SeqID_150386
atgaggcatgtaaagcatgaaggacatgcacaaagattgcatcatagtgctcctagtttttcatacttgtcgcaacctacccttttgcgggtgagcgaggctcggctcacgggtgcgtcttccataggaggaaaatgcgcggagtcgccaccaacgtttattgaaaggaaaacgttagaaaaaccaaaggaaaccggtcatgaagaatattccagattctag

SEQ ID NO: 58702 - DNA, 131 bp, Glycine max
  Peptide Sequence Number=SeqID_150387
atggaggagttgattaacaaaacacaactatctcccaaaataattccaacgtcatcacatcggctcggcggctccacatcagaatctcacttcctccaccctactgttgtcattctgctcccgcaaacaag

SEQ ID NO: 58703 - DNA, 414 bp, Glycine max
  Peptide Sequence Number=SeqID_150388
atggataatgaagagggcgtgcaagaacagatgaaggccgacctatcggccttaaaagatcaaatggcttctatcacggaggccatgctaaaacttcagaaaactatagaagataatgccatggcggccgcctccaatacagctagggaagcggaaccagtgctacagcttggaataaacttgggccgagacagaaacacgacggtgttaggtcggaggtatagtcctcaagcctacccttatggtttgcctctggacttcactccccgtaccactccgaaagatttgagccaagcccctacctttgaggggcaactccctccttatgccgactatcccctgcaagaagatgatgaagaagatgcccatttaggccctctacttcccctcaaagatccgcccccccatgaatag

SEQ ID NO: 58704 - DNA, 1081 bp, Glycine max
  Peptide Sequence Number=SeqID_150389
tgttaatggtgagggttctactcctaaggaccccttgtataagatattagatgagttgagatcccttaagttatggaaagaaaaacaagagagaaaagaaaaaggaaaaaaaagagtagaagaaataagtcaagatgaaaaggagaaaataaaggaagaagaaataaggaaaatactaaaagagttaagaaaagaaaaacatgcctcctatagtagtcataactcttgcaagagcctaagtgaagaactttgtgactattatgaaggaaggcatagggcacatcctagacctcacttccatgggagagaaaaggaaagaaagcctgacgtggctaacattaacctcctcctatacttcaatgggaaggacaatgtagaggctaacttagattgggaaataagggtagagcaacaacttaaaaggaagtctacttcaaaatcttatggctctcactcttatccaaagaaagaccaaggtcaaggcatcttagtggtgacaccttctaagcccaaagatgataaggggaagacaatagaaaatcaaccccttaaggctagtatgcaagaaaagactagctccataaagtgctttaaatgtcttggaagagggcacattacttctcaatgccccaccaagaaaaccatgattatgaggggccaagacatttatagtagccaagatgaggctactactccaccttcccctagtgaaagtgaagaagcaaaaggggaagaatctagtaaagagatctacccccaagaagaaggacaacctttaacggttaaggaggagtgtaaggaggtaagtgtctcctccaagaggttagctaaggaggaaagacattttgaaataaagacaaatattaaagaaatttcccctcttagacaacctccacattttctcctttgtaaaaagacacttgctagcattgccacacctcttaggcttgagtttattcctcaagtaaaggagttgttggatgagggtttggttcaccagagcttaaatccttgtgctttgttggtgcccaaaataggtattattaggcaccaaatccctatgatcggtggtatgatgaat

SEQ ID NO: 58705 - DNA, 594 bp, Glycine max
  Peptide Sequence Number=SeqID_150390
acattcatagagatacccctattttaccatgaacaatgggcacccaattacccacacgaagttcggttcaaatacaatggagcaacctacccaatacggatccaacaacaccgaggcagatatttttttgcagatggactctcagacgtcagggcagatttaaaaatctacgagtctattatcatcaacttctttgcctacgatgataacaccatctttgatctacattttacacctcccctgaatcaacaaacatgtggtagaccaatacttcattcccgtgtacatgcccggagaactgaaattacccaatgtatacgggatgctccccaaccaccggaaatcccatcacatgcaaggaaatatctgaaacaatgtgagaatcacttgacaattttaaggaagaatgcacctcctctgcaatgggacgtcgttacacttgaccacgacattaaagataaaagtatcgtccggccatggtacaagtttctcagggaaaacaatttccatcacggagacgaggtatcattctattaccagccacatgaaagaatttgggaaatagtcctcagaagagaacggaagtggctataa

SEQ ID NO: 58706 - DNA, 327 bp, Glycine max
  Peptide Sequence Number=SeqID_150391
gtgaaagttggaacctcttacgttccgatcaacgtctcattttcgccaaaagttggcccagggcttcccggtatcaacagggacaccaggatttatttcttctgcgaagtgatcttccgtcacaggcatatgtttttatcagctgtccctcctgttcagttactgacggggtggtgggtaacggcaaaagcaccgccggacatcagcgctggcaagtgtagcggtcacgggcgcgttccattcgccattcaggatgagcaacggttgggaagggcgatcggtgcgggcctcttcgctattacgccagctggcgaaagggggatgtga

SEQ ID NO: 58707 - DNA, 173 bp, Glycine max
  Peptide Sequence Number=SeqID_150392
atggagacagggggagcaggagcagaaagctgcagtaagcatggagacagggggagcaggagcagaaagctgatgatccacgatgtcggatacaatgtccaggacatcctgcccgaaaatactggagttgctaaaagcattgaagctgcaggatccacgatgtcggatacgat

SEQ ID NO: 58708 - DNA, 306 bp, Glycine max
  Peptide Sequence Number=SeqID_150393
atgaattcgtggggctctagtctcgatggtggaggatgcatgaatgacaatcaattcatggggctcgggataagatttgaggttggaggatggatgaacagcgctaggcaatcaatttatggggctcgagactcgatggaacaacgcttggcaatcaattcgtggggctccaaactcggtggtggaggatgcatgaatgataatcaattcatggggctcgggctaagatttttgggtggaggatacacgaacattgctaggcaatcaattcgtggggctccagactcgatggtggaggatgcatga

SEQ ID NO: 58709 - DNA, 1045 bp, Glycine max
  Peptide Sequence Number=SeqID_150394
atggctgcacctgatttcacctacgaaagcttatgcatccaataccctgatgaggatgtcccatatgttcttaaaactggactgattcatttgcttccaaagtttcatggccttgcaggtgaagacccgcacaaacatttgaaggcttttcctcattcattagagggagtggcaaaggactggctgtattaccttgctccaaggtccatcacgagctgggatgaccttaagagagtattcttagaaaacattttccctgcttccaggaccacaaccatcaggaaagatatctcgggactcagtaatatggagagaagtatgatagatgctgccagtggtggagcccttggagacatgactcctgctaaagccaggaatttaattgagaagatggcttccaactcccatcagtttagcgccagaaatgatgttatagtcattagaggagtgcatgagacctctcaacctcagcagcaaaatcaaccacagcagaacaattatgacctctccagcaacagatacaaccctggatggtggaatcaccctaatctcagatggtccagccctcagcaacaacaacagcaacctgctccttccttccaaaatgctgctggcccaagcagaccatacattcctccaccaatccaacaacagcaacaaccccagaaacagccaacagttgaggcccctacacaaccttccctcgaagaacttgtgaggcaaatgactatgcaaaacatgcagtttcaacaagagaccagagcatccattcagagcttgactaatcagatgggacaattagctacacaattgaatcaacaacagtcccagaattctgacaagctaccttctcaagctatccaaaatcccaaaaatgtcagtgccatttcattgcggtcgggaaagcagtgtcagtgtcaaggacctcaacccgtagcaccttcctcatctgcaaatgaacctgccaaacttcactctactccagaaaaaggtgatgacaaaaatttacctaacaatttctgtgcaggtgaatcttcttccacag

SEQ ID NO: 58710 - DNA, 644 bp, Glycine max
  Peptide Sequence Number=SeqID_150395
atgggtgatcaagaggggacgcaggaacagatgaaagccgacatgtcggctctgaaagaacaaatggcctccatgatggaggccatgttaggtatgaaacagctcatggagaagaacgcggccaccgccgccgctgtcagttcggctgccgaagcagacccgactcccttggcaactacgcaccatcctccctcaaacatagtaggacggggaagggacacactgggacacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcgaagggatgtcgagttctatcccccgatccccgaagggccggcaccaggcacattgcctcaacccaacatcgcagcactgccaatagttttgtctatggaagggccgcccccggcaactgaagaaaggaggaagctcgatctccttgaggaaagattgagggctatggaaggatttggggactatccgtttgcagacatgacggatctttgcttagtacccgatgttgttattcccccgaa

SEQ ID NO: 58711 - DNA, 198 bp, Glycine max
  Peptide Sequence Number=SeqID_150396
atgagctcaaaaatctaccctgaggttcatgagaaccctagggacttcttcagcaactctagcccaatcctcttggagcctcttgctcatggctctagtgactggtcccttcctaggaaggattgcatcaaaaagggagggcaaaaggctcgcctgggcgagcaaggttacttcaggttgaagcaacagctggcttgg

SEQ ID NO: 58712 - DNA, 520 bp, Glycine max
  Peptide Sequence Number=SeqID_150397
atgaggtgttggatatacgagcacttttcgtcaattgcggagtgcaatgctgatccgaactacgacgaggtgtcaccacgtgcgtgttggtggattgcgacaaagaagattgtggagaagacacactactcagaccatctggtggcagcaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 58713 - DNA, 291 bp, Glycine max
  Peptide Sequence Number=SeqID_150398
atggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaagtcagctgtgggaaatcaaagtacctcctagagccctatcctttgcttggagactactttgggataggttaccgactaaggaaaacttaa

SEQ ID NO: 58714 - DNA, 352 bp, Glycine max
  Peptide Sequence Number=SeqID_150399
tggtcatgttggtgcgcatgatcccactcgtctcttcgcagcggcacgggtgaaatcttgccccggtatgcatagtagctgcatgatagcctccctctctggttgtgctcacacagttggtcgccctccaatatcagggggggcccaggaacccacactgaaaatgaggacacgtagccctctaaaggtgagggcgtgcagccctctcaaggcgaggatgtgtagtcctctggaggtgagggcgtgcagccctctgatggcaaggacgtgtagtcctctcaaggtgagggcgtgcagccctccgttgacgaggacgtgcagttctctgatggcgagggcgtgtagcccttag

SEQ ID NO: 58715 - DNA, 246 bp, Glycine max
  Peptide Sequence Number=SeqID_150400
atggaggttgaggaaccttggttggggttatggctaccattgaattatcgagtggatatgggatcaagtttagcatatgacaacgaaatttggggtgaaccctacaggctttttgctgcaaaattcctttttgttggtgttttttggaaacttggccgtataggaatggcagtcacagcatgggtttctccctctttctcaccctcttcatttgccccagttttctcagtcgtcgtagtaggatga

SEQ ID NO: 58716 - DNA, 129 bp, Glycine max
  Peptide Sequence Number=SeqID_150401
atggcagatggacctagatcaaatgtaatgaaaggtctgcaggagattctcgagtattacgagatgcattacgtcgtcaaaacaaacttgaaattccaactggatttaccaatggtctggggtttttag

SEQ ID NO: 58717 - DNA, 267 bp, Glycine max
  Peptide Sequence Number=SeqID_150402
atgacaagcagtaagaggtttgtggaggcggaggatgaggatagtgttgtatccaagaagaaagctgctgaaaagaaaggtactgatgaaaagaaaaatgatatgagagaaaaagaaaaagaagtagaaaaagaaaaagaaaaagaaaaaggaaaaaatgaaaaagatgaaaaaaataagaatgaagagaggagtagaagtgaacaagctagagaaaagaaaagagaaaaagttgtgaatgaaggtgcggaagtaccatatcctgtg

SEQ ID NO: 58718 - DNA, 69 bp, Glycine max
  Peptide Sequence Number=SeqID_150403
atgccggtgtcggccgaaacacaacattcgattgcgctcgaacgaaaaaacctagccgatcctagcatt

SEQ ID NO: 58719 - DNA, 980 bp, Glycine max
  Peptide Sequence Number=SeqID_150404
gatgtgcgcatgaaggcacaggccatccagaagcagaatactgcccccaacgttttgtctcgtaggggttatgattatttggagcagaagctcctggctgagaagacgaagaagaagttggaggaagttgcacagtcaagaagcgttgatggcatcatcgaccctccatccccggtcagatgccacgtgaaatggaagatggcccgcacaaagaagacaggggagatgacgactgaggtcgtaaaggaaattgctgagaagattgactcgtttgaggagcaggccacacagggatcgttcgtcccccatggacgtcaggatgttctcgccgctgctattggacgtctagagcaccctggacgtgtccgtgctgctggagccggtgtcaccatcaagcaatactttggatcggctccacaaacgtcccgcagcgcttcctccctgcctcctgacgaattgcagcagctgacccagcagatcagggaccagctagaggagtccatcacagagaaagtgacgaggcaggtcatggcatccttcaacaagcttcagtcgcagatgcaatctcagggacttgcagttctcctgagcctctggtgcggcttgtacatagaagcagatcctgcccgcctggttgccatggggagaatgcagatgctcccagttcctgtacccactgatgaggtttccttagtggggcaggcacttcacaccttccctgcttggccgacacatctggtcaagtctttatcacaacaggtagttgtgtctccggcaaaaccacctccgaagcccgatccggagatcgattatccgctttatttgatgacattgaccatcccagagtttttcttgaggccttatcaggttagatgggatgccaatgtgttcggggtatttaatccagatttccccctctacataaagcacgaagatctctccgaaatcgcacagggtggtcaatgtctcagcatatcagg

SEQ ID NO: 58720 - DNA, 543 bp, Glycine max
  Peptide Sequence Number=SeqID_150405
atgtttgggtatcctccacatgagaaaaggactccttcctttccttccttccatcgggggaaccaattgattgttctacctcctatcccggccaaaagctggtcccaatctattcttctcttttcagtacacgagcgatggctcaggagcggacatggatgccttgtgtcttgttggaacaagtgcgaaaccaaccaaacacagagggcgggcaagcaacagatgatccgtgcgctactcttttcgcaccttcggtcaaatgtgtcaaataaatctgccaagacagctaccaccggactttccttgctatggtggtacctccgtggtaggcccgctatgccgttccgagtctgttttatgcggtccaaacctcttgctgaatccttgaccacagttgcaattctgctcaaagaggggagacacccggaggaaaggtatggttttcttcccccgagaggacatcctataatttcctcaaattcttcaatggttggtaccaattggaagtctccgaacgtgaagcatctcaaaagctggtcgtag

SEQ ID NO: 58721 - DNA, 722 bp, Glycine max
  Peptide Sequence Number=SeqID_150406
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcaataggaggtctgcaaatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58722 - DNA, 485 bp, Glycine max
  Peptide Sequence Number=SeqID_150407
atggtgaaatggaatcttaccacgctcaatcatttcccaaaatgcccaggttcccggtcaacatcgggatcaccaggcttatttttgcgaagtgatccgtcacaggtgctccatggcttcatgtttctatcagctgtccctcctgttcagctactgacggggtggtgccgtacaattcggcacacaagcataccgagccggacatcagcgctggcaagtgtagcgggtgcgacgctgcgcggcgcgctttccattcgggaaaccatgtcaggctgcgcaactgttaagaggccaagggcgatcgagtgcgggcctcttcgcgtattaccagggcgcaaagggcggatgtgtgcatactggcgattactagttggcactgataacgccagggttttcccagtcgaagtgcgttgtgaaaaaagcgacggccatggcccttacaacggggcaggaattcctggagatccagaagaaccttactacag

SEQ ID NO: 58723 - DNA, 411 bp, Glycine max
  Peptide Sequence Number=SeqID_150408
atgttttccaagaaggagggaatgatgagaatcatgaaactggccaaatacaggctaaaggcccaagtggagaagaacgaaggcccaagtggagaaggacaaagcccccgagtggagaaggatgaaggcccaagtaatccttgtggcgtctacccagacttatcttccttcattggaagtggcgtctacccagacttatcttccttaaccggaagtggcgtctacccagacttatcttccttcaccggaagtggcgtctaccctgacttatcttccttcaccggaagtggcgtcatccaaaaactctacagcctgtataaagtgatccgccccgtaaggttcacattccttcaccggaagtggcgtctacccagacttatcttccttcattggaagtggcgtctaccctga

SEQ ID NO: 58724 - DNA, 846 bp, Glycine max
  Peptide Sequence Number=SeqID_150409
atgaattatcgtcacgcctatcacgccggaaatttcgcggatgtcgtcaagcacgtcatcctgacccgtcttgtcgaatatctgaagcgcaaggatcaggcctttcgcgtcatcgacacccatgcgggcatcggcctctatgacctgaaaggtatcgaggctgggaagaccggcgaatggacaggtggcatcgaccgcatcgtggatgcggtgaagaaagggcagatcgagcagccagcgctggaattgctggagccctatctcgccgccgtccgcgccgtcaacgaaggcgaaaagcttcgtcattatccgggttcgccgcttgtcgtgcggcatcttctgcgcaagcaggaccgtttgtccgcgctggaactgcatccgcaggattcggccaggctggcaaaactcttcgatggcgactatcaggtgcgcgtgaccgaactcgacggatggctggcgcttggcgcgcaccttccgccgaaggaaaagcgcggcatggtgctggttgatccgccttttgaaaaggaaggcgaattcgaccgtctggtcgacgggctggccaaggcgcacaagcgtttcggcggcggcatctatgcgctgtggtatccggtgaaggaccgcagggaaaccgaacggttcaccagacacttacgtgaaaccggcattcccaagatcatgcagatcgagcttgcgattcgcgcgccttccgcagaaccgcgcctcgatggcacgggcatgattgtagtcaatccgccttttacactcgaaagtgagatgcaaaccctgcttccctgccttaccaagcttctggccgaggaaaaggggagcaatttcagcatcaagtgg

SEQ ID NO: 58725 - DNA, 626 bp, Glycine max
  Peptide Sequence Number=SeqID_150410
atggagtggtggacattactgtttctgagcatcaaattgccaaggaaatcactgccaaacaaatccagcattggccaaagaaagggaagctaagtgtgaaatatgcaatcctgcacaggattggagctgcaaactgggtacccaccaatcatacttccactgttgccacagaatcctttgctgtcaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcctcaggtgctgtgtccaaggatgctctgattgctgaactcaaggacacatgcaaggtgctggaagcaaccatcaaagccaccacagagaagaagatagagctggaacggctgatcaaaaggctctcagaaagtggcattgatgatggagaagcagctgaggaagaagaagaagcagctgaggaagaagatgctgcagcagaggaagaggaagatgcagcagaggatactgaatcagatgatgatgattctgaagccaccccatga

SEQ ID NO: 58726 - DNA, 636 bp, Glycine max
  Peptide Sequence Number=SeqID_150411
atggccatccataccctgctgattgcggttctggccacgcgctttttctggctgacgcgcagcaaagcggcagttgccctggcggggcttgctatcgccggcgcactggtggccaattacagcgtcattgaggcacgagcatcggttacgctcagtgaaatccgcagctatcagaacaatgatgatcatacgtcgctggggtcacgtttcacgatgtggaagacggggctgctggcgtttgaacaccatcctttcgggcagacgcagccggcccgtaacgcctggattgtccgctggctggatacacacgggaatccggactcttttgcaattacttatctggacgttcacctgcataacgaatttatccagtatgcctccattttcggcattaccggcgtcgtggtgctggcgtgtttttactggatctccgtcgtgggcagcgcaaccgcctggggctttttcaaccccatcaccgtggccgctcttgcatgcctgctttacggcatgaccgacgtgctgctgaccagcgtagagctgatcgtcgtgctgtgtatgctgttctcgatgatggcgctggtttcaggggcgcccctgcaggaatcgggcaacgacgcgtgtcgcgctgaggtttaa

SEQ ID NO: 58727 - DNA, 420 bp, Glycine max
  Peptide Sequence Number=SeqID_150412
atggaagggttagtggacctagcagcgattgacgctttcctcgcctttcatcatggcaaggaaagcccggtcgtcgccattttggccatgtatgacacgttcgaccagggatgtgaaaaagagcagcgcaagaattgtttgttgtgcactggctctctatgtgtggctggtttcacacctttttctccaagaagaaaggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaagtctga

SEQ ID NO: 58728 - DNA, 180 bp, Glycine max
  Peptide Sequence Number=SeqID_150413
atgtccctccaatgtgttaagacaaaagttctcagggagaagggagacacaaaagaattcaggcggttagtccttcgttcttttggaaaagggagaagagagacacaaaaagaattcaagtggttagtccttggtgaattctttttggcaaagggagaagggagtgaaaaagatgaatag

SEQ ID NO: 58729 - DNA, 606 bp, Glycine max
  Peptide Sequence Number=SeqID_150414
gcttttcgtcttacagacagcaataaagaatgtttatacggataaccactcgggtatttccgcccgtcagcgtgactcaaatgtcagtatgacagatcttgtgagcgtgaaagatgacacagtaaaaaacaatgtttatacggataaccactcgggtatttccgcccgtcagcgtgactcaaatgtcagtatgacagatcttgtgagcgcggaagatgacggcgcagaagacgacgttagtctctgcgtgctatcaggcttttcgtccttacagacagcaaaaaagaatgtttatacggataaccactcgggtatttccgcccgtcagcgtgactcaaatgtcagtatgacaaatcttgtgagcgcgaaagatgacacagcaaaaaagaatgtttatacggataaccactcgggtatttccgcccgtcagcgtgactcaaatgtcagtatgacaaatcttgtgagcgtgaaagatgacgtaaatctccgcgtaacaacgggcttgtcggccgcgattgacgaagggcttttcgtcttacagacaacaaaaaagaatgtttatacggataaccactcgggtatttccgcccgtcagcgtgactcaat

SEQ ID NO: 58730 - DNA, 356 bp, Glycine max
  Peptide Sequence Number=SeqID_150415
aagtggttcttccggaaacactccggaagaagggttcttccggaaaggtcttccggaagtttgaaacttcttccggaagtgcgagtcttccagaattcttccggatgaaccacttcttccggaaagttcccggaagacgttttccggaagaagtgttcttccggaagacttttggttacttccggaagaacacttcttccggaaactttccggaaaacgttcttccggaacttccggaagaacccctaaggggtcttccggaagactcctccgtcagcgatttccgccattttttccggcgtcctctcgtcttctcccctctcgtcttctaccctaggtttcgtcttctaccctaa

SEQ ID NO: 58731 - DNA, 242 bp, Glycine max
  Peptide Sequence Number=SeqID_150416
atggctgagaggagaaggaaactattgcaagacataatagttgcatccattcttgaggaagagacccatttttctgattcatcatcatctaattcaccatcatcaagggaatccattaatcaattgtctgaaactgctactatggcagatgagcacgaccagaggacaacatcacctacccttgaggactattcaagtagctcggtgacacaatttttcactagcattgcacatcctgaagt

SEQ ID NO: 58732 - DNA, 573 bp, Glycine max
  Peptide Sequence Number=SeqID_150417
atgccgagaggaatgagtaaattaaatcatctacaacatctggatttctttgctgtgggcaagcacaaagagaatgggatcaaagaattggggggactttcaaatcttcgtggtcgacttgaaattaggaacttggagaatgtttcccaaagtgatgaagcgtcggaggcaaggatgatggataaaaaacacattaatagtttacggttggaatggtctagatgtaacaacaagagtaacaacttccaacttgaaatagatgtgctttgcaagttacagcctcactttaacattgaatcgttgggaataaaaggctataaaggaaccagatttccagattggatgggaaattcttcctactgcaatatgacacgtctatacttgtatgattgtgacaactgtagtatgcttccttcacttggacaactaccttctctcaaggaccttggaattgcacgattgaataggctgaagactattgatgcaggtttttacaagaacgaagattgtcgttctgggacaccctttccctcccttgaatctctgttcattcatgacatgccttgttgggag

SEQ ID NO: 58733 - DNA, 342 bp, Glycine max
  Peptide Sequence Number=SeqID_150418
atgtcactctactccaagttcttgaaggatatgttaacaaggaaacattcaccaggaaaacatcgtagtggaaggaaatgggttttgaagatcataaaatttattttgatttgtttgttgaagacaagcctgctccagaacaaaatgtttgcttatagtcatttcgctaagcacaagcctcgcgctaagcacatctttggtcatgcgctaaggcgtgagtcgcaagcacttagcgctcaatccttgcatcttaggctaatttggtccgctaagctggccaaggatgagctaagccaatttcaattcgatctaaattcggctaagcaacggcccgaccgctaa

SEQ ID NO: 58734 - DNA, 356 bp, Glycine max
  Peptide Sequence Number=SeqID_150419
atgaaggagttaaggagattgagaacaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 58735 - DNA, 195 bp, Glycine max
  Peptide Sequence Number=SeqID_150420
atggtgaaagtcggaacctcttacgtgccgatcaacgtctcattttcgccaaaagttggcccagggcttcccggtatcaacagggacaccaggatttatttattttgcgaagtgatcttccgtcacaggtgctccagtggcttctgtttgtatcaggcgtccctcctgttcacctaccgacggggtggtgcgtaa

SEQ ID NO: 58736 - DNA, 361 bp, Glycine max
  Peptide Sequence Number=SeqID_150421
gtgtacgcagctaaaggcaatagaggaaggaaggagttggtgcttaatgaaggggattagtcttggagagatcaacaacaacgcttataggctagacctcccaaaggagtatggagttagcaacacctttaacattattgatttggttccttttacaggtgtagctgattcagatgataaagggtctgtagatttgaagacaaatcctcttcaagagggaggggatgatgcaattctcccaaggaggggacacatcaccaaagccatggctaggaaactccaagaagactgggccagagatgcaggagaaggccttaggattctcatggaccttaggatagattttaggcccatgggctaa

SEQ ID NO: 58737 - DNA, 470 bp, Glycine max
  Peptide Sequence Number=SeqID_150422
atgaatcggcaacgcgcgggcgatcgagtgcgggcctttcgtattacgccaggcgctaaggcggatgtgtcatactggcttactatgttggcactgataacgcagggttcagtcgaaggcgttgtggcaggagaaaaaagctgcacggtgcgtcagcagaatatgatagatatccttcctcgactcactgatcgtacgctcggcgaattcggagctccacgcggtgagcgaagccgctctagaacaggggcggagattcccccgggctgcaggaattcgatccacttaatccagggaagtgggacccccgtgcaaagccgtttttccataggctccgcccccctgacacatcaccgaaatctgacgctcaaatcagtggtggcgaaacccgacaggactataaagataccaggcgtttccccctggcggctccctcgtgcgctctcctgttcctgcctttcggtttaccg

SEQ ID NO: 58738 - DNA, 333 bp, Glycine max
  Peptide Sequence Number=SeqID_150423
atggtgaaagttggaacctcttacgtgccgatcaacgtctcattttcgccaaaagttggcccagggcttcccggtatcaacagggacaccagtggattttttgatttggaagtgatcttccgtgcacagcaccgccggacatcagcgctggcaagtgtagcggtcgacgctgcgcgtaaccaccacacccgccgcgcattaattgcgccgctacagggcgcgtcccattcgccattcaggactgcggcaactgttgggaagggcgatcgagtgcgggcctcttcgctattacgccagctggcgaaagggcggatgtgctgcatacggcgttaa

SEQ ID NO: 58739 - DNA, 706 bp, Glycine max
  Peptide Sequence Number=SeqID_150424
gatccccaaccacaaggaaagcccggttgtcgctatgctagccgacctatatgacaccttcgaccgaagatgtgaaaagagcaatacaaggattgtttgctgtactccaactctttatgtatggttactttcacacctttttcgccaagaggtgaggcatgcttgcccgctagaaagccaccgttcatgcacagagaaaggaggggcaaattgggaccaactcttagcaagcaaagaaggagcatctgtcaactggttccctcgatggaaggaaggaagaaccggagttcttatttcctgcggaggattcccgaatgttcccttgatagggacgaggggttgcatcagttacattcccgttctcgctataaggcaacttggctaccctatgagaggagcaccaatagaggaagagattgcgcctgacaaagagctcaaaggcagtaacaatgggcccatcggtggctattgtaagtggttgaaagcccatgtgcaaggtttggattggctcccgagtttgagaaccactaaaagggaggaagttgaggcaccggaggaagacgaagagctaccaccaaggccttggaacgagagaccaagagggatcgtagggaagaacacggccgaaacaagttccgaggggctctgtggggcagtaacagtgagcttaagctccggagagaggaaagggaccaatcacgagtag

SEQ ID NO: 58740 - DNA, 974 bp, Glycine max
  Peptide Sequence Number=SeqID_150425
atgggcaccgtcgagctgctgacccgcgaaggcgaaatcgccatcgccaagcgcatcgaggaaggcctttcgcaggtccaggcggccctgggccagttcccggtctcggtcgagtcgctgctgaccgactacgaagcccacaaggaaggcaagaagcgcctggccgaagtgatcgtcggcttcaacgatctgaccgatgaagagccggcaccgccggcggccgctgccgatgacagcgccgatgccgacgccgaaggcgacgaggacgaggacgacgatgtcgacggtggcgatgaagaagccgcaccgaccggtccggatccggaggaagtcgccgcgcgcatgcaggcgctgagcgatgccttcaacgccttcaagaaggccgcgaccaagggcgacaagaagaacctgccgcgcctgcgcgaagaaatgtcggcggtgttcgtcaccctgaagctgccgctgccgctgaccgatgtgctgaccaagcagctgcgcgacaccatggcgtcgatcaaggcccatgagcgacgcgtgctgaacctggccaccgtcactgcacgcatgccgcgcaaggacttcatccgttcctgggaaggcaaccagaccaacctggagtgggtggaagacgcactgaagcgcaagcagaagtggtcgtcggccctgcgcgaagtgaaggaccagatcatcgccgaacagcaggcgacgatcgacatcgagaagctgacccagctggacctggaagagctgaaggaaatcagccgtgccatggcctacggtgaagccaaggcgcgcaaggccaagaaggaaatggtcgaggccaacctgcgcctggtgatctcgatcgccaagaagtacaccaaccgcggcctgcagttcctggacctgatccaggaaggcaacatcggcctgatgaaggccgtggacaagttcgagtaccgccgcggttacaagttctcgacctacgccacctg

SEQ ID NO: 58741 - DNA, 261 bp, Glycine max
  Peptide Sequence Number=SeqID_150426
atgactgcatatttccataccatcaaactaagtctttcagattcaaccatgctcaaaggtcaatcaaagaatgagttcaagatgttcaagatagaatcaagaacaacacttcaagattcaagaggaaagttgatttcaagaatcaagattcaaggttcaagcttccaagaatcaagatcaagattcaagactcaagattcaagaatcaagagaagacttaatcaagataagtatgaaaaggatttttcaaaaactgagtag

SEQ ID NO: 58742 - DNA, 381 bp, Glycine max
  Peptide Sequence Number=SeqID_150427
atggcttacactcacattccggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcagagaaatggaggttgatgaaccttggctagggttatggctaccattgaattatcaagtagatatgggatcaagtttagcatatgacaacggaatttggggtgaaccctacaagctttttgctgcaaaattcctttttgttggtgtgttttttttttggtttatgctaaaggtggtcttcgtcattggaagtgcggtagacagactttgtggttga

SEQ ID NO: 58743 - DNA, 318 bp, Glycine max
  Peptide Sequence Number=SeqID_150428
atggctcaattgatttctgatgtcatctattgtttgcaaggatcgcacccgcaagacacccagtggacccgaagaagtccaacagtgtcttggagttgccaagctctaattacgggcctcggtcagttctacggagtgcctgtcgcccccagcaaggtcatcaggccccctactaatcgagctttcatcaagaagtactgcgtccccaggcaggcgcagggcgaaacaccacagcagcctgaggatggccgacagcgggcaacagatgcactgtcatcacctctagagttcacctcagctcatccacaaaaaggttag

SEQ ID NO: 58744 - DNA, 141 bp, Glycine max
  Peptide Sequence Number=SeqID_150429
atggcacgcagcctgtccgctccgtgcccatattcaagggacctatatgggagggagcttaacaaggcttttagtgataattcccaaggtggtcatatctctcttgatggtctccagagcctttatattcctcaattgtga

SEQ ID NO: 58745 - DNA, 504 bp, Glycine max
  Peptide Sequence Number=SeqID_150430
atggcatcatcggtggagaacttcgaagctccggtggaagatgaagaagtccaagctctaaaattagagctagggaaggcaagactcgccaaggagaagttcaaatcagccgctacacacatccggaaagagtataccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggaaagagaccggtcacgggtgcatggcatgatcttaaaagaagagttagctgcgtgcgcaaggtccaagaggagtttggctcaacacttggaagccatggagcaaagcatgctagctatcataaggcaatacaaggaagagttgaatcagtctatgacccatgaacaaaagctagcggaggattttgcacaagtatgccgaaaaggaagcaagagggagggtgattga

SEQ ID NO: 58746 - DNA, 1298 bp, Glycine max
  Peptide Sequence Number=SeqID_150431
gactacacgtcctcgccttcagagggccacacgccctcaccttcaaagcactacacgtcgtcaccttcagaggactacatgtcctagccttcagaggcctacacaccctcgccttcaaagggctacacgccatcaccttcagaggactacatgtcctcacctttagagggctacacgccctcgccatcagaggattgcacaccctcgctttcagaggactacacgtcctcgccttcagaggacaacacgtcctcgccttcagagggctacacgccctcaccttcagaggactacacgtcctcaccttcagaggacaacacgtcctcgccttcagaggactacacgtcctcgccttcagaggagagctacacgccctcgccttcaggggactacatgtcctcaccttcagagggctacacgcgctcgccttcaggggactacacgtcctcgccttcagagggctatacgtcctcgccttcaaagggctgcacgccctggccttcaaagggcaacacgtcctcgacttcagagggctgcacgccttctccttcagagggctacacgccctcaccttgagaggattacacgactacatgtcctcgccttcagaaggttgcgtaccctcaccttcagaggactacgcgtcctcgcctttagagaactacatgtcctcaccttcagaggactacacgtcctcgccttcaaagggccacacgcccttaccttcagaggactgcacgtcgtcaccttcagaggactacacgtcttcgccttcaaaggactacacgtcctcgccttcaaagggctacacgccctcaccttcaaaggactacacgtcctcgccttcagagggctacacgccctttccatatgaggactacacatcctcgctttcagaggactacacatcctcaccattagaggacaacacgtcttcacctttagaaggctgcacgccctcgccttcagagggctacacgccctcaccttcagaggactacatgtcctcgccttcaaaggactacatgtccatgcctttagaggactacacaggcctgcacgccctcgcctacaaagggctagacgccctcaccttcagaggactacacgtcttcacctttagagggctacacgcctttgccatcagaggattgcacaccctcgctttcagtggactacacgtcctcgccttcagaggacaacacgtcctcaccttcagagggctacacgccctcgccttcagagggctacacgccttcaccttcagaggagtacacgtccttacggggatcctctag

SEQ ID NO: 58747 - DNA, 261 bp, Glycine max
  Peptide Sequence Number=SeqID_150432
atgtcacatgactatcatgctcaaaatgggttgccggatgaagtagatggtaacttcagtgatgacgaagacgaaattttggcggacaacaacatcaacgacaacgacgataatgacatacaattcattttccaaccagcatcaactgaaaatgtctatcgtccatatcctaatagcgttgatgttagtgacaaccaagtggttgacaaccccgactataggcatttttggaccaacaacaacaatatgacttacccgatg

SEQ ID NO: 58748 - DNA, 225 bp, Glycine max
  Peptide Sequence Number=SeqID_150433
atgaggaagcttgggaaagcagcttgtcagaattccgggactgttgttgattcaatttcatttgcctcacaagttcttcgagggaaggttgtggaggagcctcaacttttggctgtttctagggctgttgctgttgttggattggtggaggaatgtatggtctgcttgggccaacaacattttggaaggaaggagcaggctgctgatgttgttgctgagggctag

SEQ ID NO: 58749 - DNA, 270 bp, Glycine max
  Peptide Sequence Number=SeqID_150434
atgtcgttgcctagcgctgttcatgtgtcctccaccttcgagtctggagccccgcgaatgtcattgcctagcgctgttcgccaattctccattctccacttttattcggagtcccatgaatgtcattgcctagcgctgttcatgtgtcctccgtcatcaagcgcggagcctctgcaaaaaagaaggagtagagacgagaaccgtcatcacggaaagggcaggacagacaaaatcagtgtcttatctttgctttcctcttatctccgatga

SEQ ID NO: 58750 - DNA, 654 bp, Glycine max
  Peptide Sequence Number=SeqID_150435
atgaagaaaattctttcgatgttatcgctggtggccttgatgggcctggcggcaacccctgtgagttatgctgaagagactgtgacagaaaccatcacagttcaagaaacagtttccccagatgcagccccggccgcagaagcgccagccgctgcacctgcagaagctgctcccgctgcagctgaagaggcgccaacgctggatgtgggcaatactgcattcatgattgtggcaaccgtgttggtgattttaatgacgatcccgggtctggcgttgttctacggtggtttggttcgccaaaagaacatgctctcagtgctgatgcaagtgttcgtggtgttctccctgatttctgtattgtgggcggcgtatggctacagtatggcgtttagcgaaggcaacatgatcgttggcggcttgagcaaggcattcttgtctggcattaccaccgacagtttgtctggcactatccctgagtatgtgttcctgaccttccagatgatctttgctgcgttgacaccaggcctgatcgtgggtggtttcgctgagcgtatgaagttctctgcggtattgttgttcacggctttgtgggtgacattcgcttacatcccaatcgcacacatggtgtggggtggcgttacctggcagagctgg

SEQ ID NO: 58751 - DNA, 264 bp, Glycine max
  Peptide Sequence Number=SeqID_150436
atgctgagcgactctttggaaccggaattacctgtatcgactattcctgctgacgcaccggggcaccttttttctcctgccaccgcggtggaagctccattcactgacaccctcatcagtgccaacactagcgttacccaactatcccgcaaaccgcactccccttcgccagctggcgtcttaatagcgaagaggcccggcaccgacgcccttcccgacagttggaaatggcgaatgggagcccctgagcggcaacgcaattaa

SEQ ID NO: 58752 - DNA, 265 bp, Glycine max
  Peptide Sequence Number=SeqID_150437
caaaataggggagaagcttgccgcccagctcacccaagcgagcaaggttgcttcctccagaagcaacagccttctggaggaatcttctggagggcccaagttggcctggttgctatttgcacccccctttttactaaatgcacctccttctattttttttgctttcgaagaagttacgaaaacttacggattgcgcaaaacacctcttttcgatttccgtcacattacggaatttcacggattgcgcaagcctgcttccttttga

SEQ ID NO: 58753 - DNA, 558 bp, Glycine max
  Peptide Sequence Number=SeqID_150438
atgggtgttaagtacctcggggcggtcaagcgaaggttgcatgtcaccaaacaatggtccccggacgaaattaggaccccaatgattctggaagagggggaaaacctttgtgctcattctagatttgcactcttgaggcctgatcctcaagagttagcaactaagctctgcatcccagggaagggatttgagcttaatgctgagggtcggcctttgaagattttaaggaagaacatgactactttagctcagacatggagcattctttccttctctaacttggttcctacctcctactcatcaaatgtcacattagatagggccaagttgatttacagcattataatgaagatggatataaatctgggctacctcatctcccaccagatctctattattgcccagcacgactcctctaggcttggatttccagacttaatcacagctttgtgtaaagctagaggagtcacatcagattctagatccctggagagcctcaaccctgccattaacttggcatatattaagaagaactgttggaatctagatgattcaaaa

SEQ ID NO: 58754 - DNA, 305 bp, Glycine max
  Peptide Sequence Number=SeqID_150439
aatttgatgaattcctagatgagctggatagaagacactggagggaggagttgactgactttctggatgacaacattgatgttgccattgtaaaagaattctatgcaaacttctatgaccctgaggacaaatcacctaagcagggggaaacactttgtgcttactctagatttgcactcctgaggcctgatcctcaagagttagatgctaagctttgtatcccagggaggggattcgagcttaatgctgatggttatccggtgaagattctgaggaagaacatgaccactcttgctcagacttag

SEQ ID NO: 58755 - DNA, 393 bp, Glycine max
  Peptide Sequence Number=SeqID_150440
atgattggaaatggtaacaatcgctatcaaatggtaagtgttaatgattgcgttgatgctgctatccttgcagttgataaaggttgtcctcatgggccatttaacttagggtctactaacccgcccactacaaaagaattgctgcatggtattattaaacatgcaaattcacgttcaatcgttatccctattccatcagcgatcatcaaaccagcattatcagcacttgataaatgcggtctcactttattgtatccagagcagttcggtattgctgacaaagatgtcctattggataccattgatactaataatactcttgggtggaaaccctctcgtaaagatatagatgctatgtgcgatgcctataatgattacattagagtgaaataa

SEQ ID NO: 58756 - DNA, 144 bp, Glycine max
  Peptide Sequence Number=SeqID_150441
atgacctgtacaggcttaggatcttcttcattaatgaattcctttgcttctgggaagatgaatggcagcggaatggagaaggaagagagagaggagacgtcacttcgaggagaagatgagtctagaagaagctcaccaccatag

SEQ ID NO: 58757 - DNA, 241 bp, Glycine max
  Peptide Sequence Number=SeqID_150442
aggactacacgtcctcaccttcagaggactacacgtcctcaccttcagagggctgcacgccctcgcctttagaggactagacgtcctcgtcgtcataggattagacgtcctcgccttcagaggactacacgtcctccacttcagcggactacacatcctcgccttcagagggctacgcgctctcgccttcagtgggctccacattcgcaccttaagagaatttaaggtcctctacccttaa

SEQ ID NO: 58758 - DNA, 1396 bp, Glycine max
  Peptide Sequence Number=SeqID_150443
gacctgcgcggcgcggcgtcgcaagcggcggcgccggcgcgagcgggattcgaagcggcctttgcccatgcgggcaagcggcgcgcgagccggatgctgttcgcgatcggcgcggcgttgatcgtggccgcggcgggctggatgacattgcaggcgtatcccgcggcctatctgacggcggatgtgcacagcgtgaccggcgagtggcgcgtccagttgctggaggacggctcgcgcgtcacgctggccggtgacagtgccgtgaacctgcgattcaaccgccagcgccgggaactggaattggtgcaggggcaggtgctgatcgaggtggcgaaggacgccctgcgtcccttcgtggtgcgcacgcgcgaggcgcggctgaccgcgctgggcacccgcttcgcggtggaccggcatgacggcgtgacgaagctggcaatgatcgagtcgcgcgtgcgggtcgaggcggccggcgcggcgccggcgcaagcgctggtggtgcaggccggccagcgcgtggcggtttcggcacggggcgccgggccgattgtggcggtcgatcctggccaggtggaggatgcctggaaattccatcagttggcggcgcgggatcagccgctggccgacgtgctgaaagagctgaatcggcaccggcccggccgcatcttctatgacggggccgcgttggcgggcattcgcatgacggtggtgttgccactggacgataccgaccgggcgttgcgattgctggccgagagcgtagcccggcttgacgctgcggttcgcctcgtcctatttcgtgtgggtggggcggaccggaggcgaagcggcccgctagttcggaaaatccccgcgatgggtgatcatgcacaagctccaaccggcaggcccacgccgccgttttcgattctcgccgcagcgggcgccccacaccctgtctcccgctgcccgccttgtgctggccgggttgggcgcctcggtcgcgctgattgcccaggcgcagcacgtcgacaggcaatacgacattcccgccggctcgctggcggacgtcttgagccgttatgcgcaacagtccgacatcgcgttgtcgctgattgccgaacaggtggccggtcgcgagagtccggggctgcatggccgctacgcagtggaagaaggcttcgcggcgctgttgcgcggtaccggcctgcaggcccggcgcggcgcgtccggctatgtgctggtggtgtcgccgggagccgtgaccctggcgccggtcgagatcgagggcgacgaggttgccgggaaagaggtctatgccgcgccacgttcttccgtgcatctgtccagtcaggacctcgaccgtttcggtcgggtgtcggtcggcgacctgctggccggcataccgggggtgcag

SEQ ID NO: 58759 - DNA, 327 bp, Glycine max
  Peptide Sequence Number=SeqID_150444
atgcccttttacgggcgagtgaaggcgaggctcacgggtgcgctttccaaaggaggaaagatgtgcagagtcgccaccaacgaaggtattagcacctctcacgtcgacaaaagcggagctcttgctcctacgtatcctccatcgaagaggaaatcagacctacgtagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 58760 - DNA, 465 bp, Glycine max
  Peptide Sequence Number=SeqID_150445
atgttttttaaatgtggtattgacgatgtctttgtacataggtttcaaccaacatatgggtgttctaatttcatatcaaatatcattagggaaaaatttgatgaactagctgcaagttggttgaaggtgtcagttgaccttcgcgataggtggtttggagagtttaagaaagagtataggtggcacccacaagaaaagcgagccattagagctgtttttgagacaaaagccttggacgaacattggggttctacagatttcctaaacaagagctctactgccaaggtgaatcgatctgttgatagaggagcctcaacatactatggtggttccgtatctattgaaactcactttgaaaagttgtcaaaggagtttcaaagaccaccaactacttggaaggtgatggagaaaactaagaaattgaagtcgggagaatgggtcaatgacaagtcccgcgaatttgct

SEQ ID NO: 58761 - DNA, 611 bp, Glycine max
  Peptide Sequence Number=SeqID_150446
gaaatgatcctgagaccggtgactctgacaggtgcggcttgtacatagaagcagatcctgcctgcctggttgccatcgggagagtttatgagggatccactgttgttcataacactcctttgttgcttggccaagtaaaggtgagtgtggaggaggttagagatgtagatgctccagttcctgtacccactgatgaggtttccttagtggggcaggcacttcacaccttccttgcttggccaacacatctggtcaagtctttatcacaacaggtagctgtgtctccgccaaaaccacctctgaagcccgatccggaggtcgatgatccgctttatctgatgacattgaccatcccaaagcttttcttgaggccttatcagcacgaagacctctccgaaatcgcacacggtggtcaatgtctcagcatatcagtgttacagttgtggattctgcatctcactgaaacatgtatgcgagcggggaattctgatatctatggattccttgagcctcagtccattcagaggtctgggcaatcgcagtttgaatctgaaagttccactgcagcggacattggcagatggtggtcatcctgcccaaggaacacttag

SEQ ID NO: 58762 - DNA, 501 bp, Glycine max
  Peptide Sequence Number=SeqID_150447
atggtctggaccatttaccatcaagaaagtcaaccatatggagcagtggagctttgttatcctcactctaaagatcctgacaggacatgggtagtgaacggacaaagtgggcttagcggagatgatgcgctaagcgccactcattctctggaaaaatctattgtagcagcgctaagcgtgctgtcctgggctaagccccatattcattctggaattgaaatttcacgagttgggcttagggcaggatgcgctaagcaccaatcccttactgtttttgaaattcttggaagtgcacttagcgtgcttgttgtgctaagggcaatgcttgaaaaaggggtgaaaacccctgtgtttctgttgcaaatcacgatgaacgcactaaatgattgcactaagcccgaccgtgtcgcggtaagcgcgttcatccttctgatgagtttcaacgatgagtatgctaagcgcgtctgtgcgctaagcgtcactagtgtttcagacacttag

SEQ ID NO: 58763 - DNA, 440 bp, Glycine max
  Peptide Sequence Number=SeqID_150448
acaatacctacaaaacatataggtacagacttccactacttgacattgttggggtgacaccaacggggatgacattctctactggatttgcatatttggaggacctagcattgatgaatgcagtgaaaactgtgttccctgagtgtacaagcttgttgtgcaggtttcacatcgacaagaatgtcaaggccaaatgcaaattcttaattggtcaaaaaaatgcttgggagatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 58764 - DNA, 833 bp, Glycine max
  Peptide Sequence Number=SeqID_150449
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggtgggcgtaatgattggcttggtgttttgcttgctcagtgcagcattcgatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58765 - DNA, 270 bp, Glycine max
  Peptide Sequence Number=SeqID_150450
atgttgtggaagcttggaaggattgatggggacccgacattgagaggaacgaggataagggctacgtgggagtacgtgagctcagttggaggtgggcaacaggggatggtgggtttatacgtgatttgtggatgtggagaattgtcttgcaccatcgcccgaccgccacctagtaccacatgtgatggagtggtacctggagatatgtcgcgggggtcaggagaccttggggacgtcaggtggggtgctattgcccaaaaccaagcttga

SEQ ID NO: 58766 - DNA, 177 bp, Glycine max
  Peptide Sequence Number=SeqID_150451
atggtcgtaccaaatccaatgtactcggaacatcatcttcgcatattgcgaccacttgacctttgtgatgcaatcctccctaggaagggaccaatcacaagaaccatgagcaagaggctccaagaagattgggctagagctgctgaagaaggccctagggttctcatgaaccttagg

SEQ ID NO: 58767 - DNA, 681 bp, Glycine max
  Peptide Sequence Number=SeqID_150452
gctgaagttgcggagacattacaatacatagtgtctcctcaaggaaggaatacatggacagatgatgatctcgtgccttatgtggaaaaaattacaattttatccgaagagcaagagagagtcactgaaccagcgtcacatggtcctgcatctgagcgtcaatttcccgcacaacagtttcacatacttcagtcaagtgttgaaactcagggcatagacagacgaagggagactgttgaaggggaagaatatttccaacaaatgccggagcgtggccatggaatgtattacacgccacaaacatttcctgagtatccgacacatatgtatcagtatccttttcagggtcatcacactgatacttctgcaagccagcaatcgttcggtggtgttgcggaaacacaagctcatttttcatggcccacaatgaccccttcacaacaatatcatggcccaattccaacacctaatgccccgttaggaacacaatggaatgtaccgggacaaatacctaatacgggtgacttattcggtgttgatttgcgtcacgcattttctgcggaggctgacgaagaagaagcggggaggcatcggggcagaagaaatcctgatcgccaagcacgaagatgggatcgaccatgtggcacatcctcacggcatcacggacaccaaaatgaatga

SEQ ID NO: 58768 - DNA, 359 bp, Glycine max
  Peptide Sequence Number=SeqID_150453
tccctcctgttcagctactgacggggtggtgcgtaacggcaaaagcaccgccggacatcagcgctggcaagtgtagcggtcacgctgcgcgtaaccaccacacccgccgcgcttatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgattcatgtgtcctccacctacgagtttggagctatgtttcatga

SEQ ID NO: 58769 - DNA, 201 bp, Glycine max
  Peptide Sequence Number=SeqID_150454
atgcgaccgctgcgggtcacatcactcagccccgtgatattggttaccttggccgacaacgagctgatgtcgatggcctcttctttcctttcactcggggtgtatacctccacgggactacgtggttgttttggtatgggaaaggaacaggttttgttgtcgaggggtatcggggcttttgtgaagctgcgtccttggtga

SEQ ID NO: 58770 - DNA, 512 bp, Glycine max
  Peptide Sequence Number=SeqID_150455
aggactgcacatcctcgcctttagagggctacacgccctcaccttcagagggctgcacgtcctcaccatcagagggctgcacgccctcaccttcaaaggactacacgtcctctccttcaaaggactacacattctcgccattagagggctacacgccctcaccttcaaagggctgcacgccctcacctttagaggactatatgtcctcaccttcagaggactacacgtcctcgccttcagatggctacacgtcctcgccatcaaagggtcatgtccccaccttcaaagggctacacgccctcacctttagaggactagacgtcctcaccttcaaaaagctacacgccctcgccttcagaggactacacgtcctcaccttcagagggctacacgccctccccttcagaggactacacgtcctcaccttcagagggctacacgccctcgcctttagagaactatgcgtcctcaccttcagaggactacacatcctccccttcaagggactacac

SEQ ID NO: 58771 - DNA, 761 bp, Glycine max
  Peptide Sequence Number=SeqID_150456
gacacttaatcaagattgatgctgacagcctaaataccttctttgaaaccccaatagttttagaggagggtgagacactgcctacctattccagatttacgaggatgaggattgatcctcaagagtttgcttcccgtctctgcatccctggtaggggttttgttctgaatgcagggggccatccttggaagcttctgaggaaagatctcaccactcttgcacagacatggagtgtcctctcctacaacaacctgactcccacttctcacacctctgatcttaatatggacagagacaggttggtttacggcttagtcacaggcatggacgtgaatatcagagccctaatctcaggtcagatttctaccattgccaagagtaactcttttaggctcggatttccagccttgatcactgccttatacagagctcgaggagttacctctgacagtctgacctatgagagcctgagcccgaccattaacttggcctacattaagaaaaattgttggaatgtggatgatctgacagttaacttcagaggggacaggaaggtaagggctcgagcagcagatgttccttcttcttcggcaccaccagctcctcccacttctaccacgcctacaccagctgcccatgactctcagtgctttgaagctaaggcggttgcttctggaggaagcaaccctgctcgcctgggcgagctgagctcgcctgggcgagctgggcggcaaccacctcccctattttgctataaatag

SEQ ID NO: 58772 - DNA, 88 bp, Glycine max
  Peptide Sequence Number=SeqID_150457
ggattgtcatcatcaaaaagggggagattgtagaaagggggagattgtagaagatctttggtgttttgatgatgatcaaaaagcttag

SEQ ID NO: 58773 - DNA, 216 bp, Glycine max
  Peptide Sequence Number=SeqID_150458
atgtggaccaccacgggggaggagcttgccacccagctcgcccaggcgagcaaggttgcttcctccagaagcaaaagccttctggaggaaggatctggaaggcccaagtgggctagattgctatttctttcgaagaagttacggaaactcacggattacgcaaaaacacctcttttcgatttccgccacatcacggaatttcatggattgcgctag

SEQ ID NO: 58774 - DNA, 722 bp, Glycine max
  Peptide Sequence Number=SeqID_150459
atggtgaaagttgggaactcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcaattgtcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58775 - DNA, 81 bp, Glycine max
  Peptide Sequence Number=SeqID_150460
atgaataagagcttgaaggtaggaaaagatgagatgagggagagggagagaaggagcacggaatttggtgcctcaaatgag

SEQ ID NO: 58776 - DNA, 369 bp, Glycine max
  Peptide Sequence Number=SeqID_150461
atgatgctgtcttggtctgaacctcaagctagtatactgcagaagattgaacaagccactataaagaatgttgcattgcaggaactgatacagttgtgtaaacaacaaccagaatcacagacaaattacacaatcaagggtaatttgttgtattggaagaatcggcattcagaactacagtggagtaagggagaggggaacattgatgttaacaggatatccagcattcagaagaaattaaatgaggtggaggacttagcttctaatcgtattttgactgatcaagagctcaaaatcagaagctcccttcagcaggagttatggaatgtatcaaatgcagtggaatccctttttgagacaaaaatctag

SEQ ID NO: 58777 - DNA, 477 bp, Glycine max
  Peptide Sequence Number=SeqID_150462
gagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagaggatcttccggacatctctccaaggacaattccgcgcccgttggggtaagccactagttctgagcgctcgccgcagtcgaacgaccgagcgcactgtcgtgactggaacaccctggcgttacagtgccaacatagtaatcgccagtatgcagcacatccgccttagcgccctggcttgcgcacctgacaggtttcccgacatggaaagcgggcagcctctcattagtgcaccggctttacacttgccagcgctgatgcttccggctggtatgcttgtgtgccgaattgtgagcggatcaccattccgtcagtag

SEQ ID NO: 58778 - DNA, 928 bp, Glycine max
  Peptide Sequence Number=SeqID_150463
ggaatgtgccggattacgggaagagaatgcaactaccgcaagagcccttgagcaagagagcaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctgttcaaggtccaaaaggagcttgtctcagcgtttatgtgagacggagaccaacatgctagctatcatcgccaagtaccaagaagagttaagtctagccacggcccacgagcatagggtcgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacctactccgtccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacagatggcttccatgatggaggccatgttaggaatgaggcagctcatggagaaaaaacgtggccaccgctgccgctgccgaagcagacccaactctcttggcaaccgcgcgccatcctccctcaaacatagtaggacggggaaggaacacgctggggcacgacggcaaccctcatctgggatacaaccgagcggcttacccttatggattgccgcccaactactcaccacttgtcctgcaagacgatgcgggccatattgcttctcccgtccttga

SEQ ID NO: 58779 - DNA, 558 bp, Glycine max
  Peptide Sequence Number=SeqID_150464
atgacattgaccatcctagagcttttcttgaggccttaccagataaagcacgaagacctctctgaaatcgcacacggtggtcaatgtctcaacatattagtgttacagttgtggattatgcatttgactaaaacaagtatgcgagcggggaattatgatctgtatggattccttgagccacaatccattcagaggtctaggcaatcgcagtttaaggctgaaagttacataaagagttggatgcagagttcaaaacgcgatgtctaccttggagcctacctgaatggcggacactggcagatggtggtcatcatgcccaaggaacacctagttgtctggttttgttcattgcataacaggacagacaactaccttaaggggataattaatagtgctttaaaaggtcttaatgatgctccacagcctaaatcaaaggcttatgctaggtggattgtcgtcaagtattttaacgatcctagaccattggagccagagagattaaaggcgcttcaaatccagtgggcacaatattatctccgagttagagcagagagctag

SEQ ID NO: 58780 - DNA, 123 bp, Glycine max
  Peptide Sequence Number=SeqID_150465
attccattaggagcgattttagccattgttgatcctgtggtgataggcattgttgagaagccagaggtcattgctgtttcgaaattaattaaaagtggtcttgcgatcattgctggaaagtga

SEQ ID NO: 58781 - DNA, 276 bp, Glycine max
  Peptide Sequence Number=SeqID_150466
atgtgctgcaaggcgattaagttgggtaacgccagggttttcccagtcacgacgttggacttgcgctcctcagttgatctccaagtccacccaatcaaaaattgcacattctacacgtttggtaagggtgccgtaagcgacgagccttggatcttcttcatcaatggagtcctttgcttcttgaagttcaatggcagtggaatggagaaggaagaaagaggattggagatgccacttcaaggagaagatgagtcaagcacaagctcaccaccatag

SEQ ID NO: 58782 - DNA, 691 bp, Glycine max
  Peptide Sequence Number=SeqID_150467
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatggagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58783 - DNA, 543 bp, Glycine max
  Peptide Sequence Number=SeqID_150468
atgtctggagcgcagctcggaccagctgctgctggccgagtaccagtgccacaacgacctgccgaacaacaccctcggccagctgccggtgacgtgaccaactggatatcccggcgacgccggtggcaacctgaccccgcgtgtacacgccgaagctcaacgttgccagcccagaacctggaagcggtgaccgtggcggcccaagtacccagcaggatatcgggccgcttcggctcgctgatgttctccggcaactactccaacatgctgaagcgtgaagtgcagccgatgccgggcgccgccaagctcgacctcctgagcgatccgtacaacatgtggtactacgacaacttcgccaaggtgcgcggcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 58784 - DNA, 422 bp, Glycine max
  Peptide Sequence Number=SeqID_150469
atggtgataaaatttgatgttcgaaaagcttttcatatgcttgactggaacttcttgcttcaagttcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58785 - DNA, 327 bp, Glycine max
  Peptide Sequence Number=SeqID_150470
atggttaagttcgatcttgagatagtcatggagttttatgccaatgcctggcctacagaagagggagttagagacaagcgctcctgggtgactggccagtggattcctttcaatgaggatgccatcaatcaatttttggggaatctacttgtcttggaagaaggtcagcgttgcgagttcagccagaggaggagtcaggcctctggctttgataaggaggctatcagccatttgctgtgtgttccggggcaggactttgctcggagcgtagaggggaggcgggtgcggatcatgcgcaccagcatgaccaccctcacgcatatctag

SEQ ID NO: 58786 - DNA, 324 bp, Glycine max
  Peptide Sequence Number=SeqID_150471
cgagaaaagctgtgattttggttgatgtgttgagcagagttttctgcctttgctctgttttgcttggttgtgatagcttgtgctgtttgaatgttgttttgcttggatgttgtggaagcttgggaggattgatggggacccggggatggtgggtttatgcgcgcattgtggatgtggaaagcttgttgtgcaccatcgcccgaccgccacctaagtggtacctggagatatgtcgcgggggtcaggagaccttggggacgtcaggtggggtgctattgcccaaaaccaagcttgaccaatcccgacccaacccgggcatagtcg

SEQ ID NO: 58787 - DNA, 297 bp, Glycine max
  Peptide Sequence Number=SeqID_150472
atgtatgaccaattagatgaggcttctaaggccaccacacgacagattgcggggtacctgactctattacagtgctggatctatgagcactttcctagtgtgaatcagtgcgtcacagatgatacataccaggagacgtccccacgtgcttcccggtggctgacgtcgaaggcgcatatgaatggaatcacaggagcaccgtacagggcacgttgtgatgctttgaccatcacagatgtgtcctggttgccttacactaagcatcggggggttaaggcctttgagcttatttcataa

SEQ ID NO: 58788 - DNA, 144 bp, Glycine max
  Peptide Sequence Number=SeqID_150473
atgtgttttcgtgaagaaaatccaagccgaggtgcttctgtaacgctttcaagacatttctgtaagcaattctgtggaaaatcttcatcgttcttcaccgttctttgtcgttcttcagtcttcaaccgatcgttgacgctataa

SEQ ID NO: 58789 - DNA, 216 bp, Glycine max
  Peptide Sequence Number=SeqID_150474
gggagacataagtatgtgatgcaagctccattggagcttgtaggcctaggatcttcttcatcaatggattcctttgcttcttggaagatgaatggcagcggaatagagaaggaagagggagaggagacgccacttcaaggagaagatgagtctagaagaagctcaccaccacaggaggccatggataagagcttggaggaagaaggagatgaatga

SEQ ID NO: 58790 - DNA, 453 bp, Glycine max
  Peptide Sequence Number=SeqID_150475
gaagccatatcttttctctgggttctatccctccacgacaagagttgccaagggcaaaggccttggcaaaatcaaggcgaatgggcttcttttactgacaccttggcgcttttgatctttggaggtgtcctctttccaaatatggaagggttagtggacctagcagtgattgacgctttcctcgcctttcatcatggcaaggaaagcccagtcgtcgccattttggccatgcatgacacgttcgatcagagatgtgaaaagagcggcgcaagaattgtttgttgtacaccgactctctatgtgtggctggtttcacacctttttctccaagaagtgaccacaacgcgagggtactccaaggagttcgcaaggcatgggatgcggcgtgaagaaaggacagagagcttaggggaagcagtaatgggatcatcggcggctatcataagcggctaa

SEQ ID NO: 58791 - DNA, 278 bp, Glycine max
  Peptide Sequence Number=SeqID_150476
ggatcgtgctcgcaagactcccagtggacccggagaagtccaacagggtcttggggtttccagctctgattacgtgcttttgtcagttctacggagtgcctgtcacccccggcaaggtcatcaggtcccctacttatcaagccttcatcaagaagtattgcacccccaggcaggcgcagggcgaaacaccacaacaacctagggatggctggcaacgggcaacaaacgcaccgccaccacctctagagttcatctctgctcatccacaaaaaggttag

SEQ ID NO: 58792 - DNA, 884 bp, Glycine max
  Peptide Sequence Number=SeqID_150477
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttttatcatttgatgcaagctccaatggagcttgcatcatgatgcggatgaagcccctcagcggcgaaggccaacaacatatgcacgtagacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58793 - DNA, 189 bp, Glycine max
  Peptide Sequence Number=SeqID_150478
ggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 58794 - DNA, 991 bp, Glycine max
  Peptide Sequence Number=SeqID_150479
atgcctaagaagaaaaagaaagtgaagcagatcgagcctgaaccttctgtgacggtcgagggtggtgagccagtcaggaagaaaaagaagaagaccaagtcttcaaaagaacaaggtgagaatcaacctgttgacgtccaaccaccttcgactgatgttggcggcgctgaaacagaaactactccctctattgctgagatgggcaaccttgtcgaacaaccggacttaccacaagaacaccctaccgtcgaggtacaacaaaatgtttctgtagaagaaataccctcatgtgctcgaatctctcctgctcctgagacggatgcagtgaatgttgaggaacagggtgaaggtcaaggtattggacccagcagtcctcagggatcgagtcagagaagttcatctgaagaacatttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgagcaccagtcaagccaacacctcaagtgaaaataatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaagcacatatccttctgctcgagaaagcccgagcggcccaacgtgaagtcgagcgtctcaccaaagaggcgaaagaaggatcttctgagatcaaagcct

SEQ ID NO: 58795 - DNA, 345 bp, Glycine max
  Peptide Sequence Number=SeqID_150480
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctgcaatccttgaaatctccgcccctgaagccatttccgctcccgcagcaagcgagcgtagcgaattcactgcagcccgggaggaatatatcctcactagttctgagcgacgccaccggtggcagcttttctccattcgcccatag

SEQ ID NO: 58796 - DNA, 708 bp, Glycine max
  Peptide Sequence Number=SeqID_150481
atgatacgagaagaacaagcagcatttattgaggacccttcattgtacctcccacgcacaaaacaatatggccagatgacatctcaagccgccaaagaaatagctgacaaaattgactctttggaagagcaaagcaggcagggcagcattgtgccttcgggacgtgacaatattttgaacatggctattggaagaccggagcatcctggtcgagtacgtggggctgggacaggggttacaattacgcagtattttggtccagcatcgcgtcggtctacgacttcatcaaacatcactgtagaacagttggctgatataattggtaacctaaaagaagaatggcgaagacatgctgaagaagaaaacattaaaagagacgaggcgtggatgaggagggtagaagaggaaaaacagtgcactatggacacatttaaaggacaaatacaacaagctatcaagttggagttgtcccaaattgtatcacaacattcagccccacttcagccaaatgatatagaagtattagcagcaagggtaagcacgaagggaagctgtgcagcagcagagacaaatgcattagctaaaaaaccctctgagttgaatggtgacagcgtcgggttgcatgtaactgtcgagaactccaacaaattagtggcagtgggcaaacagtgcgacagttttggcaccatcacacgtgccctatgctga

SEQ ID NO: 58797 - DNA, 270 bp, Glycine max
  Peptide Sequence Number=SeqID_150482
atggaaagaaaaactagaaagaaaggaaaaagaaggcataggtcacatctcagacctcactcccataggagagaaaaggaaagaaagcctcaagaggctaacattagcctcccatacttccatgggaaggataatgtagaggcttacttagattgggaaataagtgtagagcaacaacttaaaaggaagtctacttcaaaaccttatggctctcactcttatccaaagggaaagaccaaggcaaggcatcttaggggtgacaccctctaa

SEQ ID NO: 58798 - DNA, 330 bp, Glycine max
  Peptide Sequence Number=SeqID_150483
atggatggttgctttgatggtatggatacccgcatcacccagcttgaagaggatggattaagagaccaagggtctcttgttgtaaagcaatctgaacaaaaaggaagggttgtccttgtgtggttcaaaacttgtaaagggcttttgcaagatagtggagctctcaagcaggttgcttggggatgggacaaggactctccctacagtaaaatgcaagggttgtggttgtgggcgaaattgagggccctccaaagtgtttggcaggggtacaccaccaccaacttcttgcccctcaatggcgtatctgaggcgaggctcgaagtcgactag

SEQ ID NO: 58799 - DNA, 243 bp, Glycine max
  Peptide Sequence Number=SeqID_150484
atggcccgcatcgtcttgcaagatgggtgtgtgtcccttccccgtcctactatgtttgagggaggatggtgcgcagttgccaagagagttgggtctgcttcggcagccgaactgacagcggcagcggtggccgcgtttttctccatgagctacctcattcctaacatggcctccatcatggaggccatctgttctttcagagccgacatgtcggctttcatctattcctgtgtctcctcttga

SEQ ID NO: 58800 - DNA, 660 bp, Glycine max
  Peptide Sequence Number=SeqID_150485
atgctggtgctggtagcgctgctgattagccagaaagagaagctggggatgagcaaagacattctgtggagtgtcacgcgcgccattatccagctggtgatcgtcggttatgtgctgaagtcaattttcgatgtcaataatgactggctgacgctgctgatggtgctgtttatctgcgtcaatgcagcgctgaatgcgcgcaaacgcagccggcggatcgaacatggttttatcatcgcgctggtggcgattaccagcggtacggcactgacactaacggtgctgctgctgagcggcgccattgcctttgttcccatgcaggtgatccccatttccggcatgattgccggtaacgccatggtggcggtcgggctgtgtttcaccaatctcaatcagcgctttaccgacaaccagcagaaaatcatggagatgctcagcctgagcgcgccaatcaaacgcgcatccgccgggctgatgcgtgacagtattcgtgccgcgatgatccccaccgttgatggcgcaaaaccggaggggctggccatcaagtaccagattatggtgacgtttatgctgattgccaccgccagcctgtcgaccatcatcgcggcgtatctgtcctaccgtcgcttttacaccgcgcgggcgcagctcaaaccgtag

SEQ ID NO: 58801 - DNA, 210 bp, Glycine max
  Peptide Sequence Number=SeqID_150486
atgaaaattaggacatgcttgagagggttttctactaagaatttggctgcccccatgagggatactttgcatctaggaaacatggaaaatacctttcaatggtatggatatatggtggggaattatccctcaaatgtatatagatggcatggaatttccttttcaaatgcaagaaatggccccgaggaagcttgcctcaaagagatctag

SEQ ID NO: 58802 - DNA, 899 bp, Glycine max
  Peptide Sequence Number=SeqID_150487
tcgattgggaccaacatttggctaggataggaggcagcgcaatcagttggtttcctcgatggaaggaaggcaaggagggagttcttttctcgtgtggggactaccctaatgttccattgatagggactaggggttgtattaattataatcccgcactcgccataagacagctagggtaccccatgaggggagcgccaacggaagggagtctctcacctttccttgtgaaagatttaggcgtgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagttctggaggaagatgaagaagtccaagctctaaaattagagctagggaaggcaagactcgccaaggagaagttcaaatcagccgctacacacatccggaaagagtgcaccgaaaacaatgagctcaagatcctaagagaggaaagagaccggtcacgggtgcatggcatgatcttaaaagaagagttagctgcttgcgcaaggtccaaaaggagtttggctcaacacttggaagccacagagcaaagcatgctcgctatcatagggcaatacaaggaagaattgaaccagtctgtgacccatgaacaaaagctagcggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 58803 - DNA, 54 bp, Glycine max
  Peptide Sequence Number=SeqID_150488
atggccgaccagcaggcgaccaaatccaaagccaaaggtagaaagataccttag

SEQ ID NO: 58804 - DNA, 453 bp, Glycine max
  Peptide Sequence Number=SeqID_150489
atggaggagacacatgaaattccccaccacaatctagctgacttcgagccttggctcggatatgccactgaagggcaagcagttggtggtataccctttgaaaacactttggagggccctcagtttcgcccacaactacaatcattgcattttgcggtgggaagagcccctcctgctatggccgaaaagggaaagttggatcatttagaggaaaggctcagggccattgaaggaggtgaagattatgcctttgctaacctagaaaagttgttcctaatacccaaacatggtcattcccaagatgcaactacagaacatgtgcaaaaaggaggacggatctttcaaaaacacgcccaaaaggtggagggatctggcggcccaggtggtacccccaataatggaaagggagacgataatcgtgatggtagacacatgatcggtactccactatga

SEQ ID NO: 58805 - DNA, 447 bp, Glycine max
  Peptide Sequence Number=SeqID_150490
atggcgtatctgttctatcagctgttccctcctgttcagctactgaacggggtggtgatccgtaacggcaaaagcaccagccggacatcagcgctggcaaggcgcccgtctttccattcggaaaccatgtcaggtgccaactgtaatgaatcggccaacgccgggcgatcgaggcggtttgcgtattacgcagcggcgctaaagcggatgtgctgcatactggcttactatgttggcgtaactgatgagggtgttccagtgaagtgcttcatgtggcagggaaaaaaggctgcaccgggctcagctgaatatgtgatacgatactattccgcttctcgctcactgactcctaccgctcggtcgttcgactgcggcgagcggaacagtggcttaccccaacggggcggaattcgatcgatctggaaagatgctcatagaagatcttaa

SEQ ID NO: 58806 - DNA, 879 bp, Glycine max
  Peptide Sequence Number=SeqID_150491
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgtggccgagttcctgcagtacctggcgcagccggaaatcgccgccgaatggcaccagaagaccggctatctgccgatcaccaccgcggcttacgatctgaccaagcagcagggcttctacgacaagaacccgggggccgacgtcgccactcgccagatgctgaacaagccgccgttgccgttcaccaagggcctgcgcctcggcaacatgccgcagatccgcagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58807 - DNA, 151 bp, Glycine max
  Peptide Sequence Number=SeqID_150492
tggcgtctcctctctctcttccttctccattccacttccattcatcttccaagaagcaaaggaatccattgatgaagaagatcctaggcctacaagctcaaatggagcttacatcaccacgttttttaagaagtttagcaaatggacctag

SEQ ID NO: 58808 - DNA, 298 bp, Glycine max
  Peptide Sequence Number=SeqID_150493
atgacccctatttgtggaagttgtgcagtgaccaggttattaagagatgcattccagaccataagattgactcagtcctgcaattatgtcattcttccacaccaggtggccatcttggcatacagaggacatctcgcaaggtgcttgactgctgtttctattggcccaccatcttcaaggatgcgtggagaatttgtagcacttgtgagccttgtcagagagcaggcggctcactttcatgtagacaacaaaatgcctcaacaacccatgttattctgtgaggtgtttgatgtctggg

SEQ ID NO: 58809 - DNA, 374 bp, Glycine max
  Peptide Sequence Number=SeqID_150494
gtgctccagtggcttctgtttctatcagctgtccctcctgttcagctactgacggggtggtgcgtaacggcaaaagcaccgccggacatcagcgcaggcaggtcgacggtatcgataagcttgatccaccacacccgccgcgcttaatgcgccgctacagggcgcgtcccattcgccattcaggctgcgcaactgttgggaagggcgatcggtgcgggcctcttcgctattacgccagctggcgaaagggggatggcgaattggagctccaccgcggtggcggccgctctagaactagtggatcccccgggctgcaggaattcgatttcccaacagttgcgcagcctgaatggcgaatgggacgcgccctgtag

SEQ ID NO: 58810 - DNA, 402 bp, Glycine max
  Peptide Sequence Number=SeqID_150495
atgccaatctccccctgcagatgtatcgggatcgcgcccataagacgcccagtggaccggaagaagtccaacagggccctggggtttccagctcatgttgcgggcctctgtcagtccaacagggtgtccattcccccagcgagacacccagtggacccagagaagtccaacaggacccttgggttccaagctctaattacgggccctgtcagttctacggagtgcctcgcccccagcaagatcatcaggccccctactaatcgagatttcatcaagaattactgtgtccccaggcaggcgcagggcgaaacaccacagcagcctagggatggccggcaatgggcaacagacgcaccgccatcacctctagaattcacctcagctcatccacaaaaaggttag

SEQ ID NO: 58811 - DNA, 375 bp, Glycine max
  Peptide Sequence Number=SeqID_150496
catcttttggattataatgatcgccctgatcttagccctgaagatcgagatatgttgattgaagatctggtgagagagataacttcaatatggcagacggatgagcttaggcgttcaaaacccacaccagttgatgaagctagggcgggattgaatattgtggagcagtcactctggaaagctgttcctcattatttacgtcgagttagcagcgctttaaagaagcacacaggaaaaccacttccattgacttgcactccaataaagtttggatcgtggatgggaggtgatagagatggaaacccaaatgtgacagcaaaggtagcatcttcaaatatccattcatgctgtctgtacttttactatgtgatttaa

SEQ ID NO: 58812 - DNA, 246 bp, Glycine max
  Peptide Sequence Number=SeqID_150497
atgccagaaccacgcatcggagaagctaggttcgagtcctgtggaacacgggatctgcgtacaaggccttcgagaaatcatcagagtctcagggcaaaccccccggtgctcattgccacctgtaatgaggaagactctttcctgtacgggatgggaaaccgtgacttggacgagtctatgggtgagatgactactcaatgctggaaaggacgtgttgtctctggtatgggcatcacatcggcttag

SEQ ID NO: 58813 - DNA, 90 bp, Glycine max
  Peptide Sequence Number=SeqID_150498
atggtgacaacaacaaaggtagaattcttggagtgggccttaagcatagcctgcttagcgttagtcaactatgtgacaaaggctatctag

SEQ ID NO: 58814 - DNA, 730 bp, Glycine max
  Peptide Sequence Number=SeqID_150499
gtcgactctagaggatcccctcctcgccttcagaggactacacgcccttaccttccgaggactactcgtcctcacctttagaggactacatgccctcgccttcagagggctgcacgtcctctgcttcagaagactacacgtcctcaccttcagaggactacacgtcctctccttcagaggactacacgtcctcgcctttggtgggttgcacgccctcgcctttagaggactacacgtccttgcattcagaggactacacgtcctcaccttcagagggctgcacgccctcaccttcagaggactacacgtcctcgccttcagagggttgcatgccctcgccttcagagggctacatgtcctcctcctcagaggactacacgtcctcaccttcagaggactacacgcccttaccttccgaagcctacacgtcctcacctttagaggactagacgtcctccccataagaggactacacgtcctcaccttcagagggctgcacgcccttgccttcagagggctacacatcctcgccttcagaggactgcacgtccttgtcttcagagggctgcacatcctcgccttcagagggctgcacaccctcgccttcaaagggcaacacgtcctcaacttcaaagggctgcacaccctcacctttagagggctacgcgtcctcacttttagtgggctccacagctacaccttaggagaatttaaggtcctctgcccttaa

SEQ ID NO: 58815 - DNA, 698 bp, Glycine max
  Peptide Sequence Number=SeqID_150500
atggatattaacccccctacagctgtctgttggggcgcccgtggatccactcacgaggaagacatcttggtgagctgcccatcctctatgccttatgtggaagccgcagaggagtcattagaaaccgctttccagtcttttgaggtggtaagcatttcctccgtggactccttctctgggcaagcttgcctgtccgatgcagcagtaatgatggcccgagttatgttggggaccggttacgaacccggaatgggtttaggaaaagacaacggcggcataactagcctaataaatgccaaaggaaatcatgggaagtatggtttaggttataagcccactcgggcagatataaagagaagcatcgcgagaagaaagagtggtggtcaaagctcgcggttgagacaagaaagtgaaggaagcccgccctgccacataagtagaagctttataagcgcgggtctgggagacgaaggtcaagtggtcgcgatatacgaagatgatgttccgagtacattggatttggtacgaccatgccctcctgatttccagctaggaaattggcgagtggaggaacgccccggcatttacgcaacgagcataatatccgatgacgagtccctggaggtactaatacctgggacccgcttatcaactccgagcaagaaacgaatcaaacggaagatgaagggaacgaggat

SEQ ID NO: 58816 - DNA, 414 bp, Glycine max
  Peptide Sequence Number=SeqID_150501
gagattaacgccacttgtagaaggcgtaatcaggagagaattagaaatgttttgcaggacttagaggcagcagcaattccagaggaagaacctcaatcttctgaggcatcttctagttttcatatggcagaacattctcatttagatcctagtgaagactacatcatgaatgaagagccaagaaaagttactttggaagattattcaagttctaatgtgccacaatttttcaccagcattacacaaccagaagttcaagcacaaaccattacttatccaccatcattgattctattgattcagaataatttgtttcatggattaccaaataaagacccatatgcacacttagccacttacatagaaatatgcaatacgattaggttggctggagtgcctgaagatgcaatctaa

SEQ ID NO: 58817 - DNA, 192 bp, Glycine max
  Peptide Sequence Number=SeqID_150502
atggcgactccactggggatcacactcctaatgcggtggctaatcaagagtagtcttgaattggttgatacgcgatactacactcaaacgaggctttcctatggacgttgttggaccaggagtagtcccgtaatccgacaatatccggaagtggtcaatgactttgggaacttggtagaacccgtgatacag

SEQ ID NO: 58818 - DNA, 444 bp, Glycine max
  Peptide Sequence Number=SeqID_150503
atgcacggcacagacgtagttctggtgcaggtcgccgcccagcagcacgctgttgcgcggcgtgggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58819 - DNA, 384 bp, Glycine max
  Peptide Sequence Number=SeqID_150504
atgaaaagagatacaagccatcaaagtgtgtcattagagaataagacaggagattcaactgtgctgaagataggaaattcggctaaagttgtgataaaacaagacatgaagggaagaaggcataaatatgggtttaacaacaacaaacgtgagaaggcagagaagaaaagggtggtggatgatgaaactggcgacaaacatcaactggatgaagtcctaaggatgccatgtacatgtgttgtacattcaggaactaaagaattcaaaatagctagtaataagagggatttgtttttgggattttctgagcaccaagagcggctacgcaagaagcttgcacttgaggagggaaggatatttgcagctaatgaacaactttcttaa

SEQ ID NO: 58820 - DNA, 390 bp, Glycine max
  Peptide Sequence Number=SeqID_150505
atgacagatcttgtgagtgcggaagatgatgtaaatctccgcgtgtcaacgggcttgtcggccgtgattaaagaagggtgcagaatgaccataatttgtctctgcgtgccatcggacacaactgtgtctgaatggcaaagggtgcggaatgaccataattttgtctccgcatgtcatcgggcccgccgcctctggatgacaaaagggtgcagaatgaccataatttgtctctgcgtgccatcggacacgactgtgtctgaatggcaaaaggtgtccggaatgaccataatttgtctccgcatgtcatcgggcccgccgcctctggatgaaaaaagggtgcagaatgaccataatttgtctctgcgtgccatcgaacacgactgtgtctga

SEQ ID NO: 58821 - DNA, 519 bp, Glycine max
  Peptide Sequence Number=SeqID_150506
atgaagctttgcttctacatgtacctccacggaactacgtggctgttcttgtatggaaatggaatgggtctaactaccgaggggtgtcggggcttttggggagctctatccctggtgaaatgtattaccaaaggtttaggctttctaggaccttccttatctgtggattgcatgcatagatgtggttcttcatcccttttatcgctgacttccagccggccttggtctatcatttgttgcaacaggtctcctaccgctaaacatgcttccatgctatgtggcgcgccgggatgcatcaaacaaaaacccttctcgtgcccaccgcggggaatcacgccccctcttttggagggcctcatagataaaccttatgggggtcgttacgtccttcaaatgtttggacctgcacggcctactcgcctcgatggcattaacagctccccctccatgattggcaagcgggtttgtctttacgttgggccggtcctcttgaaatgtcagccatccggcttctattaa

SEQ ID NO: 58822 - DNA, 135 bp, Glycine max
  Peptide Sequence Number=SeqID_150507
atgggtgtcaagcacctcacaaggaccaaagaaaggtcgcatgtcatcaagcaaaggtccccggacgaaattagggaagcttccctgctatggagagctaaattctcagttggttcttcctatggggtacttgat

SEQ ID NO: 58823 - DNA, 612 bp, Glycine max
  Peptide Sequence Number=SeqID_150508
atggtgaaagttggaacctcttacgtgccgatcaacgtctcattttcgccaaaagttggcccagggcttcccggtatcaacagggacaccaggatttatttgaaaccacattatcctgaaactactgaaacggggtggtgttatccgctcacaatcggcaacaagcaaccgccggacatagcgaagtgtaaagcctggggtcaacggcggatgtgtgcaacggcttactatgttggcgtaactgagagggtgttcccagtgaagtgcgttcgtggcaggagaaaaaaggcgacggcgtcagcagaatatgtgatacgactatattccgcgaattcctcgtctgagctcctaccgctcggtcgtcatgcggcgagcggaaatggcttacaacggggcggaattcgatctggcaagatggaagatatagacattgggaaggagagggccgcggcaaaccgttttcctaacataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccg

SEQ ID NO: 58824 - DNA, 399 bp, Glycine max
  Peptide Sequence Number=SeqID_150509
atgaatgctaaccgaaatagaaattctatcaggggtgtattcattgatggtttatggactgacgacccacacaaggtgaaggaagaggtgaaatcctttttcttccataggtgccaagaaccaattggtcagcaacccaagattgatggaatcaggtttcaaactgttaatctacagcagaataacgagcttctggcacctttcatggatgaagaaattcagaaggcaatttttaaagctgcagtgaagttttttatgaaggaaggcaattcacaaaaggattgcatggatttaatggaaatcgaaaatggtgagctgtggaccagagttctgaaatcaaaatatggtggatggaggaaccttgaagaaataggaaactcagcaaagcaatctgtttag

SEQ ID NO: 58825 - DNA, 372 bp, Glycine max
  Peptide Sequence Number=SeqID_150510
atgactatgcaaaacgtgcagtttcaacaagagaccagagcctcccttcagagcttaactaagcagatgggacaattggctacacagttaaatcaacaacagtcccagaattctgaccgattaccttctcaatctgtccaaaatccaaaaaatgtgagtgtcattgcattgaggtcgggaaagcagtgtcaaggacctcaacctgtagcatcttcctcatccgcaaatgaacctgcccaacttcactctactccagaaaaagatgatgacaaaaatttaaagaaagcagcatatccctcttccattccctccaagagcaattttcaacaaaaaaatggaagaggcagagaaggagatctcggaaacatttag

SEQ ID NO: 58826 - DNA, 815 bp, Glycine max
  Peptide Sequence Number=SeqID_150511
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaatcgtgaatgggagttcattcgtgatttggctctctacttgtctgctgttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58827 - DNA, 180 bp, Glycine max
  Peptide Sequence Number=SeqID_150512
atgggtgttagacaactaatgattgaagttccacaagctgttgaaagtgatcatgtagatcaagttgtttgtgaggaacaatgtgatgatattgaacaaactggtgaagaatcggttaaacaagttcctcagcaggatgaccaagcagcattaagaagatctactagagtaaaaaggata

SEQ ID NO: 58828 - DNA, 459 bp, Glycine max
  Peptide Sequence Number=SeqID_150513
atggagagaagtatgatagatgttgccagtggtggagcccttggagacatgacccctgctgaagccagaaatttaattgagaagatggcttcaaactcccagcaatttagtgccagaagtgatgctattgtcattagagtagtgcatgaagtagccacgaattcatcttcatcagccgagactaagaagcttgaagccgtgaatcaaaaatctgcacctgtcgccagactctgtggtttatgctcctctgccgaccaccgcacagacctttgcccttctgtgcaacaatctgaagcaattgaacagcctgaagcttatgctgcaaacatctacaatagacctcctcaacctcaacagcaaaatcagccacaacagaacagttatgacctctccagcaacaggtacagtcccgggtggaggaatcatcccaaccttagatggtcggatccttcacaatag

SEQ ID NO: 58829 - DNA, 558 bp, Glycine max
  Peptide Sequence Number=SeqID_150514
atggccccaaggaagcttgcctcaaagagatccaggaaggataaagcggctgaaggaaccagttccgctcccaaatatgacagccaccgttttaggagcgctgagcaccagcagcgcttcgaggccatcaagggatggtcatttctccaggagcaatgcgtccaactcagggacgacgagtataccgacttccaggaggagatagttcgctggcggtgggcttcactggttacccccatggcaaagttcgacccagacatagtcctcgaattttatgccaatgcttggcctacagaggagggcgtgcgagatatgcgatcttgggtgaggggtcagtggatcccgtttgatgcggatgctctcagccagttcctgggataccctttagtgctggaggagggccaggaatgcgagtatggccagagaaggaaccggtccgacgggtttgatgaggaggccatcgcccagttgctatgtataccggggcaggattttgcccggactgctgctggaagatgtcattggggccatcgcccagcaggcttacacgatccgtga

SEQ ID NO: 58830 - DNA, 928 bp, Glycine max
  Peptide Sequence Number=SeqID_150515
tattatgaccagcccctaaggtgcttcacatttgaggacttccagctagtgccgactgtgatagagtttgaagaaatcctgcgatgcccactgggaggaaggaagccatatcttttctctgggttctatccctccacgacaagagttgccaaggtagtgaaaatctcagcacaagagttggaccgtgtaaagcaaaacaggaatggggtagtcggagtaccaaggaagtttttggagaaagggcgaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccgaggatgtgaaaagagcagcgcaagaattgtttgttgtgcactggctctctatgtgtgggctgggtttcacaccttttttctccaagaaggtaggcccgtctatccgctacaaggtcaccgctcgattctatcttcatgcgaaggatgtcccatgagaggagtgccatcagacgaaagcatcacgcctttcatcgcatggggtttcagtgaccacaacgcaagggacaaagagcttaggggaagcagtaatgggatcatcggcggctatcataagtggctgagagtccggacacaaggattggattggctcccaaatctaaagactatgagagacaatgaggttaaagcttcggaagaaagtgatgaggtacaagccctaaaggcaaagcttgaaagagcccgggtagtcaaagagaagttcaagtccatagccatcaaagtgaaaggaatcatcacgggtcaaaggcatgatcttgaaggacgagctaaag

SEQ ID NO: 58831 - DNA, 570 bp, Glycine max
  Peptide Sequence Number=SeqID_150516
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaagacataggtcacatcttagacctcactcccatagaagagaaaaggaaagaaagcctcaagaggctaacattaaactctcttacttcgatgggaaggacaatgtagaggctaacttagattgggaaataagggtagagcaacaacttaaaaagaagtctacttcaaaatcttatggctctcactcttatcgaaagaaagaccaaggtcaaggcatcttaggggtgacaccttctaagcccaaagatgataaggggaagacaatagaaaagcaagcccctaag

SEQ ID NO: 58832 - DNA, 369 bp, Glycine max
  Peptide Sequence Number=SeqID_150517
atgtcccaaaactccttcatgatatgcacatgttgcgttcgagtcgaatcctcagaaaaatggaggttgaggaaccttggaaagggttatggctaccattgcattatcaagttgatatgggagcaagttagcataggacacaggaattggggtgaattctataggatttttcgctgcaaaattcatttcttggttggtgttttggtttgcgctttggcattggatgcgcggtcagcaaactttgtggatgatttggggatagcctttgtggatgaccgggtggtaggaatggcagcctcaacatggattccttcatcattctcatcctcttcatttgccccagttttctcattcatcaaagcaggatga

SEQ ID NO: 58833 - DNA, 316 bp, Glycine max
  Peptide Sequence Number=SeqID_150518
atggagtatagacgagaatcgtcatcacggaaagggcaagacggacgaaatcagtgtcttatctttgctttcctcttatctccgatgagaggcccacttgggccttctagattcttcctccagaaggctgttgcttctggaggaagcaaccttgctcgcctgggcgagctgggtggcaagctcctcccctattttgctatatatagggggaggagtgaagggagaaggggttcagccttcttggcacttcttatcctctcgaaattgctgaggaaaattatttccgtgaagaaaatccaagccgagtcttcaacgg

SEQ ID NO: 58834 - DNA, 420 bp, Glycine max
  Peptide Sequence Number=SeqID_150519
gtcgtaggcaacgctccagcctttgtagatgagctgaggggctctggaggtggcggcggtgcgtctgttgcccgctgccggccatccccagtacttcttgatgaaagctcagttagtatggggtctgatgaccttgctgggggcgacaggcacttcgtagaactgacggatgcccgtaatcagagctggaaaccccaggaccctgttggacttctccgggtccactggggggacgggcaccctgtaggactgacagaggcccgtaaccaaagctggaaaccccagggccctgttagactcctccgggtccactggttgagccacgtgcatacttacctatgtcatgacggcacagaccaactgatactttcgcacggggagatcggcattgtggtcgctaggcagaatgttgctaagtag

SEQ ID NO: 58835 - DNA, 883 bp, Glycine max
  Peptide Sequence Number=SeqID_150520
tacatggcctgaatcaggccgtgatgtctggcctccggatatgaattatccttccggtgtccgtgtttatgatgcgtacaatcctgaagccagaaatatttattggaaatacctgaacaaaggcattttcagcctgggagtagattcctggtggatggactcaacagaacctgatcatctcagccagaaagcggaagatctggatactaaaacctatcttggctcattcagaaaagtaagaaatgcttatccgctgatgacagtaggtggtgtttacaatcatcagcgtgaaaccaccggtgataaaagggtttttattttaacaaggtcagcatttgcaggccagcagcgatatgccgccaacacctggtccggagatgtcaattcttcctgggaaacattgcgcaaacaggtaccggcaggattgaatttcagtcttacaggaaatccgaatttcaactctgacatcggcggtttctttgctggtacttacaaaagaaatggaggttcaaaaaatccaatgttccaggaactgtatgtccgatggctgcagtatggaacctttacaccaatgatgcgctctcatggaaccgatgttgcgagagaaatttatcagtttggaaataaaggagacattgtgtatgatgcgatagaaaaattcatcagactgcgttacagtatgttaccttatatctattctgtttcccatgatgtttcaaaaaacgggtcaagctttatgagagccctttccatggattttccttcagacaaaaaaacatgggatatgaataacgaatatctttttggaaaatcattgttggtagcacctgttctcaatgctcaatatacccctgaaaaagcagttaaactgacgaaaatgaag

SEQ ID NO: 58836 - DNA, 357 bp, Glycine max
  Peptide Sequence Number=SeqID_150521
atggtgaaagttggaacctcttacgtgccgatcaacgtctcattttcgaaagttggcccaagggcttcccgctgttctcctgttcagctactgacggggtggtgtccgtcaattcggcaaaagcataccgagccggaacatcagcgtggcaagtgtaagcctggggtgctaatgacgctgacgctaactcaccacttaattgccttgcgctcaactgcgccgctttccacagggaaacctgtcccattcgctgcattcaggctgacgccaactgtgcgcgaagggcgatcggcggctttgctattgccagctggcgctaaagggggatgtgtaactggcttactatgttggcactga

SEQ ID NO: 58837 - DNA, 189 bp, Glycine max
  Peptide Sequence Number=SeqID_150522
atggcaatttgtgcccatgttggatttcctaatctattcttgacattaacgtgtaatccagcatggccagaaatacaacgacaagttgcaaagtcaaatcttacagctcatgattgccctgatgttgtgtcacggttgtttacaccattgagtggcaaaaaagaggattgcctcatgctcatatcttaa

SEQ ID NO: 58838 - DNA, 537 bp, Glycine max
  Peptide Sequence Number=SeqID_150523
atgaaaagtgaaaacaaaacagagaagagaacaatagtgactttgactcacttcatcacgcacttcaccgtcgcggccacggactttactgtcgccatgaccaccatgcactcgcacgggcgcggaagaaacacgcactcagtgtcttggccacttgtacttccatttcacacagtcgtcgtgactaccatgctcccccccccccccccccatgtgcaatttttggtaccccaaaatgctttgagtatgcatgtatgtaaatttagccaaggagatgtgtgtgatgtaagtaacaaatacaccttggaagtacgtgtaaataatctaggaatggccccgaggaagcttgcctcaaagaggtccaggaaggaccaggcggccgaaggaactagttccgctcccggagtacgacagtcacccgctttaggagcgctgtacaccagcagcgcttcgaagccatcaagggatggtcgtttctccgggagcgacgcgtccagctcagggacgacgagtatactgattttcaggaggaaatag

SEQ ID NO: 58839 - DNA, 330 bp, Glycine max
  Peptide Sequence Number=SeqID_150524
atgccctcacctttagaggatttgcacgtccttgccatcataggactacactccctcgccttcgaaaggcgacacgtcttgaacttcagagggctacacgccctcgcctttagaggactatgcgtcctcactttcagggccagtagtttccttttaacggttcctgggccaccccctgatattggaggagggccaactgtgcgagcacaaccagagagggaggctattacacagctactatgcataccggggcaagatttcattcgtgccgctgtaaagagacgagtgcggatcatgcgcaccaacatgaccactcttacacagatatag

SEQ ID NO: 58840 - DNA, 408 bp, Glycine max
  Peptide Sequence Number=SeqID_150525
atgggtgaagtagagaagatacaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggatgaccccatgatgtgcagattcaaaacaagcacgccttcccgccatatggtttgcctcccaaactatacaccacccaatgtggcgtacactcccaataagaatgtcaataactccactcctatacccattgagagccaacaaccccgaactgatcatgcacatgtctcttaa

SEQ ID NO: 58841 - DNA, 594 bp, Glycine max
  Peptide Sequence Number=SeqID_150526
gataatgtagaggcttacttagattgggaaataagggtagagcaaaaacttaaaagaaagcctactttaaaatcttatggctattattcttatccaaagaaagaccaaggtctaggcatcttaggggcagcaccttctaagtccaatgatgataaggggaagacaatagaaaagcaaccccctaaggttagtatgcaagaaaagactagctccataaagtgctttaaatgtcttggaagaggacacattacttctcaatgctccaccaagaaaaccatgattatgaggagccaagacatttatagtagccaagatgaggctactacttcaccttcctctagtgaaagtgaagaagcaaaaggggaagaatctagtgaagaaatctacccccaagaagaaggaaaacctttaatgacacttgttagcattgccacacctcttaggcttgagtttattcctcaagtaaaggagttattggatgaagctttggttcgcaagagcttaaatccttgtgctttgttggtgcccaaaataggggttcccatgaaccctaagagaataaaggtcattcctgagtggcccgctccaccaagt

SEQ ID NO: 58842 - DNA, 210 bp, Glycine max
  Peptide Sequence Number=SeqID_150527
atgagtcctcccaaaaatgcacgtaaaggagctgcactgaagatgacatggttgttaagcatgttgcgcgcaccatttcctgaagaaccaacaatgcaccaactacaatgcagatggagtggtggtagattagaatatagggccacacctcatggtgacttggtcggatataggtctcgtatagatcatatggagagtcatgaggtataa

SEQ ID NO: 58843 - DNA, 174 bp, Glycine max
  Peptide Sequence Number=SeqID_150528
atgtgctggctgagacctcttccaagaggtgcaacacatatgtcatcacctgatgcaatcctccctaggaagggaccaatcacaagaaccatgagcaagaggctccaagaagattgggctagagctgctgaagaaggccctagggttctcatgaaccttagggtagatttctga

SEQ ID NO: 58844 - DNA, 576 bp, Glycine max
  Peptide Sequence Number=SeqID_150529
atggccgcaatgatggaggccatgatgagcttgaagaagataatggaagccaatgcggttgcaatttccgctaccagcgttgttgctaaggtgaacccgacgtccccatccggcatcaaccaaatgaatcatccaacctcagatatggtaggcaaagatttgggaagtacgggcggcccccatgatgtgcaaattcaaaacgagcacgccttcccgccatatggcttgcctctcaactatacgccacccaatgtggcgtacactcccaataagaatacacatggaattccccatcacaatctagccgacttcgagccttggctcggatatgccactgaagggcaagcagttggtggtataccccttgaaaacactttggaaggccctcagtatcacccccagctacacctcttgcattccacaacaagtaaaaaccctcatgctatggtagaaatgggaaagttggatcatctagaggaaaggctcagggccattgaaggaggtgaagattatgcctttgctaacctaaaaaagttgttcctagaacccaatatcatcaccccttccaagttcaag

SEQ ID NO: 58845 - DNA, 390 bp, Glycine max
  Peptide Sequence Number=SeqID_150530
atgcccaagtatgtacgcgtcggatatatcatacatagttggggtattaggaagatatttaagccatccaggaatggatcattggaaagtagccaaaagagttatgaggtatttgtaagagacaaagtgattatatgctccaacaagaggtcagataagttgagactttctactgggtattctgactcggattttgcaggatgcctagatagtttgagatccacttcaggttacattttcatgttagccggtggtgacggtttctcggcccaatgccaagcaaacccttactacttctccactatggtggccagaaaatttgtggcatgctatgagagaccatcaaatcagaatatggtttgcaaactgacaaaattgtcacaggactaa

SEQ ID NO: 58846 - DNA, 796 bp, Glycine max
  misc_feature (55)..(56): n is a, c, g, or t
  Peptide Sequence Number=SeqID_150531
atgaggtcagcgttaccaagtttcacaacaaaggttgcatgcatctgcatccctnnaaatcatgtggacccttgggtactagtacctatcacctttagaggactatatgtcctcgccatcagaggactgcacatccttgcctacagagggctgcacgcccttgcctttagagggctacgcgtcctcattttcattcctgggccaccccctgatattagagggcgaccaactgtgcgagcacatccagagagggaggctatcacgcatctactatgcataccggggcaagatttcacccgtgccgctgcaaaaagacgagtgtggatcatgcgcaccaacatgaccacttttacatggatatggatgatgttgctatttagtaacattctgcccggcgaccacaatgccaatctccccctgcagatgtatcggaatcgcacccacaaagacactccagtggacccggagaagttcaacagggccctggggtttccagctctggttacgggcctctgtaatcctacagggtgcccgtttcccccgacaaggtcacgtcatcatgacatagggtcttggagttgccaagctctaattacgggcctctgtcagttctacgaagtgcctgtcgcccccagcaagatcatcaggccccctactaatcgagctttcatcaagaagtactgcatccccaggcaggcgcatggcgaaaaaccacagcatcctggggatggccggcagcgggcaacagacgcaccgccatcagttctagagttcacctcagctcatccacaaaaag

SEQ ID NO: 58847 - DNA, 330 bp, Glycine max
  Peptide Sequence Number=SeqID_150532
atgggctcatacttagcccatgggcccgaaatctaccctaaggctcatgagaaccctaaggccttctcttgcatctctggcccaatcttcttggagccttctatccaatgcccttgggggctaagctctagcttctataggaatcttctaaaggaagcttctcaaggaagtttctcaagaaagcttctcaaggaagcttttcaaggagataagcctctagcttctcaaggaagcttcaaaaagaagcttctcaaggaagtttctcaaggaagcttctcaaggatgtttctcaaggaagtttctcaaggaagctacctaggctataaatag

SEQ ID NO: 58848 - DNA, 420 bp, Glycine max
  Peptide Sequence Number=SeqID_150533
atgggatcaagtcaaaagccttcgcttaaaaagaggttccatcaagtcaaaattaagagcttagaggtcactagtttacgagagttggggcaattaatgggtcaacttcaacagcaagccttccgtaaagcctatggtgagatttgggacctagataggctagtgccgactgtggaagagtttgaagaaatcctgggatgcccactgggaggaaggaagccatatcttttctttgggttctatccctccacgacaagagttgccaaggtagtgaaaatctcagcacaagagttggacccatgtaaagcaaaacagaaatggagtagtcggagtaccaaggaagtgtttggaggaaagggcaaaggccttggcaaaatcaaggcgaatgggcttcttttattgacatcttggcgcttttga

SEQ ID NO: 58849 - DNA, 92 bp, Glycine max
  Peptide Sequence Number=SeqID_150534
gtctgatttcctcttcgatgaagggtacgtaggagcaaaagcgaaagggcacgttgcgacagttgacgactccactagggatctttttgtga

SEQ ID NO: 58850 - DNA, 845 bp, Glycine max
  Peptide Sequence Number=SeqID_150535
gccacatcagcaaatactgtaggctaaaaaagaagttaagaaaccttaacctagaacccgcaattgaagagcaaataaacaatttgctcatagaaacctcggaggaagaaacagaaacttcatcctccgtgctttccgatgaaaacctaaacttaatccaacaagatgaccaactatcatcaacagatgatgatgatgggcaaatcaatactctaacgagagaacaggatctcttgtttgaagcaatcaattccatacctgacccccaggaaaagaaggtttttctggaaaaactcgagaaaacgttagaggtaaaacctagacaaaaggattttatcacaaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttaaggaagatagtgattctgaaagtaccaacaacagtgaggaaaaccaaccagaaaatttagaagatgatatgtttatgggattaatcaacaagattaaaatccaaaaattttacataaacataaaaataattattaatgatttcgttttagaaacaatggccctatttgacacagggactgattcaaactgcattttagcaggattaattcctacaaaattctttgagaaaacctcagaaaaattaagtacggcaaacggctcaaaattaaaaattaattttaagctatcaaatgcaatcattgaaaaccaaggtcttaagattaacacaaactttcttctg

SEQ ID NO: 58851 - DNA, 300 bp, Glycine max
  Peptide Sequence Number=SeqID_150536
atgggcttgggaaagaataatgatggcatggccaacctagtgaacatcaaggaaaaccgtggaaattttgggctaggctataagcccacgcggactgatgtgagaataagcatcgtagaaaggagggaccctgctgtcgattttgaacgagaagtgaatcgtcttgaggttgaagaagaagaaggtatgcaatttccccccaagctagaaaggatggtcgctcaggaagaccgagaggtgaagttgtaccaagaagaaacgacagtcgtaaacttaggtgttggctatgaaaagaaagag

SEQ ID NO: 58852 - DNA, 297 bp, Glycine max
  Peptide Sequence Number=SeqID_150537
gtccccagtggagtcgccaactgtcgcaatgtgcccttcgcgggcgagcgaaggagaggctcacaggtgcgctttccaaaggaggaaagatgcgcggagtcgccaccaacgtttattcgtggcaaacgtcggaaaaaccgaaggaaaccggtcgaaatgaaaattctaagttcgggagttgtatttacatttgaggaaggtattagcacctctcacgttgataaaagcggggctcttgctcctacgtaccctccatcgaagaggaaatcagacctacgtagttcttcttatgcgtga

SEQ ID NO: 58853 - DNA, 330 bp, Glycine max
  Peptide Sequence Number=SeqID_150538
gtacatgatgaattcggttataacagtattgtatttcaatggaaggaaaaggatgtggctggtggttcaatgtttcattctgcaaattcccttacatcatgtggaaattatgtatctaatgatgacacacaaccgccaacaaatatgagcaatttaaatcttgacgaagatgatggtcatgatgattatcttgtgtctaactcatacgttgaagagtcgttagatgaagatgacagtgttgacggtatatcagatacagacaatgaagtccccgagatgattccaccagtaagaattgttcacccagcagaaggtatgatttcctcttaa

SEQ ID NO: 58854 - DNA, 135 bp, Glycine max
  Peptide Sequence Number=SeqID_150539
atgccacctatagtagtcatgactcttgaaggcataggtcacatcttagacctcactcctataggagaaaaaaggaaagaaagcctcaagaggctaacattaacctcccatacttccatgggaaggacaatgtag

SEQ ID NO: 58855 - DNA, 396 bp, Glycine max
  Peptide Sequence Number=SeqID_150540
atgaagaacggagaaaagagggaggtggttgttgcccaactcgcccaggcgagcagggttgcttccaccaaaaggcactgccttcttttggaaccctcaggaaggcccaagtgggcttggttgctatttgcacccttcttttcattaaatacaccccccttttgtgttttttttattgatttctttccgaaacgttgtggaactttacggattatgcaacgacacctattttctttcttgaatgttgcaaaactttacggattacgcaactatgctcgttttccttccggaatgttgcgaaactttatggattacgcatggatgcttgtttcgagggttccaaagggagcaaacaaggttcaaggactgaccgcaagtactcccggaaaaaattag

SEQ ID NO: 58856 - DNA, 51 bp, Glycine max
  Peptide Sequence Number=SeqID_150541
atggacacccgtctccgtgtgattggtgatcccatgaatggagttcaacgg

SEQ ID NO: 58857 - DNA, 405 bp, Glycine max
  Peptide Sequence Number=SeqID_150542
atggcggttccaaaaaaacgaaaggtcagattagggtttcgttctctaccgaaaccgcaagccaagttggaagatttcgcttcggttgaagggttcctctcggtgtggagaacaacgatgagatgctctcgggaacggaagcttatagcatactccagacatcttctcaaagatcccaacggtcagatcatggacaagtgtcttttgaagttacaaaccaaatttcgagaagatccaacggttaaagaagtctgggaagcgtttttatcaaggcagattcatgtagctttatctaaaagcttcattaagaggcttcctccaggagcttcattaagaggcttcctccagaagcttcctcgtggcttctttgagaatctttctcaagagacttctttgagaaaatag

SEQ ID NO: 58858 - DNA, 531 bp, Glycine max
  Peptide Sequence Number=SeqID_150543
atggagtcgccaactgtcgcaacctaccctttggcgggagggcgacgtgagactcacgggtgcatcttccaagggaggaaaatgcacagagtcaccaccaacgtttatttgaggaaaacgtcggaaaaaccggaaagatgtggtctacgaactttaatcgtgaaaggttctagagttgtttttatgcacggggaataccgaagaacgaagaagaacgaacaaagaatgatgaagaacggtgaagaatctccacgaaatcgctcacgaaaacgtctcggaagcacctcggcttggatttttttcacggaaacaatttttctcacaaatttcgagagaattctcaataccaaaagggctggacatctttgctctaccctctttcccttatttataggagaaaaaagggaggtggttgccgcccacctcgccgaggtgagcagggttgcttccaccaaaaggcaccgccttctgttggaaccctcaggaaagcccaagtgggcctggtttctatttgcacccccttttcactaa

SEQ ID NO: 58859 - DNA, 633 bp, Glycine max
  Peptide Sequence Number=SeqID_150544
atgaaagccgatatgccggctttgaaagagcaaatggcttccatgatggaggccatgttagggatgagacaactcatggagaataacgtggccaccgctaccgctgttagtttggctgtcgaagcagacccaactctcccagctaccgcacaccatcctctcccaaacgtggtaggacgagaaaggagcacacaggggcacatcagcaacccccatttgggatacaaccgtgtgacttacccttatggattaccacctaattacacgccaccagtcatgcgtgatgacgcgagtcatgtcccttcccccgtccttgaaggggagcctcctcgacagtcagatgaggttcacgaggatcatagagagtatgcccaaggagatgtcgatttctaccccccggtccccgtcgagggtccggcacccaacatactgcctcagcccaacctcccagcacagccaatattcttgtccacggagggaccaccctcggcggcagaagaaagaaggaaactcgatctcatcgaagagagattgagagctgttgaaggctattggcgactatcggttcacggacatggcggatctttgcttggtaccagacgtcgtcatccccccaaaattcaaggtacctga

SEQ ID NO: 58860 - DNA, 261 bp, Glycine max
  Peptide Sequence Number=SeqID_150545
atggtgaggctcatgaaacaggccaatgtattcccattgaagaaaacactcaagaagttcactgtatgggaaatcaacagcgacaagggtatactcaaggaggattttcaggcttccagaagggtccttaaaatcaacaaggacagtggaggtcacaccctggcaatcagttcaacaaagaccaggaggactactaagctggaggagactttgactcagtttatgcagaaaagaatcccaaggaggaatgcaaagctgtga

SEQ ID NO: 58861 - DNA, 240 bp, Glycine max
  Peptide Sequence Number=SeqID_150546
atggtggtggagaaggagcctgcaacactcgcccaggcaaaatttgactcgcctgggcaagctgatccagctcaaattttactgcttcatttaaaatatcatatctcatactcaagatgttatattgcaaataccaacagtcagaatctgaaaaatcaggttgtaagcctacattccaaattagaaagcgatccaacgggtaacgaatccaggattgcggttttagtggaacatgtttaa

SEQ ID NO: 58862 - DNA, 441 bp, Glycine max
  Peptide Sequence Number=SeqID_150547
atgaatacatcatcatcgaatgtgtctgatgctggcccatcaaatttacatgtaccgagaattgtgcatcgatttgacacgtcattccatgttgagcagaacgtcattgaggttccttttgcttatcatagacaatggtccccaaattatccaaattatgtgttattcgactacgaaggagacaaacactttataaagcttcataaatatggtaaccaattcttttttggcgatggactcaaggaacttaggagaacccatggcattcacgaaagtgttctcatgcgttttgttggaagggacaaaaatactactttcagtgtggacgttgtgggacctctacaccaaagggcaggcccaaccataaggcaccatgtttttaccattgatgtctctgaagatatgatacaacacaattatcaattggtaggtctttcttaa

SEQ ID NO: 58863 - DNA, 465 bp, Glycine max
  Peptide Sequence Number=SeqID_150548
acttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcattagaagtggcgtcatccaaacctccgtagcctgtatcaaacgatccactcctactcagacttatcaaggtaatccttgtggcgtctatccagacttatcttccttcactggaagtggcgtctacccagacttatcttccttcaccggaagtggcgtctaccctgacttatcttccttcaccggaagtggcgtctacccggacttatcttccttcactggaagtggcatctaccatgacttatcttccttcactggaagtggcgtcatccaaatatccgtagcctgtatcaagcgatccgccccgtaa

SEQ ID NO: 58864 - DNA, 658 bp, Glycine max
  Peptide Sequence Number=SeqID_150549
ggttataggcagagctcggggtagacaggatgatcatcatgcagatgatgttcctcagtggcgtaggcctaccgcacccgcacataggcaacgggaagctgcccctgttgttgaggatgttcttgagatgactcaggatgttgctgagatgactgaggacgtaccagcatctggtgtagagggcttagctagtgacggtgttgagggcttagttggtgatggtgctgagggattagctgctgatgatgctgagggattcccaggtgggccacgtgacccatcagtgctgacttcgtttactgagcatgttgcacatagcatatggactagagaggttgagaaatttgggaggccaattcctaagattgaagggatagtcgctgccacaggattaactcctttgatcgcgtgttcagtagtcaccggcaatccaggagttatatccgcttttgtcaagaggtggcacaaggagactagcagcttccatcttccagtaggagagctgaccatcacactgaatgatgtggcgtcacttctccatctgccgatcacaggcgccttccacagcttcaagcctctacatgtggatgaggcagtcatcatgttggtggagttgcttgagatctcgggtgaggaggctagagctgagactgtatag

SEQ ID NO: 58865 - DNA, 480 bp, Glycine max
  Peptide Sequence Number=SeqID_150550
atgaaaaatcatgaaattcattttggtaagagctactcaatagaaaattttcacgggggaccaaagttacaaccttactatcaaaatgaagcagaaaaaggttccaatctggataaattgctgatgcaattcatggaagcaactaaatcaactcaacgagcactccaaagtatagaaatccagaaaagtacggttgaagctcaagagaaaagccctgtaaaagagcatgtgtcaagagaaaaagatgaggaacaagtacaacaacaatgggagaagtactcaacagtagaaaaacagctagaaaatattctccaaatcaataaccttcctcatcaactgattatcaagaaaggaaggcaaggagaacatgaggaaaccttaagtgccattctttctttaatcactaacacctttcttgaaatgatttggaatgtacttccagactatatgaagttcatggaatttctagctaaaaggtga

SEQ ID NO: 58866 - DNA, 549 bp, Glycine max
  Peptide Sequence Number=SeqID_150551
atgtgctgcaaggcgattaagttgggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtctctactagcccggattctgacttaaaggcgttcagtcataatccaacgcacggtagcttcgcgccactggcttttcaaccaagcgcgatgaccaattgtgcgaatcaacgggtccttcttcgtactaggttgaattactattgcgacactgtcatcagtaggggaaatactaacctgtctcacgacggtctaaacccagctcacgttccctattggtgggggaacaatccaacacttggtgaattctgcttcccaatgataggagagagctga

SEQ ID NO: 58867 - DNA, 177 bp, Glycine max
  Peptide Sequence Number=SeqID_150552
gttttgggttagagtgtggtgtcaggcttccttatgtggtggctcgtggtccacaggtgtacccctcgaatctccccaacattagagtcgatggtcgtgttgtgactggatctagcttcttacattgggatgagttatgcgacaagttactaggggaagtctctccagaaaatgcac

SEQ ID NO: 58868 - DNA, 172 bp, Glycine max
  Peptide Sequence Number=SeqID_150553
atgtaccctaaggctcataagaaccctagggccttctcttgcatctttggcccaatctacttggagtttttctatccaatgcccttgcggggtaggattgcatcacagagtaacaggccactggtaatcgattaccagttatgtgtaatcgattacacagtgcatattgcag

SEQ ID NO: 58869 - DNA, 534 bp, Glycine max
  Peptide Sequence Number=SeqID_150554
atgccgactcgccgcgaccttatcggtgctgcctccacgcttgcactgagcagcctcttgggcggatgcgcccctgcccgttccaaaggagaaccccccatgtcaaacgcctcaaacaccacgcccgacatcattttccacaatggccgcatcacgaccctggaccgcgccaagccgctggccagcgccgtggcgatcaaagacggccgcttcgtcgcggtcggcaccgacgccgaggtcatggcgctggccgggccggccacccggcgcgtcgatctcaagcagcgcggcgccctgcccggcctgttcgacaaccacacgcacgtggtgcgcggcggcctgaactacaacatggaactgcgctgggacggcgtgcgctcgctggccgacgccatggcgatgctcaagcgccaggtcgccatcacgccggcgccgcaatgggtgcgggtggtgggcgggttcaccgagcaccagttcgccgagaagcgcctgccgacgatcgaggagatcaacgccatcgcgcccgacacgccg

SEQ ID NO: 58870 - DNA, 1093 bp, Glycine max
  Peptide Sequence Number=SeqID_150555
gttccccgaacccagctgtcgtgcgtgtttcttccccattcccgttttcgtgagagtttcccccatgagcaatgcacagcgcagtttccacgtcgccgtcgtcagtgccaccggtgcggtcggcgagaccatgttgtcgatcctggccgagcgtgatttcccggtcggtaccctgagcgttctcgcttccgagcgttcggccggcggcgagatcgagttcaacggccagaaggtcaaggtccaggacctggctacctttgatccgagcggcgtcgagatcgccctgttctcggccggcggcagcgtgtccaaggaatacgcgccgaagttcgcagcagcgggcgctgtggtgatcgacaactcctcggccttccgttacgacgatgacgtgccgctggtggtgtccgaggtcaacccggagcaggtcgccaaccgtccgcgcggcatcatcgccaacccgaactgctcgaccatgcagatgctggtggcgttggcgccgctgcaccgcaagtacggcatcgagcgcatcaacgtctccacctaccagtcggtgtccggcggcggccgttcggcaaccgaggagctgggcaagcagaccggccagctgctgagcttccaggagatcgatccgcagcgcttcccggtgcagatcgccttcaacctgattccgcacatcgacgacttccaggacaacggcttcaccaaggaagagatgaagctgatctgggagacccgcaagattctcggcgacgacagcatcctggtgaacccgactgcggtgcgtgtgccggtgttctacggccactccgagtcggtggcgatcgagacccgcgacaaggtgaccgtggccgaggcgcgcgcgctgctggagcagtcgccgggcatcgaagtggtggaccgccatgaagccggtggctacccgaccccggtcacccacgcctcgggcaccgacgcggtctatgtcggccgcatccgcgaggacctgtcgcacccgcgcggcctgaacctgtggatcgtgtcggacaacgtgcgcaagggtgctgccctgaatgccgtgcagctggccgagctggtcgccgccgagcagcgctga

SEQ ID NO: 58871 - DNA, 93 bp, Glycine max
  Peptide Sequence Number=SeqID_150556
atgaatagcagaaaccaacccaaggtacttaggaacggatgcaattggggatggggtcatgaccgactgatcgtcgccccttctctgcgctaa

SEQ ID NO: 58872 - DNA, 252 bp, Glycine max
  Peptide Sequence Number=SeqID_150557
atgacaacacaaacgagttgtcgcaacgtgcccttcgcgggcgagcgaaggcgaggctcacgggtgcgctttccaaaggaggaaaggtgcgcggagttgccaccaacgtttatttgtggaaaatgtcgggaaaaccgaaggaaaccggtcaaaatgaaaattctaagttcgggagttgtatttacgcttgaggaaggtcgacaaaagcggggctcttgctcctacgtaccctccatcgaagaggaaatctga

SEQ ID NO: 58873 - DNA, 300 bp, Glycine max
  Peptide Sequence Number=SeqID_150558
atggtgaaagttggaacctcttacgtgccgatcaacgtctcattttcgccaaaagttggcccagggcttcccgccgcgaacattaaatgcgccgctacagggcgcgtcccattcgccattcaggctgagctaactgcacattgggaaggttgcgatcggtgcgggcctcacttgcgctattacgccagcggcgaaaccggggatgtgctgcaaggctgcattaagttgaatcggtccaacgcgcggggaggggtttcgcgtacgttggcgctaaaacgacggccagtgaatactggctaa

SEQ ID NO: 58874 - DNA, 523 bp, Glycine max
  Peptide Sequence Number=SeqID_150559
atgggaaagttggatcatctagaggaaaggctcagggccattgaaggaggtgaagatcatgcctttgctaacctagaagagttgttcctagtatccgatatcatcacccctcccaagttcaaggtgctggactttgacgagtacaaggggactacttgccccaagaaccatctaaagatgcagtatcagtacaattttgatatggttccggataggatgcaacaacaaaacatgtgcaaaaaggggcacatatctttcaaagaatacgcccaaaggtggagagacctggcagctcaaagctttgcggatttggtctttgccagtgaaaggatcgatgtgggtctgaaaagaggcaaatttagtcatcctgcttggacaaatgagaaaactagggcaaatgaagagggtaaggatgaaggagaagcctgtgctgtgactcctattccaatacagccaagtttcccgccaacccaacaatgtcattactcagccaataacaaaccttctccttacccaccgccca

SEQ ID NO: 58875 - DNA, 555 bp, Glycine max
  Peptide Sequence Number=SeqID_150560
atgacacacgacctcaccatcagagggatgcacgccctaaccttcagaggactgcacgtcctcgccttcagaggactacacgtcctcgccttcagagggctgcacgtcctcaccttcagaggactgcacgtcctcaccttcagaggactagacgtcctcgcctttagaggactacacgtcctcgccattagagggctgcacgccctcaccttcaaaggactacacgtcctaaccatcagagggttgcatgccctcaccttcataggactacacatactaaccttcagagggctgcacactacacgtgggcctcaccatcgtaagagggctgcatgccctccttcaaaggacgtttacagccctccttcagaggactactcgtccacgcccatcatgagggctgaccacatctgtgcgaccatcagagagggaggcttgcacgcaactcacctatgcataccgagggcaagttgcacccgtgcttcgcctgcagaggatacgacgtggactcacctcagagggctgcaccctcgaccaatttacggaggactatga

SEQ ID NO: 58876 - DNA, 549 bp, Glycine max
  Peptide Sequence Number=SeqID_150561
atggcagatgatattaaattcaatcatagaaaacaaggtattcaacttactgaaaaggaagcaatccatttatgcttgactgaaattgaaaatatgctacaagccaacagaaaaagaccacgagattttccttccatgaaatacccaataggatatgcacccaatcaagaccataataaactcatcttcaatgaaatggcatatgacaaacaaatactagcggcagaattcaacagatcttaccatttgttgacagacaagcagaaatctattgtcgataccattatccgtgtcgttgacactcaatcagcagaattttacttcctctatggatatggtggaactaacaaggcatttgtctggacaacattatcatctgctatatgctccaatggtggtattgtttatatagttgcttcaagtggaattgcttcattactattgcttggtggtagaacaacacatttcaaatttgttataccagtgcctgcaacacaaaattcaacatgtaatattcatcaaggtagcaacttagctgaattattgaag

SEQ ID NO: 58877 - DNA, 705 bp, Glycine max
  Peptide Sequence Number=SeqID_150562
atggccgcgggcctggtgttcctcaccgtctcgctgatccaactgtgggccgggatggggttggcgtggcagtcactgcaatccgggcggatcgccgctgatcggttgcaggccatcgtcgagcaggcgacgacggtggaggatccggcagcgccacagccggtaccgcaggccgcgcgcgtgcactgggatgacgtgcatttccagtggccaggcgcggtgcgaccggtgctgtccggcctgcggcagacgttggcgcctggggaacgcatcgccatccgtggcgacagcggcagtggcaagaccacgctgtccagcctgcagctgcggctgtgggatccgcagcaggggcgaatcacctatggtggcatcgacctgcgtgatttcagccaggccgactggcatcggcagctggcctggttgccgcagaacgcgccggttgatgcgccgcatgcgcctgggcgaatgggccgagcgcaacggtggcctgcaggcctgggtgggcgagaacggcgcgacgatgtcggccggccaggcgcggcggctggcgctggcccgtgcactgctgcgcaatgcgccgatcctgctgctggacgaaccgaccgaaggcctcgacgtggataccgcacgtgcgctgctgcaggacctttccgggttgctggacgggcgcagcctgttgatgatcacccacgacgacctgcctga

SEQ ID NO: 58878 - DNA, 919 bp, Glycine max
  Peptide Sequence Number=SeqID_150563
ggatatggcaagccaagagaagtgggtcccatttgcggatatactagctttgctgatttttggggttgtcctctttccgaacgtggacgacttggtggacttagctgcgatcgatgctttcctttcctatcagcatagcaaggagagcccagtggtggctatcttggcagacttatttcatacctttgaccgaagcgcgatcaattggtttcctcgatggaaggaaggaaaggagggagttcttttctcgtgtggggactaccctaatgttccgttgatagggacgaggggttgtatcaactacaatcccgcacttgccataagacagctaggtctcaaggttatacaaagagtccacaaggcatggagaagtccattgaggaaagacaaagagcttaggggcatccgtaatggcgtcatcggtgttatcaatgaggagaacttcgaaactccggaggaagatgaagaagtccaagctctaaaattagagctagggaaggcaagactcgccaaagaaaagttcaagtcagccgctacaaatatccagaaagagtgcaccgagttacgagaggaaaacgcggccactgcaagagcccttgaacaagaaaccaaaagggcccgcaaggaggaacatggccgagagaaattccgaggagctttgtggggtagcaacaatgagctcaagctccgaagagaggaaagagaccggtcacgggtgcatggcatgatcttaaaagaagagttagctgcttgcgcaagatccaagaggagtttggctcaacacttggaagccacggagcaaagcatgctagctatcatagggcagtacaaggaagagttgaaccagtctatgacccatgaacaaaagctagtagaggattttgcacaagtgtacaccgaaaaagaagcaagagggagg

SEQ ID NO: 58879 - DNA, 222 bp, Glycine max
  Peptide Sequence Number=SeqID_150564
atggtgggttacacaccttcaagctttgcggatttggtcttcaccggcgaaaggatcgaagtgggtctaaaaagaggcaaatctgatcatcctgcttggataaatgcaaaaaatggggcaaatgaagagggtgagaatgagggagaaacccatgttgtgactgcccttcctatacggccaagtttcccaccaacccaacaatgtcatttggggatcctctag

SEQ ID NO: 58880 - DNA, 351 bp, Glycine max
  Peptide Sequence Number=SeqID_150565
atgtcaggatttacacgtggttctcctcaaatttcagccagcccgcatcaattagacctttcaccttacgcttcagagccctacaatgctcaatggaatgccccggggcttctccttgacaagcacacgttgcgttcgagtcgtattctcgaagaaatggaggttgatgaaccttggttggggttatggctaccattgaattatcaagtagatatgggagcaatgcggaagacagactttgtgggtgttttagggatggcctttgtggataactgggtggtgggtaaggagaaggttggttattggctgagtaatgacattgttgggttggtgggaaacttggctgtatag

SEQ ID NO: 58881 - DNA, 714 bp, Glycine max
  Peptide Sequence Number=SeqID_150566
atgaccggtgcggaaccagacgctgcccgcgccgaggaacagggtgcttttaaacaggctgtggttgacgaggtgatacagaccaccgataaacccggtggcaatcaaggcaggctgattcagcgccagaccggtgacgcccgcgccaagaccgagcaggataatgccgatattttcgagcgtgtggtacgccagcaaacgctggatgttgtgctccatcagcgcgtacaggccacccacgaacgcggtgatcatcccggccagcagcagcacgacaccccaccacagcggcggttgcccgctggtcagcgtgagtaccaaaatcccgaacaaacccactttcatcaccaccacagagaacagcgcggcggcgggcgcggaggcattggcatgcgcctgcggcacccagccgtgcagcgggatgatcccggcgagcaggccaaagcccacaacgcccagcagccagacgtcattccccagcggatggccgttgagcgcagagaaatccagcgtgccaaagcgttgccacaccagccagctggccagcgccagcagcagcgtgccgaggcgaccgagggcaaaccacagcttgccggaggcgctatagcccgtcaggaacacgccgcacagggccataatttcggccatcaccaccagcgcgccaagattgctggcgataacggtgcagaccgccgtcgccatgagcaggtttag

SEQ ID NO: 58882 - DNA, 585 bp, Glycine max
  Peptide Sequence Number=SeqID_150567
atggtgaaagttggaacctcttacgtgccgatcaacgtctcattttcgccaaaagttggcccagggcttcccgtgttatcaacagggacaccaggatttatttcaatctgcgaacatacacgccggacatcagcgctggcaagtgtagccggggtgcagacgctgacgctaaccaccacacccgccgcgcttaattgcttgccgctacagggcgcgtcccatttcgccattcagggaaacctgtcgtgcaactgctttgaatcggccaacgcgcgggcgatcgagtgcgggcctttgcgctattacgccagcggcgctaaagggcggatgtgctgcatactggcgattactatgttggcactgataacgccagggactcactattccagggcgaattcctcgtctgagctcgctaccgctcggtcgtcatgcggcgagcgctcagaactagtggcttaccccaacggggcggaattcgatctttcctgtgaagatgcgaatatacttaacagggaagtgagatgggccgcggcaaagccgtttttccataggctccgcccccctgacaagcatcacgaaatctga

SEQ ID NO: 58883 - DNA, 297 bp, Glycine max
  Peptide Sequence Number=SeqID_150568
atgggttgcagatataaggtaggttggatgggtaagggacaagggaagagaagaaaggtcgtgggttctatctcctctgctatcaaaactaagacactaacatttgtcttaaaagaaatttgccaatgggtatacaatagagatgacacggaagagatgtgtggaaaactcaattccacgagtcttcagcaagaagcagttggccgtggtatcccacaactatcatcaggacaaggaagtggagcaacaaaggccctccccttcaacccagctgcaagcgtcgaagcggtgaagaag

SEQ ID NO: 58884 - DNA, 441 bp, Glycine max
  Peptide Sequence Number=SeqID_150569
atggacgaagatgagtggatgtatgaaagtataatgtctgaagaagcggatatggattatcaaaatgaagaagcatgtggtacgaatgaaccacatgttcattgttccgatgcgttcaagacttctcaggatgttttgcggtgggctcgatccattgctcatgaaagcagatttgtgacgatgattttaaggtcagacacaaacacaagtagtagaggaaggactttgtttgtgttaattggctgtgaaaggagatgtgagtataggtgtaggaaaaaagaatttatcagaagagacactaggactaggaaatgtgggtgtcccttcaagcttcattgcaagccagtggttggaggagaaggttggatggtgaagttgatttgtggagtgcataatcatgaattggccaagtcattagttggacatccatatgcggagtga

SEQ ID NO: 58885 - DNA, 1635 bp, Glycine max
  Peptide Sequence Number=SeqID_150570
atgccaagccttatgctggtcttagggtattatcatcaaatctttaagccagaggtagttaaatacatcaagcacaccataggagtatggcacaatgatattgtcaagatcgcatcagatctaataggcaataacgaattcttcatgcagcccgacgtgggaacgctcgaaagcagtggggcctctgggacagggactagacctgagtcgctaacatttgggaataagagaaatgttgaggtggcacttgttcccccggggcgggggtatatgcccgtagctttattcggtcacttctttcagatcaatgaagttgaaaagtggaacctgaaactagcacttacaaatgagttagcaaaaggaaaaagacaattctcaaatgcgtacaagactttcttccttctctgtttaagaggccagtctgcgatggatgctctaaggcttaagtcgacgaaaaagttaggaaaggggatcatatggctagggttgccctcggggctcaagggtttagcgatgaagagtgccaagcaaaaggtcaataccggtacgccgatcaaagaagtccagtggcaaggccctttcagccaagctaatgccactgcgaaagactctagagatccactctcacagcgtatacgcgacatccctatgtatacacaatcctttcaagcagctaggacagctagcaagcaagttatttgttcgctgacaagctctctggatgacaaaaagcatgctctttcatgcggaaaaaacatggtctttcgtggaaagaaagagatcacattctatcctagggctagggagagagagattccagcattcttcccaactgaggcaacaaacaatcgagcagaaggggaaggagaagcctcagcgtaccaaacagattcattaggttcaggggctgaaagggacggattccctattgggttcagggacgagtacggaaagtcagagtccaagtcccaaagaacaaattcagccacttccttctctattgaagggacatctagatctaggtcagccgcatctgcagttgaagcagttgagggccgggccaaggccgacaagagccataatgagcatcaaatcaaccaaaagttctcagcttctttcttaagtgcttcagttcgacgtgatctatcgcagacggttttgaatcagactcttcccctactttccacgtcaagcagtaggaaattggaacagtctccgatttcaaaggcgaagccgagggggccccattccaatgagaatcaaaggcaatcgagaacgggatctttctccgatgatgagtctctattggaatggacggtagcttcggacgatgcgcccctcttcgccagatggatcagatctgttaaaaagaatcaacaggtcctctcaggtattgaaatccaatgggatcaagagctccagagcagagctaggagttctatgtctaggttgaggaggacgactaagccaaaaccattagcgacgaaagaggagtttcgctcgttgactaggaaccgaaaagacgtcaaggagagacgaggcgttagcacatcagtggagtcgggagaggttcatggtagagccaaggccaatccccttttgaagatggtgcatgatatcattggaccattttga

SEQ ID NO: 58886 - DNA, 309 bp, Glycine max
  Peptide Sequence Number=SeqID_150571
atgcggcgccccgaccgcgatattttctcgagccgttcagagcagacaacatcaacggaagggcctgttttggaggagtttattccaatcaagaaaagggcatcatcatcccttttttgtgatgaagaggatgaggatgatgagcaacattctcacaagcaaagggagctagaaaagaagagaaaggaaaagacacaattggtttatgagagaaagaagcagctcaacaaattaagggtgaaagccgagaaggttgctgaagacaagctcggttcccaacttgatatccttgctccagtcaagtattga

SEQ ID NO: 58887 - DNA, 432 bp, Glycine max
  Peptide Sequence Number=SeqID_150572
atgatcatgaccaaaactagtgctaaagatcctggaaggtcagtgcacaatgccccccatgatcatacacaacatccaacgtatgaacctggccaaaagctagtgccaaagaccctggaagaaaaaatcagcatgcaacagggacaggcagatatcctcatagctaggtttcctgaccctagctatggtgttaaaacgggttttgttctctaccgaaaccgcaagccaagttggaagattctgcttcggttgaagggttcctctcggtgtggggtttcaatggagaacaacgatggtttgtggtggctaatggtggctgtgggtgatggagaaagtgtttgggacattagaaatggctttggaagaaagaaaggagaagaaataacgtttttcctaagatacacgaaagcaaaggctgaaatgcttaaataa

SEQ ID NO: 58888 - DNA, 744 bp, Glycine max
  Peptide Sequence Number=SeqID_150573
atgaggcgtaggcctactgcatcagcccgtaggcaatgggtacatattgcggttaatgagggtgttcctcaggtgactgaggatgttcctcatatggtggaggatgttcctcatatggctgacgatgttcctcagatgagtgaagatgcgcctcagatgactgcggacgtagatgtgactgttgtagaggacttaggtcgtgattgtgttgaggggtcacatgctgatgagggattccctggtgggccccatgacccatcagctctgactttatttgcgaagcatgtcgcacatgccatttggactggacaggagtgtcctaagctaaagttggtgtcgcacgggaggaaggtgacactaattgggaggccagtgcctaagattgaagggttggttgccgccacaggattaagtccattgatcgggtgttcagttgtaaccggcgatcctggacttatattcgcatttgtggagaggtggcacagggagaccaacaccttccacattccagtaggagagttgacgatcacactagatgatgtgtcatcactcctccatctccctatcagtggtgccttccatagcttccaggctttttccgtggacgaggcggtatttttgttgatggagttgctggaggtgttcggtgaggaggctagagccgagacagtacgagcgcatggggcatatgtacgcctctcatgggttcgggagatctatgagatgagatgccagacacgatga

SEQ ID NO: 58889 - DNA, 564 bp, Glycine max
  Peptide Sequence Number=SeqID_150574
atggcagccttggacgtgcagcggaagaaggaagagaagaaaagaaagaaggcgaaaaggtggggggactgtgctgggtgcacacggtttttggggaataaccgtctttgtatcgttaatggtagcacgtggcaaccacctgagtgggccgacgagtatacaaagatggtggtctggccacgtgattggaggcgttcaattacaaagacggtcctgatgaacaaccgtctttgtatcgttaatggtttcactataaacacgtcatcatcttcatcatttagttacgaagacggtcttgcccaagaccgtcttcgtattgttggtggttacacacacgtggcgggcgtcattcaaagacggtctttgctaggacccgtcgttgtatctgaaattgtatcacagcttcttctccgacaaagaccttctcctccgaaaaatagcatctcgtgtccattgcctcttgttccatttgcagtcgccgccgacaaaggctgttggttgttcttggtgctcttcatcgtcgtctacattgtagtgtttaaggaagataaggtggttccataa

SEQ ID NO: 58890 - DNA, 351 bp, Glycine max
  Peptide Sequence Number=SeqID_150575
atggcttatggcccattggcagctcgttgtattgtgcctaggcaacaatctagtggtttggttttgttctttgcgaaagaagtcggatgctgccatcaagggtgcagtaaacagagtcatgttcaaacaggaaattacgagtgtggatactatgttatgcaatggatatggtgcatcgtaagtggtggattgaaggatgactggattcacggtggtggtgacaaggactacaaggaggtacccccacctcctttgtttaaacctgcagggggacacattaaccaagctgtgaccttcaacagatcttattacaaggtaatcagttcaatggaaaaatggttgagtcactag

SEQ ID NO: 58891 - DNA, 594 bp, Glycine max
  Peptide Sequence Number=SeqID_150576
atggttaggacccgaggattaggtcgtgccttaggtcacgatactggcagaggtgtgggcagaggagatcgtgatgattccgatgatgctccacagcgtcgacagcctacagcatccccacgcaggcaacgagtacctgtcactactgcgaacaatgagccagtggtccttgcaacagaggttgagggagctttgattgaggctgatgtatatgcggatgagccgatggcaggaggtgatgtacaggatactggggcagacaatcctgcaaacacaggcgcacaggctgctgaggatgagcctaagggattttcaggtggtctgagggacccatccgtgctgaccgagtacgcggattacgttgcaggcagcgtatggacgggagaggagcgtcctgagttgaagttatcctctcataggagaaacatgcatagtttaggcatgcctgtccctgccattgaggggctagttgctgggacaggactaagtcctctgatcgtgtgcttgatagacactagcgatcggggacttttgtcgttgtttgtcgagcggtggtaccgggaggcttctagtttccatctccctgtgggagag

SEQ ID NO: 58892 - DNA, 450 bp, Glycine max
  Peptide Sequence Number=SeqID_150577
ggtacatcctttgtggtacaagtagaggatacatctacttgggttgttgtgactgagaacaagagagggcacatctcttgtggatcagttctagtagagggtacatccactaggttgttcaaaaagaataaaggagggtacatcaattgtggatctttgcttgtaaaggattttacaaggttgaaaagaaatctcaaggaccgcagttttcacataaacaagaatgtgaaggccaaatgtaaatcactaattgggcaaaaaaatgcttgggattatgtcatcgattgttggggatgtctaactgattgtccttcagaacaacagtttgatgaatgcctgaagaagttcgaaatggcttgctcaccttggccaatgtttgttgactatgtcaaggaaacatggataataccacacaaggaaaaaaaatttccgcctggactaataaggtga

SEQ ID NO: 58893 - DNA, 295 bp, Glycine max
  Peptide Sequence Number=SeqID_150578
atgaaccttagggtagaggacgctggaaaaaatggcggaagcttggtgacggtgagccttctggaagacccgttaggggttcttctggaacttccggaagaagatcttccggaagatttccggaagaagggttcttctggaggtaatgaaacaacttccagaagaacaggtcttccggaaagctctcggaacacctcttccggaatgtttccggaaacattccggaagagggtttttccggatgaccttttagtggttccggaagcactttccggaagacccttcttccggaaag

SEQ ID NO: 58894 - DNA, 366 bp, Glycine max
  Peptide Sequence Number=SeqID_150579
atgcactataatgcatggtgtggacttggaatgttatatcttcgccaagagaagtatgagttctctaaacatcatttccatatggcctatcaaatcaacccacgatcttctattatattgtcataccttggagttgctttgcatgctttaaagagaagcagggaagcattgcctataatggagaaaactattttggaagataagaaaaatccagttcccatgtatcaaaaagccaacatactcataagcttagaaagaattgacgaggatttagatgtcctagaggagctgaaagaggttcaacctcatgaaagtagtgtttatgctttgatgggcaatatttatagaaaggtgtcacatgcatga

SEQ ID NO: 58895 - DNA, 49 bp, Glycine max
  Peptide Sequence Number=SeqID_150580
cttcatgcttaagtatgtataccaaatcgctcgtagtaataatttcccg

SEQ ID NO: 58896 - DNA, 132 bp, Glycine max
  Peptide Sequence Number=SeqID_150581
gaatctatcaagcctactcttcacactaccattgggcctgatccatgtaaagctactaccagcactcttaactgtggttcttcctatggtcatcatggcttgaatagtcagcttgtgctgaaagtcatgtga

SEQ ID NO: 58897 - DNA, 237 bp, Glycine max
  Peptide Sequence Number=SeqID_150582
atgtcttcatctaagattttgcctaggatcttcttcatcaatggattcctttgcttcttggaagatgaatggcagtggaatggagaagagaaaagagagaggagacgccacttcaaggagaagatgagtctagaagaagctcaccaccattggaagccatggataagagcttggaggaagaagaagatgaatgaagggagagggagagaagagcacaaaattttgtgctctaaatga

SEQ ID NO: 58898 - DNA, 279 bp, Glycine max
  Peptide Sequence Number=SeqID_150583
atggtaggaaagttgtatgcggatcacaaactggagtcattctattgtattcatggggatgcttcaaggattgtagcctggttgggatattacctaacagagtcatccagccaattgcagaacactcagagtatcctgttgagtgtcttggaattgtttaccctgatttttggcacatttatattagatgcttactatcatgattgtaaatgtaaacccccatctgatcatcatatcggggtcataactttgttatcaagaactataggccttaaatag

SEQ ID NO: 58899 - DNA, 294 bp, Glycine max
  Peptide Sequence Number=SeqID_150584
atgggttctccacctgcctccactcctcctcttcctcctcctcctcctcctccttctcctcctcctgctcctcctacttcggacgcttcggcttcgccgtctaccgtgaagtggacacgcaaagcctcacgtctacgatcgttgtccactagatcacctggtgctgagagaccagtggtgcatattgatcctgctaccgggaaggccgacggtccccacaggaagaaattaagaacatatttggggattgtggcgcgtgataaggtggacatcacctacgagaactggaaggag

SEQ ID NO: 58900 - DNA, 985 bp, Glycine max
  Peptide Sequence Number=SeqID_150585
cggacacgcaaagccacacgtctatgatccttgtcttactagaccacctggtgctgagagaccagtggtccatgttgatcctgctaccagcaaggccgacggtccccacaggaagaaattaagaacatatttggggattgtggcgtgtgataaggtagacgtcacgtacgagaactggaaggaggtccctactactcagaaggacttgatttgggaggatattaaggcggaatttgaaatcccaaaggcttctgacagtaggacgaaaaagaagttacttaagactgtcggcgagagattaaggacgcagaagctcctggctgagaagaccaagaagaagctggaggaagctacacagtcaggaagtgttgatggcgtcatcgaccatccatcccctgtcagacaccacgtgaagtggaagatggcccgcaccaagaaaacaggggagatgacgactgaggccacaaaggaaatcgctgagaagatcgattcctttgaggagcaagcgtcacaaggatccttcatcccccatggacatcaggatgttctcaccgctgctattagacgtccagagcaccctggacgtgtctgtgctgctggagctgcagctgacctagcaaatcagggaccagctagaggagtcaatcacagaaaaagtgactcgacagctcatggcatcgttcaaccagatgcagtcccagatgcaatctcggggacttgcactgcctccggagccttggttggtccctcaggaaacaatcctgagacgggtgactcagacaggtgcggcttgtacattgaagcaaattctgcccacctggttgccctaggaagagtttataagggatccactgttgtttataacactcctttgttgcctggccaagtaaaggtgggtgtggaggaggttaaagatccagattctcccgttcctgtacccattgatgaggcagttgtcccaagcacctcaacgccggatccggag

SEQ ID NO: 58901 - DNA, 195 bp, Glycine max
  Peptide Sequence Number=SeqID_150586
atggatacctcagagccctgcactggggcaacgagaggcaccatgcatgagcctcaagtgaacttaggggcaaatcaaaatttctcacccgtgagatcgacagacccttggcatcactctatcaggaaagtttcacttggtcacataccaaagtgcaacaattcattgccatccttcaatgggacacacaattga

SEQ ID NO: 58902 - DNA, 222 bp, Glycine max
  Peptide Sequence Number=SeqID_150587
atggtgggtctcttggtgcaagaagaaaacttttggaggcagcgctcaaaggttttttggttacgagatagggatgcgaacactaagtatttccattctgaagcgtcaaccccaaagaaacaaaatcaagagcgtagaggcaaggtgggagtggttgatgcaatcctccctaggaaaggaccagttactagagccatgagcaagaggctccaagaggattga

SEQ ID NO: 58903 - DNA, 168 bp, Glycine max
  Peptide Sequence Number=SeqID_150588
atgcagagttcaaaacacgatgtctaccttggagcctacctgaatgggccagacaactaccttaaggggataattaacagtgctttaaaaggtcttgatgatgctccacaacctaaatcaaaagttgttgctaggtggattgttgtcaagacaaaaaggaagcactga

SEQ ID NO: 58904 - DNA, 216 bp, Glycine max
  Peptide Sequence Number=SeqID_150589
atgagtgttcctgggaagtcactaatacaaattcgtgaaacatcaaatggagtaataacattggcaggaataactgaagttgctgcaagtacattacatgagatgtcttcttacttggagcagggttcttttagaagggcaatgggaagtacaaatatgaacaaccattccaagatactttggaaaattgaagcagtttctttacactatggataa

SEQ ID NO: 58905 - DNA, 249 bp, Glycine max
  Peptide Sequence Number=SeqID_150590
atgattactgtaataccaaagggcaaagagcagtcctctgtcaaggaggcagattcatccccaaaaagtgtgactgataaactacaagaagtattgaaaaagatcaaaaccccagtcaaaactgggatttatgatgacctatatggagaatcgttatctgtcaaagttggatcttccttgccatattcacctgcactcagtactggtgaacgaggaggatggtgcaaggagcggaaagtcagagagtaa

SEQ ID NO: 58906 - DNA, 425 bp, Glycine max
  Peptide Sequence Number=SeqID_150591
atgactaggggcaatccaggtgatttacaaccctttgatcatgaaatagatagaaccttccatagattagttaggcatagtgtgcatcctggacattctgtacattttgagcattctgttgagggtgattctaaatattctgattttgagcattccactactaatttttatactgagaacatggctcaaccttcacctcgtgagaggactcttagggagatggctgcacctgacttcacttatgaaagcttgtgcattcaatatcctgacgagggtgaagatcctcataaacatcttcaggagttccatattgtttgttccaccatgaagccccctgacgtccaagaagatcatgtctttctaaaggcttttcctcattctctggagggagtggcaaaagattggcaatactaccttgctcccag

SEQ ID NO: 58907 - DNA, 234 bp, Glycine max
  Peptide Sequence Number=SeqID_150592
atgggttttcagagctatcaactactgaaagacaagaaattaattcagatgaagaaagccaaactaattggtatgcttgatgaggtggagcaaaggtacaagcagtaccaacagcagatggagatagtgaagattgctttggagggaaaatggaaggttcgcggctcaaatatgttgaccatcatcttcggcaacagcgagcacttcctctcctcactctacaactgcttatga

SEQ ID NO: 58908 - DNA, 603 bp, Glycine max
  Peptide Sequence Number=SeqID_150593
atggttgcagagttagggcaacagacggtggagctatccaccctcatcacacgcgccgctaatgataagtccttcgatatgttaatcggaggatttattgttagcggcgcgtgtgacgaggggttgtgcctcactaataggacagctgaaggttttaagcttttgcagcttattaaggccagagcgattgcctcaaacactgtggtttacaacactttgcttcatgcactttgtaggaatgggaaggttcttgatctttttaatgatatgaaaatagatgggaacaaaataatcagaggtttgtgttcaaaaggaagaattgaatatagtttttatattttggagttaatggaggaaaacaaagaaggctctagagggcaaatcagtccttataatagcataaggtatggcctattaaagcaaaatcgatttcatgacacagatgagtttctaacaatgatggtgaacttcttccctagagctattggcaaaagcttgataatattagagcactacaagaaggggtctattgaggatgcagagagtgtgttatcagaaagccatgcaggcctctatggaaatggtagacaagggcatccttga

SEQ ID NO: 58909 - DNA, 102 bp, Glycine max
  Peptide Sequence Number=SeqID_150594
atggaatatgagactgctctggcagagatgtcaccattcaccaatgagggtggtgccatcaacaccaccctcctcctttgtcgggcttgggaccggctatga

SEQ ID NO: 58910 - DNA, 669 bp, Glycine max
  Peptide Sequence Number=SeqID_150595
atggatgtgttgaagggaacttgggatccactagcccctctcttatttaatattgtgacagagggcttgacggatgacgccattttcttcgatgaaacatccatacaaaacgtgaaggtcctcaaggcaatactgaggagttttgagatggtatcaggcctaaaaatcaactatgcaaaaagtcagtttggggcggttggaaaatgtgcccaatggttgaatgaggctgccttgtacttcaattgtagcttactagttgtactgtttacctatttgggtaacctcggtgactctgataaagtcaatactgaggattccaaaggtggtacacaagctagtcacattacaaagaaggttattatggggctatcctgggatagtagaagtgggatctatttcaccattagggagaactctaaactagagtgttggattccaaatatggaggttggcgaagcttggatggaaacaattcacctcaagcagtctccaaatgctagattttgggaagatggatgggcagctgatgggatccctttaaaggaaaagtatcctagactgtacctaaactcgaaacaaaaaaaagcaatacattttgcaaataggagacagttcaaaagggaaatgggaatggtgtctacagtggaagaggctattgttcgagactga

SEQ ID NO: 58911 - DNA, 144 bp, Glycine max
  Peptide Sequence Number=SeqID_150596
atggtgaatgagtctgagatcatcatttttctgagacagggtactcacaacctattgtcataccctaatttcgtccggggacctttgcttgatgacatgcaacttttgtttggtccttgtgaggtgcttggcacccatcattag

SEQ ID NO: 58912 - DNA, 759 bp, Glycine max
  Peptide Sequence Number=SeqID_150597
atggatgtgttgaagggaacttgtaattcattcaacaagggcttgacgggtttaatggaaaaagcactaaaagcaaacaagtacaaggggttattggtcctcaaggcaatactgatgatttttgagatggtatcaggcctaaaaatcaactatgcaaaaagtcagtttggggcggttggaaaatgtgcccaatggttgaatgaggctgccttgtacttcaattgtagcttactaggtgactctgataaagtcaatactgaggattccaaaggtggtacacaagctagtcacactacaaagaaggttattatggggctatcctgggatagtagaagtgggatctatttcaccattagggagaactctaggctagagtgttggattccaaatatggaggttggcgaagcttggatggcaacaattcacctcaagcagtctccaaatgctagattttgggaagacggatgggcggctgatgggatccctttaaaggaaaagtatcctagactgtacctaaactcgaaacaaaaaaagcaatacattttgcaaataggagacagttcaaaagggaaatgggaatggtgtctacagtggaagaggctactgttcgagactgaaataagtatgtgggctaattttctggaggaaatacaagctattaatgtaaatctccaacaatcggataaatgggtatggacaaatgataccagtggaaaatacacagttagaagtgcataccaattaatggacaggaactaa

SEQ ID NO: 58913 - DNA, 291 bp, Glycine max
  Peptide Sequence Number=SeqID_150598
atgagtgaattgactttgagatcatcaagatcgagcagggttgatgaagtgatatatgggcttgttgatgctcgcacccaagtatgtgggttattaatcaaattccaaccctacttccctaacatggctaggttgaatccgtggagattacaaaatcctatacctcaaaacttcttctttatggaaagcttgtcccaattgagccagttgattcctcttgttgatgcaccttttgatctccaccaaaataaattcagcatccttcgaatatcatcctctagagtggtttga

SEQ ID NO: 58914 - DNA, 581 bp, Glycine max
  Peptide Sequence Number=SeqID_150599
ggaagctgagtgtgaaatatgcaatcctgcacaggattggagctgcaaactgggtacccaccaaccatacttccactgttgccacagaatcatttgctgtcaaattacccattgccttcccaactgtattgtgtggcattatgttgagtcaacaccccaatattttaaactacactgactctgtgatgaagagagaatctcctctatccctgcattacaaattgtttgaggggacacatgtcccagacattgtctcgacatcagggaaagctgctgcctcaggtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatggtgaagcagctgaggaagatggagaagcagctgagcaagaagatgaagcagctgaggaagaggtcgaagcagccgaggaagaagaagaagctgctgaggaagaggaagatgcagcagaggatactgaatcagatgatgattctgaagccaccccatga

SEQ ID NO: 58915 - DNA, 178 bp, Glycine max
  Peptide Sequence Number=SeqID_150600
atgggggtgcaaatagcaaccaggcccacttgggccctccagaaaggcggttgcttctggaggaagccaccttgcttgcttggcgagctgagctcgcctgggcgtgctggtggcaagcatctcccccattttcctataaataatgggagaagtgaaggggatttcgttcagccctctg

SEQ ID NO: 58916 - DNA, 272 bp, Glycine max
  Peptide Sequence Number=SeqID_150601
catgttagctattgtaagcaaataccaagaagaactaaatttagccacggcccacgagcatagactggcggacgagtatgcccaagtatacgcggaaaaggaggctagaggaagggtgatcgactcgttacatcaagaaacaacaatgtggattgaccgatttgctcttaccttgaacgagagtcaagaacttccccgattgctagccaaggccaaagtaatggcggacacctactccgcccccgaggagatccatggacttctcagctatt

SEQ ID NO: 58917 - DNA, 131 bp, Glycine max
  Peptide Sequence Number=SeqID_150602
ttctagcttctcatctcaaggaggtgagcttagctattagagagctaagctctagtttctcaaaggaagttttctcaaagaagcttctcaaggaagttttctcaagaaagcttctcaaggaagctacctag

SEQ ID NO: 58918 - DNA, 299 bp, Glycine max
  Peptide Sequence Number=SeqID_150603
tgagagcaacaacttccccagatgacgaatcagaaagatcagcaattcctccaactggggaagcagggggaggggcagccacttcatctgatgatgcgttagagatgacaatcagaggaggagatgggggaactgcttcaagctcaggagaagaaggtgaattcacccctggagattgtgggtcagctggctctggattgcctgcacagatgtgggctcaggcggagcagcctctttgggtctcaccaaaggaagttgatcttcagcccaggctactttctcaagaaaatgctccatag

SEQ ID NO: 58919 - DNA, 412 bp, Glycine max
  Peptide Sequence Number=SeqID_150604
gctgtcgtcccttgtgacggacgtgtggggtgctaataccttccccgtgcgtaaatacaactcccgagcctttcacttaaaagttcatagatcgcgtcttttccggtttttccgacgttttcctcaaataaacgttggtggcgactctgcccgtattcctttcgtggaacacgcatcccgcgagtcacgcgtcgccctcccgccgaagggtaggttgcgacaccagggttttacttcttttccgtgccctactccggatcagttcagggcagaggtcgcgtggcccggagattggcctgaggcccgggcaggagaggcaccagcagaggctcctgacgaggcagatgaggcccgcgaggatgaggagatgaccgatttacttgatttcttaggagggagcggagccacatga

SEQ ID NO: 58920 - DNA, 588 bp, Glycine max
  Peptide Sequence Number=SeqID_150605
atgttggtgcgcatgatccgcactcgtctctttgcagcggcacgggtgaaatcttgccccagtatgcatagtagctgtgtgatagcctccctctctggttgtgctcacacagttggccctcctccaatatcagggggtggcccaggaaccgtgtggatatggagcccactgaaagtgaggacgtgtagtcctctaaaggcgagggcgtgtagccttctgaagttcaggacgtgtcgcctttcgaaggcgagggagtgtagtcctatgatggcatggatgtgcaatcctctgaaggtgaggacgtgtagcgctctgatggtgaggacgtgtagtcctctcaaggcgaggacgtgtagtcctctcaacggtgagggtaacgagtacccaagccctctgatggtgaggacgggtagtcctctcaaggcgaggacgtgtagtcctctcaacggtgagggtaactaccctctgatggtgaggacgtgtagtcctctcaaggcgaggacgtgtagtcctctcaacggtgagggcgaggacatgtggtcctctgaaggtgagggcgtacaaccctctgttggcgaggatgtgtag

SEQ ID NO: 58921 - DNA, 746 bp, Glycine max
  Peptide Sequence Number=SeqID_150606
cgacagcggcatatcgccgatctcgtcgaggaacagcgtgccgcccgccgccgccatggaaacagcccttcgcggctgctgaccgcgccggtaaaggcgcccttggcgtggccgaacagttcggactccagcagctgctccggcagtgcgccgcagttgatggcgatgaacgccttgccggcgcgcgggctggcggcgtggatcgcctgcgccaccacctctttgccggtgccgctctggccgttgatcaagacgctgacgtcggactgcgccaccattttcacctgctccagcaggcgcagcatcagcgggctgcgggtgacgatatcttcgcgccaggcgtcgtcgccggccggggtggccgacagcgcgagcgcttcgtcgatcgccttgtacagcgcatcgcgatccaccggtttggtcaggaagctgaacaccccctgctgggtggcggccaccgcatcgggaatcgaaccgtgcgcggtgagaatgatcaccggcatgcccggctgatgcttttggatctcggcgaacagcgccatgccgtccatctcgtccatacgcagatcgctgatcaccagatcgatctgttcgcgcgccagcaggcgcagcgcttcctggccgctttcggcggtggtgacgtgaaaaccttcgctggtcagacgcatgcccagcagcttcagcaggctgggatcgtcgtcaaccaagagcaggttggccggtttgcgtgcggtcattgcgcgtga

SEQ ID NO: 58922 - DNA, 147 bp, Glycine max
  Peptide Sequence Number=SeqID_150607
atgacatgcacccacattccaatggaagcaaaaatgattcacaagcgattctcctcaagtttcagccagcccgcatcaattagactttgcaccttacacttcgaggtcatacagtgctcaatggaatgtcccggaactcctccatga

SEQ ID NO: 58923 - DNA, 768 bp, Glycine max
  Peptide Sequence Number=SeqID_150608
atggctacctcaccaaaagaaactgcagctcctagttcacccgctgtaccatcatctccgcaccaggaacaaccagaattcaacatccaacccatacagataattcctggtcaagcttcagtccctgagaaactggttcccagaagacaacagggagtgaagattgctgaaaaccctagctctgcaacaagtcctagggaagtagacccggagatggacaagaaaatccgcagtattgtgagtagcattctgaaagatgcttctgtgcctgatgctgagaaagatgttccaacatcttccaccccaagtgtttccgtgcctgatgctgagaaagatgttccaacatcctccgctccaaatgctgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcagaaaggttacaaggcagaaagggaaaaaccccccttaagaggtctggacgaatcaagactatggcacagaagaagagtactccaatcactcctgccacatccagaagaagcaaggttgctatcccctccaagaagaggaaagaaatttcctcatccgattctgatgaggatgtcgaactagatgtctcgacatctaagagggccaagaaatctgggaagaaggtgcctgaaaag

SEQ ID NO: 58924 - DNA, 581 bp, Glycine max
  Peptide Sequence Number=SeqID_150609
ttgtgcggtccgccgtgattagatcgaggtttaactttcagcgagccgccacggccgctttcgcccagtccggcattgccgcttcaacatcggcgatagcccgcagcgcgggggttgccgagggaacgctgtttcgctatttcgccactaaagatgagttgctcaacgagttatacctcgccattaagatgcgcttagtacagacaatgatcgccgggctcaatcctgacgaaaaacgcccaaaagaaaacgcgcggaacatctggaacagttatatcgactgggggatgcgtaaccctatggaataccgcgccattcgccgtatggcattgagcgaacgcattaccgatgaaacccgcagccaggtcaaagagagttttcccgagctgaacgagatgtgccagctgtcggtgaaagcggttttccttagcgacgcctatcgcgctttcggcgatgcccttttcctgtcgctggccgaaaccaccatcgagttcgccagccacgatccacagcgcgcccgcgatatcattgccctcggttttgaggccatgtggaatgcgctgcatgagagtgagtcgtaa

SEQ ID NO: 58925 - DNA, 372 bp, Glycine max
  Peptide Sequence Number=SeqID_150610
atggataccttagagccctacactggggcaatgaaaggcactatgcataaacctcaaaacgaacctaggggcaaattagaagttctcacccatccgcatttaccaaatttcacgacaaaggttgcatgcatctgcagccctaaaaatcatgttaactgcatagatttcctacatctaatgtccaaatcttgtggatttgggatgaccggccctctcgatgagtcgatctcttgctttctcataaggaggactacacgtcctcgccaacagagggttgcacgccctcaccatcagagaactacacgtcctcaccatcagagggctgcacgccctcacctccagaggactacacgtcctcgccttgggtactag

SEQ ID NO: 58926 - DNA, 348 bp, Glycine max
  Peptide Sequence Number=SeqID_150611
atggcgatatcgacgccgcgcggcaagcgaccggtgcggcgcagcacttcggcctgcagcagtttcgccgcgcggatgatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58927 - DNA, 258 bp, Glycine max
  Peptide Sequence Number=SeqID_150612
atggcttctggtaatcgattaccaagggtaggttttcacgtcctgaagctatgtaattcgagtttggcctctggtaatcgattaccaatgaggtgtaatcgattaccagagatgaaaagccttgagataccccttttacttgcatgtagtggttatgggacgcattgtgttgctaccgcagttagatctctcgtgaaagagtctacccctttccttttctttcttgtagatcgcgatggcggcgcaactaatctatga

SEQ ID NO: 58928 - DNA, 444 bp, Glycine max
  Peptide Sequence Number=SeqID_150613
atgagtatgatggatgctgccaatgatggggcccttggtgatatgacccctgttgaggctaggaatttgattgagaagatggcttccaactcccaacaattcagtgcaagaaatgatgctatcatccttagaggagtccatgaggtgaccacggattcatccttatctactaaaaataaaaagtttgaaggaaaacttgatgccttggtcaacctagtaacccagcttgccatgaatcagaaatctgcacctgttgcaagagtctgtggtttatgttcttctgcagatcaccatatagatctctgtccttctttgcagcaatctggagtcaatgagcaacctgaagcttatgctgcaaacatttataatagacctcctcagcagcaaaaccaacaacagcagaataattatgacctttcaagcaatagacacaatccaggttga

SEQ ID NO: 58929 - DNA, 573 bp, Glycine max
  Peptide Sequence Number=SeqID_150614
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatggcatgtgccgtgccaccaattacatcggtctgctgcgcaaagctctcaaggatgccgggtttggcaatatcccggtcatcgcagcttccctgcaaggagtcgaggacaacccgggatcaagcttatcgataccgtcgacctcgagggggggcccggtaccagcttttgttccctttagtgagggttaa

SEQ ID NO: 58930 - DNA, 345 bp, Glycine max
  Peptide Sequence Number=SeqID_150615
atgacgttgctacttagctacattctgcccagcaaccgtaatgccaatctccccctgcagaagtatcaattggggtcgcgcccacaagacacccagtggacccggagaagtccaacagggccctggggtttccaactttggttacgggcctctatcagtcctacagggtgcccgtaccccccagcaaggtcatgccatcgtgacatagttaaggatcgcgcccgcaggacacccagtggacccaaagaagtccaacagggtcctagggttttcagctctaattacgggcctctgctagttctacccgccacccccaacaaggtcatcaggccccctactaattga

SEQ ID NO: 58931 - DNA, 138 bp, Glycine max
  Peptide Sequence Number=SeqID_150616
atgcttgggagtatgtcatggatgctcggggcagtctggttgattgtccttccgaacaacaattccatgaatgccttcagaagtttgaaatgggttgttcaccttggccaatggttgaatatgctcattgagctttaa

SEQ ID NO: 58932 - DNA, 195 bp, Glycine max
  Peptide Sequence Number=SeqID_150617
atggtgatggaggagcaagaagaaaacgtaggggaagaaggagaagaggctggaaatttctggaggaaagagagagaagccataaaagaaaaatctggacctttttggatgctgaaatcttgcctcgatttgcatgtcgtctccccgattctagttcttcgcgtttctctgcacccatcggggcccgtttcaaag

SEQ ID NO: 58933 - DNA, 324 bp, Glycine max
  Peptide Sequence Number=SeqID_150618
atgtctcttgccactttgtttggcaaactacaggaacatgaaatggaacttcaatgtctcaaccaaaatgaagagactgacaaaaggaaaagaagcatagcactcaaagcctcctcctcaatgcaagaagaagaagaagaagaagaatcagatgatgaagaggacttgagaagaaaagctataaagaaagaagatccaagaaggcgtatattgcttgggatgacaatgactcatccaatggtttggagaaggagatcaaccttctatccaaggactatgaaagtgatgagaacatctctcaagaagattaagcaaaaagcaaaa

SEQ ID NO: 58934 - DNA, 529 bp, Glycine max
  Peptide Sequence Number=SeqID_150619
gggctgacacagtccttatggtttcgcacccttttgtctccagaggcggcaggcccgatgacaagcagagacaagtttggtcattctgcacccatgatacgcggagataccttatggttattcgcacccttttgtcatccagaggcggagcccgatgacaagcagagaaagtttggtcattctgcacccatgatacgcggagataccttacggagcgaaattagtgtcattctgcaccctgatttcggggataccttatggcttgatcatgcgacctcttttgtccttgtgagggcttggcgggcccatgacattaggaaatttgtgaaattttgggaacaacaagtcatgatacgcggagataccttatggttattcgcacccttttgtcatccagaggcggcgggcccgatgacaagcagagaccaagtttggtcattctgcacccatgatatgcggagataccttatggttattcgcacccttttgtcatccagaggcggcgggcccgatgacaagcagagaccaa

SEQ ID NO: 58935 - DNA, 450 bp, Glycine max
  Peptide Sequence Number=SeqID_150620
atgcaagatgatgcgggtcatatctcttctcccatccttgaaagggagcctcctcaacagcccaaagaggttcacgaagatcatcaagagtatgcccaaggggatgtcgagttctaccccctgattcccgtcgagggaccaacacccaacactttgcctcagcccaacctcactgcacagccgatgatcttgtccatagaaggaccacccccggcgaccgaagaaagaaggaaactcgatctcctcgaggagagattgagggctgttgaaggctttggtgattatccgttcgcggacatgacggatctttgcttggtaccaaatgttgttatccccccaaaattcaaagtgccggactttgacaacttggccggagccgcagttgtttggtacactaatctggaagcttcctgcatccgtactgggaaggacctgattactgctttctaa

SEQ ID NO: 58936 - DNA, 680 bp, Glycine max
  Peptide Sequence Number=SeqID_150621
atgacgccacccaatatgctgacgcctgcgctgtatcgccaatgcctgcaaaccatggcacacgaaaaaggctggcaatataccgagtgggacacggaggcactgaagcacttgggtgcaggggcttttgtggctgtggcacagggctcggatccgcaagatgccgctatcgtcaaactctcctaccgtcacccgcaagcacagaaaacgctggcgctggtcggtaaggggatttgctttgatactggcggccacaatttaaagtcgtctaaatatatgcaaggcatgcatcaggacatgaatggtagcgcggtggctgttggcgtgttgcaggcgattagcgcacagcagttggcgattaacgttgattgctggctggcgctggcgcaaaaccatatcggccccaatgcctataagcaaaatgatgtgattaccgccctcaatggcatgacaatagaaattgtccacaccgatgctgaaggacgtatggtattggcggatacgctgacactggccagccgtgaaaaaccggatgtgatgattgattacgcgacattgactggcagtatgcaaaccgccttaggtacgcgcatgagcgggattgtggctaatcgtgagccattagcacaacaaatgatagaagcgggggcgctcagtggtgagcgcgtggtgcctttccc

SEQ ID NO: 58937 - DNA, 279 bp, Glycine max
  Peptide Sequence Number=SeqID_150622
atggcagaatcattgaagaagagaaagggatcatcctccaccgctgctgctgctggccatcgccgccacggacaatccgaagcacccacaacacctacccatccatctttttcatctccaagatcatccaatatgttttcttccgatgatcaacgtctacggtacctttctcaatttacttctaggatcattttagaccctaagtacctagatatagatttctttaatgttgagacatttgattgctatcaagtgtttcaaaattctgggcttggttga

SEQ ID NO: 58938 - DNA, 501 bp, Glycine max
  Peptide Sequence Number=SeqID_150623
atgacgttgttacttagcaacattctgcccagcgaccataatgctgatctccccctgcggaaggtgaccgcccccccagcaaggtcatgccatcgtgacatagggatcgcgcccgcaagacacccagtggacccgaagaagtccaacagggtcctggggtttctagctctgattatgggcctctgtcagttctacgaagtgctcgtcgcccccagcaaggtaggcgtagggcgagacaccacaacagccaggggatggccggcaacggacaacagacgcaccgtcgccacctctagagcccctcagcttatctacaatggttggagtggtgcctacgacccatggtggaccagcagacgaccaagtccaaagacaaagtgttttgaggccatcaaaggatggtcattcctcagacagagacaggggcaactgagggatgatgaattttcgcacttccttggaggaggcggagccatacaaccaggatcgccaaacttgtga

SEQ ID NO: 58939 - DNA, 555 bp, Glycine max
  Peptide Sequence Number=SeqID_150624
gtgacgggttgtaccatctgtggagaggctcttgaaataggccaatgtaatcccattgaagaaaacactcaagaaattcattatatgggaaatcaacagcggcaagggtatactccaagaggattttcaagcttccagcagggtccttataatcaacaagtacagtggaggtcgcacccgggtaatcagttcaacaaagaccagggtggacctttgaataggccaatccaacaagggcccaacatctttcagaggactactaagctggaagagactttgactcagtttatgcagatagctgacaagtcatccaacagttttgtggcaaatacagagaagaatcccagggaggaatgcaaagctgtgatgacaagaagtaaaaggtttgtggagaatgaggaagagaagagtgttggacacaagaagaaagctgttgaagagaaaggtattgatggaaggaaaaataataagagtagaagtgaaaaagctgtgaatgaagttgcggaagtaccatatcctgtggtaccttccaagaaggagaatgaccgccatttg

SEQ ID NO: 58940 - DNA, 247 bp, Glycine max
  Peptide Sequence Number=SeqID_150625
gaacaggatattccaagatgatgatgaagaccaagtcaacttgtgtctcatgacaaaatctgatgagaataacaaagaagattctgtaaggaagaaatggtacatagacaatggatgttccaagcacatgacgggtgatgtatccaaattcacaactatttcccccaagaaaagtggacatgttacatacggcgacaataatatcagtaaaatctcaaaagaggtaacatctaagccatctctatga

SEQ ID NO: 58941 - DNA, 165 bp, Glycine max
  Peptide Sequence Number=SeqID_150626
atggaggttgaggaacctttgttggggttatggcaaccattgaattatcaagtagatataggagcaaggatagcctttgtggatgactgggtggtgagtaaggagaaaggccgatattggctgagcgatgacattgttgggctggtgggaagtttggccatgtag

SEQ ID NO: 58942 - DNA, 237 bp, Glycine max
  Peptide Sequence Number=SeqID_150627
atggagaattacactaagcaatcactacgcatggctcctaactcgcatggctccaaactcgtgggtggagcacgcatgaatgaaaacgcaattcatggggctccgaaaaaggaacacaattcatggtgctccgaaaaacggttgagaattgagaattgtactacgcatgactccaaactcgtgggtggaggacgcatgaacgaaaacgcaattcatggggctccgaaaaagggttga

SEQ ID NO: 58943 - DNA, 549 bp, Glycine max
  Peptide Sequence Number=SeqID_150628
atggaagaacaccaggtcaccggtgcgcagctcgggacagacggcgcgcgcgatccatgcggcgttctcgggcgcgtcatcgcggaagaatttctgctcgtcgaactgcgccggcttgaacgccgccgcgtgcgaaccgggaatgaacgacaggccgccgttgtcccagttctcgtcgcccaacgccagccaacaggacatcaggtcggtatcggaaaacgaccaatagcggatgtcctggtgccagccggtcaggctgccataggcgggatgcttggtcatcacgcagttgtggtgcaccgtggacagcaccggcgtctcgccgaaatagcgcgccagcgattggccgatgcgcgcgttggtggcccattgcgcgaacaagggatcgcgcccataggcgctgagcaggcgccgcaccgtcaggccgccttcggcgttgcgcgactcgggcgcgccgggatagcgcaggtccgcctcgtattcgatgggcgccacgtgctcgcgcagatggcgctcggccagcgcgcgcagcgccgccacctcggccgg

SEQ ID NO: 58944 - DNA, 469 bp, Glycine max
  Peptide Sequence Number=SeqID_150629
ggtttgtctgtgtgtctgtgggtgtctcattaggggggtttgtgtctgtgtccgtgtgtgtcatgagggtgtttgtgtgtctgtgattagggtttctgggtgtgtcataagggagggtgatagggcatcaaccattgcacaaacactattcgcttacaaggcatcagcggcagcacaacaacggcagcaaggttcacttctcagtatctcagcaaatggaaagggtggggctgatgtggtgcaatgggtggaaactacaatatctaaggtaagggaattagaagtcgttgatcctaacattgcaggctctaggaattggctcgatgagatggaccaactcctccacattggtgctgcttgcacagaaagcaaccctcaccagtggttacacatggtggaagccgttagaaggataatggagattaaatttgagtgtggtcaacaatcaacaagccttgcagataggtga

SEQ ID NO: 58945 - DNA, 481 bp, Glycine max
  Peptide Sequence Number=SeqID_150630
tgtaatttacaaaacaaaagttgaaaggaaagatattgagctggtagacgaggaagaagcacagattggtgctgatcgttctagtgcaacctctaataaatgtgagatttataaggaggaagcacagaatgcagcacaaaagcataaagcaaagagggtggagagtgtcaatgttgatgcagaagcctttgctgaagcactagaacatacgaagaaaagagatacaggccatcaaagtgtgtcattggagaataagataggagattcaactatgctgaagatgggagattcagctaaagttgtgataaaacaagacatgaagggaagaaagcataaatatgggtttaacaacaataaacgtgagaagacagagaagaaaagggtggtggatgatgaaactggcgacaaacatcagctggatgaagtcctaaggaggcaaattgaaacaaaaaaccgatgcctcaatcagagaaaaatgtag

SEQ ID NO: 58946 - DNA, 168 bp, Glycine max
  Peptide Sequence Number=SeqID_150631
atggtgagcaaagtttggagctttgatggagacttcaatggtgaggaagaagaaaggaatagcaactccctcgcgtttctctgcacccgtcggggcccgttttcgaaagtaagcaatatgtatatcaaaacgctcagaatgaaaccccgagcgtggttcagaggttga

SEQ ID NO: 58947 - DNA, 435 bp, Glycine max
  Peptide Sequence Number=SeqID_150632
cgagcggggaattctgatatctatggtttcctcaagccacagtccattcagaggtctgggcaatcacagtttgagactgaaagttacataaagagttggatgcaaagttcaaaacatgatgtctaccttggagcctacctgaatggcggacactggcagatggtggtcatcgtgcccaaggaacacctagttgtctggttttgttcattgcataacaggccagacaactaccttaaggagataattaatagtgctttaaaaggtcttgatgatgctccacaacctaaatcaaaggctcctgctaggtggattgtcgtcaagtgtaatagacaaaaaggaatatttaacgatcctagaccattggagccagagagattaaaggccctgcggatccagtgggcacagtattatcttcgagttagagctcaaagctaa

SEQ ID NO: 58948 - DNA, 117 bp, Glycine max
  Peptide Sequence Number=SeqID_150633
atggccctccacaggatactaggctgccttgcagcgacgttttttgcttgtccagcgctgggaagggatgatgatctgtcggtcgtgaccctatcctctatttgcatccgtccctaa

SEQ ID NO: 58949 - DNA, 398 bp, Glycine max
  Peptide Sequence Number=SeqID_150634
atggttcatggcccatgtggaatttcaagagctgaatctccatgcatgaaagaagacaagtgcagtcgtttctatcctaaaatgtttcaaccatatacggttttagatgcagatggttatcctgactatcgtaggagaaacaatggtcacacaattgagaaaaatggtgttataattgataacaggtatattgtaccttacaatccaaaattgctcaaaaaataccaagcccatatcgatgttgaatggtataaccaaaacacttctatcaaatatttattcaagtacatcaacaaaggatatgacagaataactgttgttttgattcatgatgataatgatccaattcgttatggtagcactcataatgatgagatcaaagaatatctagattgcag

SEQ ID NO: 58950 - DNA, 216 bp, Glycine max
  Peptide Sequence Number=SeqID_150635
atggtgggttacacaccttcaagctttgtggatttggtcttcatcggcgaaaggatcaaagtgggtctggaaaaaggcaaatatgatcatcctgctttgatgaatgcgaaaattgagccaaggttgctcaacctccatttttctgaggatacgactcgaacgcaacatgtgcatatcatggaggagttccaggacattccattgagcactgtatga

SEQ ID NO: 58951 - DNA, 294 bp, Glycine max
  Peptide Sequence Number=SeqID_150636
atgaagcgttatctacagcacttggttcgccagcaggcagccaaccaccgtggactggtgcagatacacgagtgtctctaccatttcagccgcagtcagcaggggcaaagttccaccccttttgtgtgccctaccccagagcagtttgcggctgaggacgcatggccaggagactggtccgatgcccaggtaggggaggagcctacaggatcccccggtaggatggatgagccccgcatggacgaggatatgactgacctgttcgatttcttgggagggagcggagccacatga

SEQ ID NO: 58952 - DNA, 415 bp, Glycine max
  Peptide Sequence Number=SeqID_150637
tgtagttttcaaaagcaaaggtgaaacgaaagatattgagctggtagaggaggaacaggcacagattggtgctgatccttctagtgggacctccaataaatctgagaattataaggaggaagcatggaagaaaacacagaagcataaaccaaagagggtggagagtgtcaacgctgatgcagaaacctttgctgaagcagtagaacatacgaacaaaagagatacaggccatcaaaatgtgacattggacaagaagacaggagattcaactatgctgaagatgggagattcagctaaagttatgatcaaacaagacatgaagggaagaaggaataaatatgggtttaacaacaatgaacgtgagaaggcacagaagaaaagggtggtggatgatgaaactgtcgacaaacattag

SEQ ID NO: 58953 - DNA, 123 bp, Glycine max
  Peptide Sequence Number=SeqID_150638
atggagaaattgcgaacagcgctaggcaatgaattcgcggggctccagactcatgcgctaggcaatgaattcgcggggctccagactcatggtggaggacacatgaacagcgctaggcaatga

SEQ ID NO: 58954 - DNA, 444 bp, Glycine max
  Peptide Sequence Number=SeqID_150639
atgggcagctcaccaagatgtcttcctcgcctgacacgagaccaaatgcccttccactacgaatttcgaacttttggtggagtgtcagagggcacaactcccactggtggatccacgggcgccccaacagacagctgctatggggggttagcagatatccattattctcggataggtgacggtaatgacaggtgtgagggcctatttgtactgtcgcctttttccactctcccaagtctactagctctgtttcttcttgatgaggtcccatttcctggtcctcatgggcgaccattctttctaattctgggggaagtcccacatcctcgtttccttcatctttcgtttgactcatttcttgctcgaaagtcgataggcgggtcccaggtattagtaccttcgggggactcgtcatcggatctgccgtttcagaaaaagaagtaa

SEQ ID NO: 58955 - DNA, 222 bp, Glycine max
  Peptide Sequence Number=SeqID_150640
atgacttcaaaagaattgaacgaggagccatatgaagtgaaaatctcatgtacgtttcgtaagggaactggagcaggctaccatgagacaaaagattttctttctaaagaaattcgattcggaactacgatatgtccaaggtccaatatggaaagaatttcagaggttttccttgactttgtccgtgtcaacaaacaattcgaaatgcctcgacttttttag

SEQ ID NO: 58956 - DNA, 429 bp, Glycine max
  Peptide Sequence Number=SeqID_150641
atggtaggcaaagatttgggaagtacgggcggcccccataatgtgcaaattcaaaacgagcacgccttcccgccatatggctcgcctctcaactatacgccacccaatgtggcgtacactcccaatgaaatctcaacaactccactcccatactcattaagagccaacaacctcaatctgatcatgcacatgtctctcatggaggagacacatgaaattccccaccacaatctagctgacttcgagccttggctcggatatgccactgaagggcaagcagttggtggtatacccctgcaaaacactttggagggccctcagtttcgcccacaaccacaaccctcacgttccacagtggttaaaaaccctcatgactatggcagaaatgggaaagttggatcatctagaggaaaggctcagggccattga

SEQ ID NO: 58957 - DNA, 312 bp, Glycine max
  Peptide Sequence Number=SeqID_150642
atgactcatcattcatctagtgttaatggcgagggtactagtcataaagaccctttatctagaatcttagatgagttgagttccctcaatagtcataactcttgcaagagcctaagtgaagaacttcatgactattacgaaggaaggcataggtcacatcttagacctcactcccatagaagagaaaaggaaagaaagcctcaagaggctaacattaacctctcttacttccatgggaaggacaatgtagaggctaacttagattgggaaataagggtagagcaacaacttaaaaagaagtctacttcataa

SEQ ID NO: 58958 - DNA, 51 bp, Glycine max
  Peptide Sequence Number=SeqID_150643
atgcctttgcggggtaggattgcatcaagatttttgagcccatgggtcaag

SEQ ID NO: 58959 - DNA, 280 bp, Glycine max
  Peptide Sequence Number=SeqID_150644
tagcatagacattgctattgtaaaggagttttacaccaacctctatgaccccgaggataaatcacctaagcaagtgagggttcgcactcctatagtgatgggcagctgtcgcaacatgcccttttgcgggcgagcgaaggcgaggctcacggatgcgctttccaaaggaggaaaggtgcgcagagtcgccaccaacgtttatttgtggaaaacgtcggaaaaaccgaaggaaatcggtcaaaatgaaaattctaagttcgggagttgtatttacgtttga

SEQ ID NO: 58960 - DNA, 168 bp, Glycine max
  Peptide Sequence Number=SeqID_150645
atggaaggtatagtaggagcgagtacagagacggggagaatcaccttgagaggtactaaaggccgtggatcgagcaccgggatcctcttgaaaagggtaagatctaggttaggcggccaacctcgcaatatggaggagagcgatcgtgcttatgctttgaccaggtga

SEQ ID NO: 58961 - DNA, 171 bp, Glycine max
  Peptide Sequence Number=SeqID_150646
atgttagaaaaaccaaaaagggggtttgcaaattttagtgataaaggttcaggagtagtttacgtgcgaggaagaaaatgcggggaggaggttgaacagcagctctcccaagcgagctcaacttgcccaggcgagttattgcctcaacctgaaataaccttgctcgcctag

SEQ ID NO: 58962 - DNA, 399 bp, Glycine max
  Peptide Sequence Number=SeqID_150647
atgcaatggcggttccaaagtcagaaaagatgcaaagacaagctgaaactaacaagaaacaagcatagaaccatgggtttcgttctctaccgaaaccgcaagccaagttggaagattttgcttcggtcgaagggctcctctcagtgtggggttgcaacggagaacaacggcggtttgtggtggctaatagtggctgtgggtgatggagaaagtgcttgggacgttagaaatggttttggaagaaagaaaggagaagaaatggtgtttttcctaagctacacgaaagcaaaagctgaaaacgctcaagtgagaaatgctctcgggaatagaagcttcgcgcacactccagacatcttctcaaagatcccaatggtcatatcgtggacaagtgtcttgtga

SEQ ID NO: 58963 - DNA, 481 bp, Glycine max
  Peptide Sequence Number=SeqID_150648
gtatggtgctactaggcaccctttggacccagataagtccaacagggccctgggatttcccgcactgatcacaggactatgccagtcgtttggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggatcagtatttacgacatttgatgagcctcagcatgcagagccagggcttcgcttctttttcatgccctactccagaccagttcagggcagaggtcgcatggcctggggattggcccgaggcccaagcaggagaggtgcccccgaaagttcccggcaatggagaggaggcccacgaggacgaggagatggccgatttgcttgacttcttgggagggagtggagctacatga

SEQ ID NO: 58964 - DNA, 267 bp, Glycine max
  Peptide Sequence Number=SeqID_150649
atggagcttgcatcacatagaaccgtgggttcctctcggtgtggggtttcaacggagaacaacggcggtttgtggtggctaatggtggctgtgggtgatggagaaagagcttggaacattggaaatggttttggaagaaagaaaggagaaggaatggcatttttcctaagctacttggactacaaggctcaaaacaaacaagtgagcaatgctctcggaaacagaaatgtcgcgcacactccagacatcttctcaaagatcccattg

SEQ ID NO: 58965 - DNA, 453 bp, Glycine max
  Peptide Sequence Number=SeqID_150650
atgccgatctccccttgcggaagtatcagttggtctatgccgtcccgacatagggatcgcacccacaagacacccagtggacccggaaaagtccaacagggccctggggtttccagctctggttacgggcctctatcagtcctacagggtgcccgtacccccccggcaaggtcacgtcatcatagttctacggagtacctgtcacctccagcaagggcatcaggcccccctaccaatcgagctttcatcaagaagtgctgcgcccccaggcaggcgcagggcgaaacaccacagcagcattgggatggccgacagcaggaaacagacgcaccgccatcacctctagagttcacctctgctcatccacaaaaaggtttgagtattgcctacacaacatggccgaccaataggcgaccaagtccaaagccaaatgacgcacctagttgctcatga

SEQ ID NO: 58966 - DNA, 276 bp, Glycine max
  Peptide Sequence Number=SeqID_150651
atgggcctcttccagttatacggagtgcccgtcgccccccagcaaggtgtagggcgagacaccacaacagcctggggatggccgacagcgggcaacaggcgcactggcgccacctccaaagcccctcatctcatctacaaaggctggagcgttgcctatgacccgtggccgactggcaggcgaccaagtccaaagccaaaggtaagcaaaagtactaggtccgtgaccaacaagtcatcacgcgtccagctcaagacgttaaagaagcgctactag

SEQ ID NO: 58967 - DNA, 456 bp, Glycine max
  Peptide Sequence Number=SeqID_150652
atggcaggagctggtgacaatggtggtgtatatcatcaactggacggatttcaacgcttgttactggacgcgatgactacacaaatgcaacgtttgttgaaccgtaataatgaagtgctctataggcgaatagaacgactagagcaccaaatgaatccaaatgttgggagaccttatggtggcaacaggagggagatgaagattcagcatgcattctcctacaatgattatccggaaaagcagaagatagatacatggactgagatgagaagggttgtgcgaaagaggtatgctccaactagctatagtagaaccatgcgacagaaactccagaggttatctcagggaagtttgattgttgaggacaaggagatggagatggcactagtgagggccaacattgaagagaacaccaaagcaatgcatgatggcttcaccaacaagatttctttctag

SEQ ID NO: 58968 - DNA, 404 bp, Glycine max
  Peptide Sequence Number=SeqID_150653
atggcgcccaccaggcaccctctggacccagataagtcaaacagggccctggggtttctggcactgatcacgggtctctgccagtcctatggagttcccgtcacccccagtatagtaatccgactgccgatcacccgagccttcatcgagaagtactgcacgcctaggcaggcgcaaggtgattcacatcaggtcgcagacgcaccgccaccacctcggcaggccgatccagctgggcggccaaccatcgtaggaaggtgcagatacataagtgtctctaccggttcagcgtcagtcagagaggagcctgcaggatcccccaatgaggcagaggagtcccgtatggatgaagatatgattgacttgctcggtttcttgggagggagcggagccacgtggccaag

SEQ ID NO: 58969 - DNA, 492 bp, Glycine max
  Peptide Sequence Number=SeqID_150654
atggcgcctaccaggcaccctctggacccggataagtccaacagggccctgggatttcccgccttgattacaggactctgccagttgttcggagtccctgtcgcacctagcaaggagattcggccgcccatcacccgagctttttttgagaagtattgcacgcagagacaggtccagggggatgctctgcaggccgcagacgcgccgccacctcatcaggccggtctgaccggattgtttgatacggagcagtatttgcggcatttggttcgccagcaggcggccaaccaccgggcacatagccagggctttacttcttttccgtgctctactccggaccagttcagggcagaggtcgcatggcctggagattggtctgaggcccgggcaggagaggcaccagcagaggctcccgacgaggcagatgaggcccgcgaggacgaggagatgactgatttacttgatttcttaggagggagcagagccacatga

SEQ ID NO: 58970 - DNA, 555 bp, Glycine max
  Peptide Sequence Number=SeqID_150655
atgaatgttggagccctcatctctggacagatcactcttagggctcagtccaactcctcgaggctcggatttccatccctcatcactgccttacgcatggctcgaggagtcaccttagattccatgatttttgagtccttcagcctagccattaactttacttacataaagaagaactattggaacttggacgaccctacggccagctttccagggactcgcaaggccagggctagaggatctaagggtccatcttctgctactccccagacatctactacaccagctcctattcctttagcaccaagtttgcatagtttggctcaacatcagccaattatgagtatggaggagttttctttgcaggtggcctggccaggagtccaaccttcttctcacggaggaggtgaggcctccacagctcaagagcctcaggcagatctggagactacacttgttgctcaggaggatgatttagaggccattcccccagagtcatttgtaccagaaactgatccagaggcgaatccagtggttgcagaggccaatccataa

SEQ ID NO: 58971 - DNA, 567 bp, Glycine max
  Peptide Sequence Number=SeqID_150656
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacgctcttttaaggcaatcaaaagcctctttgcatctgtcattaaagtcaaactccacctccttttgcaacaagttggacagtggaatggctactttgctaaaatcccttataaagcgcctgtcgaatcctgcatgaccaagaaaagatcgcacctatcgcacacaagaggggccgaaaggcatcctcctataggcgaaagtgctgaaggg

SEQ ID NO: 58972 - DNA, 550 bp, Glycine max
  Peptide Sequence Number=SeqID_150657
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagctaatgcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 58973 - DNA, 821 bp, Glycine max
  Peptide Sequence Number=SeqID_150658
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcagttctaacaacgtgaccccattaaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58974 - DNA, 226 bp, Glycine max
  Peptide Sequence Number=SeqID_150659
gcctaactcacaaaaaggtccccagtggagtcgtcaactgtcgcaacatgcccttttgcgggcgagcgaggcgaggctcacgggtgcgctttccaaaggaggaaagatgcgcggagtcgccaccaacgaaggtattagcacctctcacgtcgacaaaagcggggctcttgctcctacgtaccctccatcgaagaggaaatcagaccttcgtagttcttccttaagg

SEQ ID NO: 58975 - DNA, 231 bp, Glycine max
  Peptide Sequence Number=SeqID_150660
atgccagacattcgcagacaatgtcaacgctctgcccctgcctctgaatatcttggccgcaccgtggtcgttttccatgtgtgggattgtcgcaacctacccttcggcgggagggtgacgcgtgactcgcaggtgcgtctcccaagaaaggaatacgcgtggagtcgccaccaacgtttatttgaggaaaacgtcagaaaaaccggaaaagacgtggtctacaaattttaa

SEQ ID NO: 58976 - DNA, 441 bp, Glycine max
  Peptide Sequence Number=SeqID_150661
atgaagcacttcactgacaccctcatcagtgccaacatactagtagaattagaacatgaaggaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 58977 - DNA, 219 bp, Glycine max
  Peptide Sequence Number=SeqID_150662
atgggaatcaaatcacctgcagaagatcttctttgcatacaagaacagtacaatagttatccagttcaaaagaacaatgaatttactttttgttcatttatgtctcaaggaaatttcaatggggggttaccggaaaacgcaccggatcgtcaagtatttaaaattaaagcggatgaattcgagtatcgaacacagggaactaatgttagcctgaattaa

SEQ ID NO: 58978 - DNA, 186 bp, Glycine max
  Peptide Sequence Number=SeqID_150663
atggcttttgctttggctaacagacgcggaagcgcatcaatcaccctccctcttgcttctttttcggcatacacttgtgcgaaatcctcgactaacttttgttcatgggtcatggactggttcaattcttccttgtattgccctatgatacctagcatgctttgctccgtggcttccaagtgttga

SEQ ID NO: 58979 - DNA, 210 bp, Glycine max
  Peptide Sequence Number=SeqID_150664
atgatgacaaaggtgatgacaaaaagctcaaagatcaatcaaagaatgagttcaagatattcaagattcaagaggaaagttgatttcaagaatcaagaatcaagattcaagatttcaagaatcaagaatcaagagatcaagatttcaagaatcaagattcaagagatcaagattcaagactcaagattcaagaatcaagagaaggcttaa

SEQ ID NO: 58980 - DNA, 552 bp, Glycine max
  Peptide Sequence Number=SeqID_150665
atgtcctcaccttcagagggctacatgccctcgccatcagaggactgcataggactgcatgtcctcaccttcgtagggctacacgccctcgccatcagaggactgcatgtcctcaccttcgtagggctacacgccctcacctttagaggatcacacgtcctcaccttcagagggctacacgccctcgccattagaggactgcatgtcctcaccttcagagggctacacgccctcgccatcagaggactgcatgtcctcacctttagagggctacacgccctcgccatcagaggactgcatgtcctcaccttcgtagggctacacgccttcacctttggaggactacacgtcctcgccaacagagggctgcacgccctcaccttcagaggactacacgtcctcaccttcagaggactacacgtcctcgccttcaaagggtcatgtaccttcacctttgtagggctacacgccctcaccttcaaaggactacacgtcctcacctttagaggactacacgtcctcgccatcagggggacatgccctcacctttag

SEQ ID NO: 58981 - DNA, 276 bp, Glycine max
  Peptide Sequence Number=SeqID_150666
atgcagcctatcatgagcatggaagagttcattagccagttggcttggctaagagtctatcgttctcctttgggagggggtgaggcctccgcagcccaggagcctgtgctagaggaggacgagcccatccctcctaagccatttgtttatgagactgatccagctagtgctctagaggaggtagcatcaccgaagcttgttcctcagtcatccccatcacaagctccagtccttgaagacccagagccatctgcaccagcaccgatacctgattag

SEQ ID NO: 58982 - DNA, 301 bp, Glycine max
  Peptide Sequence Number=SeqID_150667
atggcggaggtctccacagaggccattgcctccctcacccagtattatgaccggccgttgaggtgcttcacctttggggacttccagctatcgcccatggtggaagagtttgaagagatcctgggattccctctagggggaaggaaaccatacctcttctcaggattctatccctctttagctagaatttctaagataatccaaatctcggtgcaggaattagaccacagaaagcaagtcgaaaatggggtggttggagtactgagaaaatgtttggaggcaaaagcaagaatcttggaag

SEQ ID NO: 58983 - DNA, 81 bp, Glycine max
  Peptide Sequence Number=SeqID_150668
atggataagagcttgaaggtagaaaaagatgagtggagggagaaggagagaatgagcattaaattttgcgcctcaaaagag

SEQ ID NO: 58984 - DNA, 362 bp, Glycine max
  Peptide Sequence Number=SeqID_150669
atgcaggatttagaagcagcaacaactccagaagaagaacctcgatcttccgaggcatcttctagttttcctattgcagaccattctcatatagaacctgttgaagacccaatcatggctcaagagccaagaagagttaccttggaggattattcaagctctattgtgctacaatttttcacaagtattgcacaaccagaagttcaagctcagacaattacatatcctccttctttgatacacctgattcaaaataatctgtttcatggtctacccaatgaagacccttatgctcacttggcaacctatatagagacatgcaatactattaggttggcgggtgtgcctgcggatgcaattag

SEQ ID NO: 58985 - DNA, 356 bp, Glycine max
  Peptide Sequence Number=SeqID_150670
tctttgttggccagtgctgcggctttcttcaccatcaccatgccacggacaaactcagggatgtcgctgattttgctgttgctgatgtagaagttttcaatcgctctcagagtgtgaacaccgtagtaggcatccgctggaacttccctgggcttcaaaaatttcctgataatgcagcagaagatggccgcaggcgaaagcccggctgcggagatgatcaaaagcgtatcgctgattattgctggtctgctgctgatcctgccggggttcttcaccgacttcctcggccttctgctgctactgccgccggtgcaaaagcacctgaccatgaagctgctgccgcatctgcgctttag

SEQ ID NO: 58986 - DNA, 372 bp, Glycine max
  Peptide Sequence Number=SeqID_150671
atggccagaacacgaggtttaggtcgtgtcataggtagagttgtaggcagaaatagacctgctgaccaggatgctgctgatgttcccgagaggcgtaggcctactgcctcagcccgtaggctacgtgttcatcagatgactacggagggacgtgatttggttgaggacgtcgctggcatgactgacgatgttcctgagcatgcttcggaggcacctgagatgcgtgcggacgcacagggtgctgatagtggtgaggggtcggatggtgatgatgctgctgagggattccatggtggtccacgtgacccgtcagtgctcacatcatttgccgagcatgttgcacatgttgtttggagtggacatgtattttaa

SEQ ID NO: 58987 - DNA, 498 bp, Glycine max
  Peptide Sequence Number=SeqID_150672
atggcgcctaccaggcaccctctggacccggataagtccaacagggccctgggttttcccgccttgatcacaggactctgccagtcgttcagagtccctgtcgcacctagcaagagacaggcccagggggatgctccgcaagccgcagacgcgccgccacctcatcaggctggtccagccaaatcgtttgatacggagcagtatttgcggcatttggttcgccagcaggcggccaaccaccgagcacatgtacagacccatgattgtctttatcagatgagtctcagcctgcagagccagcgctttacttcttttccgtgccctactccagaccagttcagggcagaggtcgcatggcctggagattggcctgaggcctgggcaggagaggcaccagcagaggcacccgcagaggctcccgacgaggcagatgaggcccgcgaggacgaggagatgaccgatttactggatttcttaggagggagcgggaccacatga

SEQ ID NO: 58988 - DNA, 510 bp, Glycine max
  Peptide Sequence Number=SeqID_150673
atggaagtgtcagttgggatcgcgcccacaagacacctagtggaccctgagaagtccaacagggccctggggtttccagctctggttatgggcctctgtcagtcctaccgagtgcccgtccccccagcaaggatcgcgtccgttagacacccagtggacccggagaagttcaacagggtcctggggtttccaggtctgattacgggcctttgtcaattctacggagtgcccgtcgcccccaacaaggtcatcaggcccctattaacagggctttcatcgagaattactgcatccccaggtaggcgcaaggcgaggcatcatagtagcgggcaacaggtcacctccaccacctctagagttcacctcagctcatccacaaaatggttagagcgttgcctacgacacatggccgaccagcaggcgaccaagtccatagccaaagctcaagacattaaagaagcgctattaggaggcaacctagtaccttttaaatctctgcttgttatttga

SEQ ID NO: 58989 - DNA, 261 bp, Glycine max
  Peptide Sequence Number=SeqID_150674
atggcctcctatggtggattcacaagcgattctcctcaaattttagctagcctgcatcaattagactttgcaccttatgcttcaaggccctacaatgctcaatggaatgccccggggcttctccatgacaagcacacgttgcgttcgagtcgtatcctcggagaaatggaggttgatgtaccttggctggggttatggctaccattgaattatcaagtagacatgggagcaagtcagcataggacaccggaattggggtga

SEQ ID NO: 58990 - DNA, 150 bp, Glycine max
  Peptide Sequence Number=SeqID_150675
atggaggttgaggaaccttggctggggttatggctaccatttcattatcgagtagatatgagagctggctttgtggctgatttaggggtggcctttgtggatgattgggtgttcttggctgatagggtggtgggtaatgagaagggctaa

SEQ ID NO: 58991 - DNA, 111 bp, Glycine max
  Peptide Sequence Number=SeqID_150676
gacgcatccgtgagtctcgcgtcgccctcccgccgaagggtagtgtcataccctaatttcgtccggggacctttgcttgatgacaagcgacctttctttggtccttgtgag

SEQ ID NO: 58992 - DNA, 492 bp, Glycine max
  Peptide Sequence Number=SeqID_150677
catcatcacctcatcccactgggtgacgtccacggggcgctgcaccgggcgcgtcatcgccgggacgggcggctgggctttacgctgcgaaacaaaatagccggagcgcggctggggcgtgatcagttggaggttttcaaggatctgataagcctgctgtatggtgctgatgctcacgccgtgctcctggctcagcgtgcgcaccgacggcagacgttcgccgctgcgatacagcccttgttcaatgcgttctgccaggagattggccagatgttgatagcgcgtcatgctgtatcctttgttttcaccatacagattgtaaaaccagtacagattgccgcggatttccaggatgataaccccactggcacagtgaggagagcatcatggaatttttcgagaatcgttctaaaagaccgtttatcgtgtttgtctggatcgcgaaaacgctgcgtaactggtatcgcatcaaccgtacccgccgcatcctga

SEQ ID NO: 58993 - DNA, 294 bp, Glycine max
  Peptide Sequence Number=SeqID_150678
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacaactcagttccgg

SEQ ID NO: 58994 - DNA, 327 bp, Glycine max
  Peptide Sequence Number=SeqID_150679
atgtgtggcatctcttgtcaatgtcaggatttacacgcgattctcctcaaatttcagccagcccgcatcaatttgaccttgcaccttacgcttcagagccctacaatgctcaatggaacgcctcggggcttctccgtgacaagcacacgttgcgtttcgagtcgtattctcggagaaatggaggttgatgaaccttggcttgggttatggctaccattgaattatcaagtagatatgggagcaagctttctcactgcaaaaattcattttttggttggtgtttttggtttgtgcgagaggtggtgttcgtcattggaagtgcggtag

SEQ ID NO: 58995 - DNA, 309 bp, Glycine max
  Peptide Sequence Number=SeqID_150680
atggaagagggggaatgtgctgcttctgcaaatcagaattacctgtggaagaagttcacctgcacagaaattgttaggaatgtatggtctgcttgggccagcaacattttggaaggaaggagcaggctgctattgttgttgctgagggctggaccatctgagattagggtgattcctccatccagggttgtatctgttgctggagagcataagcttcaggctgctcaattgctccaggttgctgcatggaagggcaaaggtctgtatggtggtcagcagaggagcacaaaccacaaacccttgcgatag

SEQ ID NO: 58996 - DNA, 144 bp, Glycine max
  Peptide Sequence Number=SeqID_150681
atggagaattgcactaaggatgagaaaggggaattgcactatgcaatcactacgcatggctccaaactcgaaggtgaaggactaatgaacgaaaacgcaattcatggggctccgaaaaggattgagaatggagaattgcactaa

SEQ ID NO: 58997 - DNA, 318 bp, Glycine max
  Peptide Sequence Number=SeqID_150682
atggcaaccacgaagctcacaaagcttatggattcttcgaggaaaatcgctaaccttctaggttgtggaaatcacaaacccaagcaagagtgttgttctgtttgggtgtcagaggtggtggttgaaaaacatggttgtcgcctgaaacatgtcatcatcaacgttattcccattgaaaggagttcctcatcgtacacctcagagccccgaagtcgcgtgatgtgtttgtgtaacgtagaggctccgttggtgacatcgtggactgaggataattcatggaagctttttatggttgtggtctatataagggtaatgtga

SEQ ID NO: 58998 - DNA, 712 bp, Glycine max
  Peptide Sequence Number=SeqID_150683
ggttgagagtgctcattggtcactaaagagactcctacaaaactctgttggtgacatatgcagtgtttgggaagcaatgaataatatgatgacacttcaacacacccagattaaagcatcttttgagacaagcacgcacgtggttgggcatgtgtttaaagtaaccttgttcaaaaaaatacttggcatggtatcaaggcaaaaatccttcacgttgtggatttgtcatgaggagtacccacggtatttcatgtgcattttttcagatcaagggttatgtgggacacaggtgaccataactgaggagatggaaaccatatcgaaacgctttgagcaactcgatgtttttggcaaagtacatttgaagtcaaagctacaagaaattgcttatcctggtatgaactctatgtgtcctcctccagaaaaggattctattgaaaacattattgatgtcaaagcggatggtaattatggttatcaggcaatagctgtgttattgggtatgggtgaaaaatcgtggtcattggtgcgcaaccatctgcataaagaactgacaagctggtccgaagagtatatcaacctggttggtggcatacagagatttgaggaattaaagctttccctatatgttgacggattaactatggttaccatggacaagtggatgaatattacaaatatgggatatgcattgcttcacgatacaacgtga

SEQ ID NO: 58999 - DNA, 420 bp, Glycine max
  Peptide Sequence Number=SeqID_150684
atggaaaaatccgacaagaaaactttcaaagataagaaaggaaagaaagcatatatcacttgggaagataatgacatagattcatcaagtgattcagaaaatgaaatcataaatctaagcctcatggccaaagactatgaaagcaaagaagaggactccttgaagcaaaattggtacattgatagtggttgctcaaaacacatgacgggagatgcatcaaaatttactcatatttctcacaagaatagtggacatgtgacatatggagacaacaacaaaggacataggactaataatgtgtacatgataaatctagataaagccccaaatcaagctcaatgctttctaagtaaagaggatgaatcatggttgtggtataggagaattggtcatataaatatggaacaaaggaaggaatag

SEQ ID NO: 59000 - DNA, 829 bp, Glycine max
  Peptide Sequence Number=SeqID_150685
gccgttacggtgtcgtgagttgctacaactccctgccgctggctggcggcggcagtaccctggtgcgcctcaacctcaaagccattgccgaacacagcacctccctcgacgattttttcacccgtacgcttccccactactgccagcagcagatcgccatcatcgatgcccgctgcgattttctgtatcaacagtccggcttctttgagaatagcttcctggtgaaagaggggctgattgatgccgatcggtttgtgcccatgtttggcctgtacggcctcgcggaagcggtcaatgcgctctgtgaaaaagcaggtatcgcagggcgttacggcaaagatgagcaggccaacgcgctgggctatcgcatcagtgaacagctggcggctcggggatcagctctgattcgggtaccacgccgggcgcgcgtctgccctacggcgacgagccggatcccatcagccaccttgctggccgtggcccctcatcaccagtactatcattccgggataagcgacatactgacattggatgagacggtaaaacggaatccccaggcggtggctcaactctgtctcggcgcgttcaacgcgggcatgcgggaatttacggccaacgtcgcgggtaacgctctggtccgcgtgaccggctatatggtgcgattatcggatctggagaaataccgggaagcaggttcgagaaccaataccacggctgcaacctgcgctgcaaaacctgccataatccgtggacgatcggccgctgcaacgactgtggagactgcgttccccactgccctcatgaagcccttagcattcaggccggacgc

SEQ ID NO: 59001 - DNA, 345 bp, Glycine max
  Peptide Sequence Number=SeqID_150686
atgtccaaatcttgtggatttgggatgaccggccctctcgatgagtcgatttcttgctttctcataagggtggacccttgggtacttgtacctatcgcctttagaggactacacatcctcgccttcagagggctacacgtcctcaccttgagaggactacacgtcctcgccaacagagggctgcacgccctcaccttgagaggactacacgtcctcgccaacagagggctgcacgccctcaccctgaagaggactacacgtcctcgccaacagagggctgcatgccctcacctccaaaggactacacatcctcgccttgagagggctccacgccctcacctttag

SEQ ID NO: 59002 - DNA, 234 bp, Glycine max
  Peptide Sequence Number=SeqID_150687
ggacatgcagatatcctcatagctaggttccctaaccctagctatggtgttaaaatgggttcctctcggtgtagggtttcaacggagaacaacggcggtttgtggtggctaatggtggctatgggtgatgaagaaagtgcttgggacgttagaaatggctttggaagaaagaaaggagaaggaatggcgtttttcctaagctacacgaaagcaaaggctgaaacgctcaaatga

SEQ ID NO: 59003 - DNA, 512 bp, Glycine max
  Peptide Sequence Number=SeqID_150688
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgcttctcctggtcctgcctttcggtttaccgttcgctccagctggactgtatgcacgaacccccgttcagtccgaccgctgcgccttatccggtaactatcgtcttgagtccaacccggaaagacatgcaaagcaccactggcagcagccactg

SEQ ID NO: 59004 - DNA, 505 bp, Glycine max
  Peptide Sequence Number=SeqID_150689
atggtgccccgggtgatgttggggaatgactacgagcccagaatgggtttaggcaagaacaatggtggcagaaccagcctggtaagcaccagaggaaaccgcgggaagtttggattaggctataaacccacacaagcggacataaggaaaagtgtcgcgggaaggaagagcagaagccaaggtttgcaattaggacgactagtcgaagggggctcgccctgccacatcaataggagatttataagtgtgggtctaggacacgaaggccaagtcgttgcgatatgcgatgaggactctctgagtgggtcagatttggacccgaccatcggtttcaagcaagaagtggatcagatggagagtgaagaggatgaggatgtgggacttcccccggagttggagaagatagtcgcccatgaggaccaagagatggggcctcatcaagaagagacggaactagtagacttaggaaacgacagtgggaaaaaggaagtgaagataggcacgg

SEQ ID NO: 59005 - DNA, 495 bp, Glycine max
  Peptide Sequence Number=SeqID_150690
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtttatttgaaacatgatgctggacatgatatcccgcgagattccaagtcagctttggatatagcaaaaggaattgcacaactagctgaattgacaatcgatgcaactcagctgtag

SEQ ID NO: 59006 - DNA, 975 bp, Glycine max
  Peptide Sequence Number=SeqID_150691
atggctacctcaccaaaagaaacttcagctcctggttcacccgctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatacgcagtattgtgagtagcattttgaaagacgcctctgttcctgaagctgatgaagatgtcccaacatcgtccaacccaaatgtttttgtgcctgatgtcaataaagatgttccaacatcttccgctccaaatgctgaagccctcccttcacccagtgaagaggaatcaacagaagaagaggatcaagcctcagaggagacccctgcaccaagggcaccagaacctgctccaggtgacctcattgacttagaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaagaggaaagaaatttccttttcctcatccgattctgatgatgatgtcgaactagatgtctcgacatctaagagggccaagaaatctgggagaaaggtgcctggaaatgttcctgatgcaccattggacaacatctctttccactccattggcaatgttgaaaagtggaaatatgtgtatcaacgcagacttgcggttgaaagagaactgggaagagacgcattggattgcaaggagaccatggaactcattaaggctgctggactactgaagacagtcaccaaattgggagactgttatgaaggccta

SEQ ID NO: 59007 - DNA, 273 bp, Glycine max
  Peptide Sequence Number=SeqID_150692
atggtgggttacacaccttctagctttgcggatttggtcttcgccggccaaaggatcgaagtgggtctaaaaagaggcgaatctgatcattctactttgataaatgcaaaaaaacctggggcaaatgaagagggtgagaatgaaggagaaacccatgatgcgactgccattcctacatggccaaacttcccaccagcccaacaatgtcattattcagccaatatcagctccactcattacccaccacccagtcatctacaaagttatccctaa

SEQ ID NO: 59008 - DNA, 438 bp, Glycine max
  Peptide Sequence Number=SeqID_150693
atggcgttggccttcgtgcgtcaacagccgttcgtcgcctgcaccctgctgggcgccaccacggtggatcagttgaaaatcaacatcgacagcctcgatgtgaaatccatacccggtttaccattccggcgccttaatacagcaagggcgcagcctggctgcgccccgtttcaccgccgctgcgaccaccatagcgcgctaatcgccagcgcaaacaccacgccaaaccctacgccgacgcccaccaccggcacgcccagcttcaccaccagcgaatacagcgccagcatcagcaacatggcggcgttttcacccaggttttgcaccgcgatcgcattgccggcaccgactgaatgcttgccccgctcctgcagcaacgcattgagcggcaccacgaaaaagccccccagcatgccgatgatcgccaacaagacatag

SEQ ID NO: 59009 - DNA, 594 bp, Glycine max
  Peptide Sequence Number=SeqID_150694
gtttagattggctcgccaagttaaagattgtcaacgaagagaacttcgaagctccggaagaggatgaagaagtccgagctctgaaaaccgaactaggaaaagcgagacttgccaaagaaaaattcaagttggtcgctacagacattcggaaagagtgtgccgggttacgagaagaaaatgcagctatcgcaaaagcccttgaacaagaaaccaagagggctcgcaaggaagaacatggccgtgacaaattccgtggagcattgtgggggcaacaacagtccaaaagaaacttgtctcagcgtttatgcgagacagagaccaacatgttagctatcatcaccaagtaccaagaagaactaagtctagccatggcccacgagcatagggtggtggacgagtatgcccaaatgtacgcgaaaaaggaggctagaggaagggtgatcgactcgttacaccaagaggcaaccatgtggatggaccgatttgctcttaccttaaatgggagtcaagaacttccccgattgctagccaaggccaaagcaatggcagacacctactccgcccccgaagagatccacggacttctcgactatt

SEQ ID NO: 59010 - DNA, 489 bp, Glycine max
  Peptide Sequence Number=SeqID_150695
atgggtgatcaagaggagacacaggaacagatgaaagccgacatgtcggctctgaaagaacagatggcttccatgatggaggccatgttaggaataaggcagctcatggagaaaaacgtggccaccgctgccgctgtcagttcggctgccgaagcagacccaactctcttggcaactgcgcaccatcctccctcaaacatagtaggacggggaagggacacactggggcacgatggcaaccctcacctgggatacaaccgagcggcttacccttatggattgtcgcccaactactcaccactcgtcttgcaagacgatgcgggccctattgcttctcccgtccttgaaagagagcctcctcaacagcccgacgaggtccacaaagaccttcaagactatgctcgaagggatgtcgagttctatcccccgattcccgaagggacggcacccagcatgttgcctcagcccaacatcacgacacaaccaata

SEQ ID NO: 59011 - DNA, 243 bp, Glycine max
  Peptide Sequence Number=SeqID_150696
atgataacaaaagatgatgacaaaggtgatgacaaaaagctcaaaggtcaatcaaagaatgagttaaagatgttcaagatagaatcaagaacacttcaagattcaagaggaaagttgaatttaagaatcaagattcaagagatcaaggttcaagaatcaagattcaagaatcaagaaaaggctattcaagaatcaagaaaaagcttaaccaagataagtatgaaaagtgcctttgaacgttga

SEQ ID NO: 59012 - DNA, 1361 bp, Glycine max
  Peptide Sequence Number=SeqID_150697
cggcacaggtgaagcgcgcgctgctcaccggtattggtctggtgcaggataaaatcggccggctcaagtcagaggtgcagagcgatcccatgaccagcctgctcaatcgccgcggcctgagcgcggtgctcgactatttcgataccatgcagcagtcgtttgccgtgctggcgctggatattgaccacttcaagcgggtgaatgataacttcgggcatgatgttggcgacgaggtgatcaaacaggtggcgcgcacgttgcgccagagcgcgcgtcagaccgacgtggtgtgccggaacggcggcgaagagtttctgatgctgcttcccgccaccgcccctgatgaagcgcgggtgattgcggagcgcgtgcgcaccagcattgccggcggctggattgatccggtcgggcagatcacgatttcgattggtatcgccagctggcagccgacgcacggcagtcaggaacagattctgaagcaggccgatgatgcgctgtatcaggcgaaaaacgccggacgtaactgcgtggtgatcgccgggcaggaggcgctggccagcacggtaatcgagcacgatatcgtggtggttcgaggttttaaaatcgtcgaacaccttctccactttgccatcgccgccaatcaggaagctgatgcggtgaatgccgtcgtaggttttccccataaaggttttctcaccccagacgccaaactgctcgcaaacctgatgatcttcatccgacagcagggtgaagttgagcaattctttctcgacaaagcgagacagtttttccggcttgtcgaccacaggcctgcgtggtgcagcccggcgtcatggctttcgggtagaaatagaccagaacgcgctgtccctggaacggcaaaagcgccaggtggagtttacctcagggttatttcactacacggtatgccggcgcggcagagtgtgtggcggaataacccggagcctgattcagacggcgctgtgcgcgtcgtcgttcttcgcacagccgatggaaagcctgctcaaacggtgcgctggcatgattcgccgggctgtgcgcggtcatctgaatatagagcaccggcggcgcgtcacggtagcgggcatcggcggcgtgacgcgcgcgttggtgcgcttcatcacgatcagcagctccagctcggcacccttcatcggcagggtcgattcaatcagggtaatggcgttccagctgccggagagcagcataataaaggtgaactcgtcgcccagcatcgccaggcggctgtcttcaatattgcaaccacagctgctgacgtggcgggtaatggtattgacgatacccggacgatcaacgcccagagcggtgatcaccagatg

SEQ ID NO: 59013 - DNA, 360 bp, Glycine max
  Peptide Sequence Number=SeqID_150698
atgagtgagctaactcaccacattaattgcgttgcgctcagctgcccgctttccagttcgggaaaccatgtcggtgccaactgcattaatgaggccaacgcgcgggcgatgagtgcgggcctcttgcgtattacgccaggcgctaggcggagtgtatactggcttactatgttggcctgtgcagggtgttccagtgaagtgtctgtggcagaaaaaaaggctgcaccggtgctcagcagaatatgtgaatacaggactcactattccgcttcctcgctcctgactcctacgctcggtcgtcactgcggcgacggaagcttagaactggggcggaatttcccccggaagctgcaggaatga

SEQ ID NO: 59014 - DNA, 264 bp, Glycine max
  Peptide Sequence Number=SeqID_150699
atggctgcaagtgacattactattcccagagatagagctcacataccaacaaagaaaagtcttctggaacttacatcgcaagatgcattgttggcacaaaacaagttgttttccaagcaattagaagcattgaccgaaacactaagtggatatttcctatttcagcatggccagccatataattcacagcagggccagtggaggaatcaccctggaaaccagttcaacaaagaccagggtggtccatctacaaggccacaatag

SEQ ID NO: 59015 - DNA, 482 bp, Glycine max
  Peptide Sequence Number=SeqID_150700
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggacgaatcaaagcgacaagggctgaatctcagtggatcgtggcagcaaggccactctgccacttacaatactctcgtcgcgtatttaagtcgtctgcaaaggattctactccgccgctcgatgggaattgcgcttcaaggcgtctc

SEQ ID NO: 59016 - DNA, 618 bp, Glycine max
  Peptide Sequence Number=SeqID_150701
atgactaccttgactcaaacatggatgacgttgctgcttagcaatatcctacccagcgatcataattccaacctccccctgccgaagtgtatgccgcctaccaggcaccctctggacccggataagtctaacagggccctgggatttccagctttgatcataggactctgccagttgttcggagtccccgtcgcacctagtaaggtgattcggccacccatcacccgagcttttattgagaagtatttcatgcagagacaggcacagggtggtggccttcagaccccgaatgcactgcctccacctcctcaggctgacccaactgggtcatttgacacgaagcggtatttatggcatttggttcaccagcaggcggccaaccacagggcgcacgtgcagacccatgactctctatatcagcttagcctcagcttgaagagccagggttttgcttcttttccatgccctactccggatcagttcagggcagaggtcgcatggcccggagattggcctgaggcccatgctgcagaggctcccggcgagccagatgaggcccgcgaggatgaggagatgtcagatttgctcggcttcttgggagggagtggagccacatga

SEQ ID NO: 59017 - DNA, 209 bp, Glycine max
  Peptide Sequence Number=SeqID_150702
atgtcgcaaaaccttacgaattgcgcaacaatcccttctttgacttctggaatgttgcggaaatgtacagatcgcgcaacaatgtttcctttcgacttccggcatgttgcggaacttcacggattgcctaacgatgggtgtcaagtttctcaaagaggtcatgcgaaggtcacatcccaacaaatagatggtcctcggacgaaattagg

SEQ ID NO: 59018 - DNA, 198 bp, Glycine max
  Peptide Sequence Number=SeqID_150703
atggcttcctcatccagcttaactctctctcagtctctccatacgccagtcttctcgcttaggctaagggttaaaggtggtgcgcttagcgagttcacactcgctcagcgcctctgtgccgctcatccttcttccagattcttctgtgcgcttagccagaggatggtacgcttagcggatggctcgcccagcacgtga

SEQ ID NO: 59019 - DNA, 441 bp, Glycine max
  Peptide Sequence Number=SeqID_150704
gacaaatgttttccaagaaggagggaatgatgagaatcatgaaactggtcaaatacaggctaaaggcccaagtggagaaggacgaaggcccaagtggagaaggacaaagcccccgagtggagaaggatgaaggcccagaggcagagacactatcaagactattaattgttgctgaaggcccaagttcgcatcatctgcaagagaattgctattccctgcatggatttcctgaaaaagttgccaaggtagctcagacagaaaaatcagagtctaagttctctgataaagagtaccaagagtatttgaagctgaaatctgagaaatccagcagccaggcttcaccttcctctgtaccatgttattcaacagcatgtatttctcaatctattgacggttctagtccttggatacttgattcaggtgcctctgatcatatttctg

SEQ ID NO: 59020 - DNA, 237 bp, Glycine max
  Peptide Sequence Number=SeqID_150705
atgacagaaattgtctgcgcgaaagatgacgtaaatctccgtgtgtcaacgggcttgttggccgcgattgacaaaggtatgacagaaattgtctgcgcggaagatgacgtaaatctctgcgtgtcaacgggcttgttggccgcgattgacaaagggtgcagaagacgacgtcagtatgacagaaattatggggcggccgacaaaagcgaggctcttgctcctatgtatcctcaatga

SEQ ID NO: 59021 - DNA, 579 bp, Glycine max
  Peptide Sequence Number=SeqID_150706
atggacatgaatgtgggagcccttatctctggccagatcacatctatagcccagtctaactcttctagacttgggttccctactctgatcaccgccctgtgtaaggccagaggggttaattctgatagcttggttttcgagcgcttgagcccggtcatcaacttggcctatattaggaaaaattgttggaatccttatgatctaacaatttctatcagaggggccaggcgggcaaggacgaggccagctgagcctccttccacatctacagctcctattccagcattggagcagttcactgagttggtagcctggcccgggactcagtcttctcttcgtagggaagatgaaggtcccacagcccaggtatcacagcatgtggaggatgattcatccgaggccaccattccagagccttttgtcagggggatggaggcagaggagacacaggaagctgcggccacacttgagagatctcttgaggtagcttctgagtccccagcacaaggggaggacataccctcacctcagcctgcaacagacccttccactcttgtcttggacttatcagaggattaa

SEQ ID NO: 59022 - DNA, 444 bp, Glycine max
  Peptide Sequence Number=SeqID_150707
atgggggcatatcctagtgagaatgtcaataactccactcccatactcattgagagccaacaacctcaatctaatcatgcacatgtctctcaacctatgggggagacacatgaaattccccaccacaatctagccgacttcgagccttgcctcggatatgccactgaagggcaagtagttggtggtatacccctgcaaaacactttggaggggcctcaatttcacccccaaccacaacccttctatggaaaaatggtgggttacacaccttcaagctttgcagatttggtgttcatcggcgaaaggatcaaagtggttctagaaagaggcaaatatgttcatccagctttgatgaatgcaaaaactggggcaaatgaagaggatgagaatgagggagaaaccattgctatgtctgccattcctacacggtcaaatttcccataa

SEQ ID NO: 59023 - DNA, 195 bp, Glycine max
  Peptide Sequence Number=SeqID_150708
actcatcttctccttgaagtggcgtctcctctctctctccctttctccattccgctgccattcatcttccaagaagcaaaggaatccattgatgaagaagatcctaggcctacaagctccaatggagcttgcatcatgaggcaagatcaattccaagattctccactaagtgtgcttaggtgtcatgaggcatga

SEQ ID NO: 59024 - DNA, 279 bp, Glycine max
  Peptide Sequence Number=SeqID_150709
atgtcaggacatcgtgtccgacatcgtggatcctgcagcttcacttctgcacttgacttttatcttgcattgtacagcaactccagtattctcgggcaggaacaactccagtattctcgggcaggatgtcaggacattgtatccgacatcgtggatcctgcaacttcaattcttcatttgacattttatcttgccttgtgcattgtgcagcccgatcttattccttgtcataacgttggacattatgtgcagcaactccagctttccttcattgtctaa

SEQ ID NO: 59025 - DNA, 633 bp, Glycine max
  Peptide Sequence Number=SeqID_150710
atggctaagtttgaccctaaagtagtcctggagttttatgctaatgcttggcccacagaggagggagtgcgagacatgtgttcatgggtgagggatcagtggattccctttgacacagatgccctcagccagttcctaggtgacccactagtgttgggggaaggccagcagtgcgagttcagccagaggaggaacatggctgacgggttcgacgaggaggatttcacccggaccgctgcaaggaggcgggtgcaaatcatgcgcaccagcatgaccaccttgacccagacgtggatgacattgctgctcagcaatgtcttgcctagcgatcataactctgatctccctctgccaaagtgccagttggtgtatgccatcctgacacggatgagtgtccacgtggcccaggtgattgctgacgctatctatctatttggaggtatgtcgcccaccaagcaccctctagacccgaataagtttaacagggccctgggatttccggcattgatcacgggcctctgccagtcgtttggggttcccgtcacccccactaaggtgatccgaccgttgatcacccgggccttcatcgagaagtattgcacgcccaggcaagcgcagggtgatgcaccttag

SEQ ID NO: 59026 - DNA, 276 bp, Glycine max
  Peptide Sequence Number=SeqID_150711
atgaagcccgagatgtccctaaagatgaaggaggaagtgaagaagcaattcgacaccggtttcttgtccgttgctcaatccctagaatgggttgccaatatcatattgatccctaaaaaggatggaaagttacaatcatataaagatggcaccagaggatatggaaatgacaaccttcatcacactatggggaaccttctgctacaaggtgatgtcatttgggctaaagaacgttggggcaacgtaccaatgagccatggtggcattattccatga

SEQ ID NO: 59027 - DNA, 283 bp, Glycine max
  Peptide Sequence Number=SeqID_150712
ccgttatgggacgcattgtattgtgtcgcaacgtgcccttcgcgggcgagcgagggcgaggctcacgggtgcactttccaaaggaggaaagatgcgcggagtcgccaccaacgtttatttgtggaaaacgtcggaaaaaccgaaggaaaccggtcaaaaatgaaaattctaagttcgggagttgtatttacgcttgaggaaggtattagcacctctcacgtcgacaaaagcggggcttttgctcctacgtaccctccatcaaagaggaaatcagacctacgta

SEQ ID NO: 59028 - DNA, 330 bp, Glycine max
  Peptide Sequence Number=SeqID_150713
atgccgatctccccctgcggaagtatcagttggtctggccggtcccgacatagcgatcgcgcccacaagacacccagtggacccggagaagtccaacagggccctggggtttctagctctggttacgggcctgtatcagtcctacagggtgctcgtaccccccggcaagggatcgcgcccgcaggacacccagtggacccaaagaagtccaaaaggatcctggggtttccagctctgattacgggcctctctcagttctacggagtgcccgtcacccccagcaaggtcatcaggcctccttctaaccgagctttcatcaagaagaattaa

SEQ ID NO: 59029 - DNA, 528 bp, Glycine max
  Peptide Sequence Number=SeqID_150714
atgtgtgtggattatcgggacagactgaatcggccagtcccaagaagagcggctaattttccttatagccacgacaaatcgatatcctctgtgataacacgccaactttcgctttattttccttcatggacggtttctccggctacaccagataaagatgcgcctagaggcagtactggaaaagcctactaccgttcgtcaccaatgatgggggaccgtttgttcaaggtgatgtcctttggactcaagaagccggcaagcttatcacgggacggcgcccaggatccaaatccgagtaagaagcaccttgtcaagattgcggaagttttggctcaacaggtcttaagacgactatcaattaagggacccatgccaagtgtacctttggggtcaaattccagaaggacacattgccttggtttcatcgtgagagaaaaaggagatagagggaccgaaaagggaaggccatcctctgagatgccgaacctcgtactgagaggcaagtccgaggcttcctgggacgcttga

SEQ ID NO: 59030 - DNA, 641 bp, Glycine max
  Peptide Sequence Number=SeqID_150715
gactccacgtcctcgccttcagaggactacatgtcctccccttcagaggactacacgtcctcgccatcggagggctacacgtcctcaccttcaaagggctccacgtcctcgccctcagagggctgcacgccatcgccttcagaggactgcatgtcctacccttcagaggactacatgtcttcgccatcagagggctacacatcgtcaccattcgagggctacacaccctcacctttagaggactacacgtcctcgccttcagaggactacacgccctcgccttcagagggctacacgccctcgccttcagaggtctacacgccctcgctttcagaggactacatgtcctcgccttcagaggactacacatcctcgccttcagagggctacacgccctcgcctttagaggaccacacgtcctaaccttcagagggctacgcgccctcacctttagaggagtacacgtcgtcgccctcagagggctgcacgccatcgccttcagcaggactgcatggctacacatcgtcaccatcagagggctacacgcccttacctttagaggactacacgtcctcgccttcagaggactacacgtcctccccttcagaggactacacgtccttgccatcggagggctacac

SEQ ID NO: 59031 - DNA, 908 bp, Glycine max
  Peptide Sequence Number=SeqID_150716
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaccgcctgagcactcccttccaggcgcgctcccccgtcacccctttcgaacgtccttcacggaaccgaactgcatgaacatttttgacaagaacgccgacgcggctgcctccgacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59032 - DNA, 378 bp, Glycine max
  Peptide Sequence Number=SeqID_150717
atgcccccggggcaccccccatggtacttgcaagttgcgttagggtcataccactttgggaaagggggttggaagacttttccgggagttaccacggccaattggttggcgatgagggacggcaagaggtcttcatacgtcattgaggggtggggtgaattcttgaaatggcctcggagggaagttccttatggcgttggaatttccaccgggcgagttgtgttcggagttataacttggggagcttccctctgggtgggtgccttaggctgcacaggtgctgaactagaggccattcccggtgtgagccgagaagctcgggtgatgttgcgttcgtacctgatgggtatccatgaggtggcttttgtgggggtttga

SEQ ID NO: 59033 - DNA, 1023 bp, Glycine max
  Peptide Sequence Number=SeqID_150718
atggggacaaatcaaaacggcaaaaggttttatcaagtcaaggttaaaagtctagatgtcagcggcctcaaggaattgggacgattgatgggacctctccaaaggcaagcctttcgcaaagtgtacggaaagattctagatttgaccgtggcagaggtatttacggaagctgtcgtatccctcgcccagtactatgaccagccgttgaggtgcttcacgtttggggacttccaaatggtaccgactattgaagagtttgaggagatactaggatgccctcttggggggagaagactgtatcttttctccgggtttcttccctccttgagcaagattgcagctgtggtcgggggttcggcaagagagttggatcgcatgaagcaaactcgcaacggcgtagtgggcctaccacggaaatacttggaaggcaaggcaagggatatggcgagccaagagaagtggggcccgtttgtggatatactagctttgttgatttttggggttgtcctctttccgaacgtggacggtttggtggacttagccaccattgacgctttcctcgcatatcaccatagcaaggagagtccagtggtggctatcttggcagatttgtttgatacctttgaccggagatgtgagaaaaatagtgcacggattgtctgttgtttacccgctctctgtgtgtggttagtttcacacctattccaacaagacacaagacacccgtgtccgcttcaaagctatcgctcatgcgccgaaaaaggaagagtcgattgggaccaacatttggctggaataagaggcaacgcaatcaattggtttcctcattggaaggaaggcaaggaaggagttctcttcttgtgtggggactaccctaatgttccattgatagggactaggggttgtattaattataatcccgcactcgccataagacagctagggtaccccatgaggggagcgccaaccgaagaaagtctctcgcctttccttgtgagggatctaggcgcgcaaagtctcaag

SEQ ID NO: 59034 - DNA, 96 bp, Glycine max
  Peptide Sequence Number=SeqID_150719
atggtgccctcaaaagatggtccgtggcggcaatggccagcagcagcggtggtggaggatgttcccttttgcttcttcgatgattcttccatttga

SEQ ID NO: 59035 - DNA, 256 bp, Glycine max
  Peptide Sequence Number=SeqID_150720
atggaacttcaatgtctcaaccaaaatgaagagaccgacaaaagaaaaagaagcatagcactccaagcctcctcctcaatgcaagaagaagaagaaaaagaagaatctgataatgaagaggacttctcactctttgtgaagaagtttcataaattcatcaaaaatagaagaatggagagaagccataacttcaacaatgggaacagatcccaagaagtttctcctacacttaaatgctataagtgtaatcaaccag

SEQ ID NO: 59036 - DNA, 435 bp, Glycine max
  Peptide Sequence Number=SeqID_150721
atgtctttcattctacggcatgctaaaaggaaccggctgcttactcttgacaaaactacttttttgaacaagggttccctctgccctttatgttcaaatgaggctgagtcaaatgctcatttgttcttttcttgcaggaaatctctccaagtttgggctcacattcgtgatttggctcctttccacaggcgtttcacttctttgcagtgcattactaactctttaattaggggcagatccacatcaggtgttcaaggaaaatttcgttgcttggctatagcaattacagtctactgcatctggctgtctaggaacaagctaatttttgaagattatcaattttctgtaatagaggttattagcaagataaaatttcttatggataacatagatgcattcatgtctcagccccatagcagtttggatagggattaa

SEQ ID NO: 59037 - DNA, 1425 bp, Glycine max
  Peptide Sequence Number=SeqID_150722
atggcgagccaagagaagtggggcccgtttgcggatgttttagctttgctgatttttggggttgtcctctttccgaacgttgatggcttggtagacttagccgccattgatgctttcctcgcatatcaccatagcaaggaaagtccagtggtggctatcttggcagatttgttcgacacctttgaccggaggtgcgagaaaaacagcgcacgaattgtctgttgtttacccgctctctgtgtatggctgatttcacacctgttccgacaagacacgagacacctgtgtccgcttcaaagctatcgctcgtgcaccgaaaaaggaagagtcgtttgggaccaacatttggctgggatagggggcagcacgattgattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccattgaggaaagacaaggagcttaggggcatccgaaacggcgtcattggaggttatcatgggtggctaagaattcacacgcggggcttaggttggctctccaaattgaaagttgtcgatgaggagaaattcgaagctccggaggaagatgaagaagtccgagctctaaagttagagctagggaaggcgagactcgccaaggagaagttcaaatcagctgctacacacatccggaaggagtgcaccgagttacaagaggaaaacgcggccactgcaagagctcttgaacaagaaaccaaaagggcccgcaaggaggaacatggccgagaaaaattccgaggagcattgtggggtagcaacaatgatctcaagctccgaagagaggagagagatcggtcacgggtgcatggcatgatcttaaaagaagagttagttgcttgcgcaaggtccaaaaggagtttggctcaacacttggaagccacggagcaaagcatgctagccatcataggacaatacaaggaagaattgaaccagtccatggcccatgaacaaaagctagtggaggattttgcacaagtgtatgctgaaaaagaagcaagagggagggtgattgatgcgctgcatcaagaagcgactatgtggatggatagattcgccttgaccttgaatggaagtcaagacctcccacgtctatcagccaaagcaaaagccatggccgaagtgtgtactgcccccgaggagattcatgggctaatcaattactgtcaacacatgatagatttgatggcccatataattaggaatcgttag

SEQ ID NO: 59038 - DNA, 340 bp, Glycine max
  Peptide Sequence Number=SeqID_150723
gtgctccagtggctatcatgtttctatcagctgttccctcctgttcagctactgacggggtggtgcgtaacggcacaaagctaccagccggacatacgaagtgtaaagcctggggtgccaagacggtgtccagtgaagtgcttcatgtggcagacgttgaaaaaagctgcacgggcgtcagcagaatatgtgaatacggactcctatgggaattgagcccaccgcttcccgctctagaactgactcctacccggcgtcactgcggaattcgaggaattatggcattacaaggatcggaatttcctggaagaatttactgcgaagattacttaacagggaa

SEQ ID NO: 59039 - DNA, 196 bp, Glycine max
  Peptide Sequence Number=SeqID_150724
atggagtcgccaactgccgcaacctacccttcgacgggagagcgacacgaggctcacgggtgtgtcttccatgggaggaaaatgcgcggagtcgccaccaacgtttattcaaggaaaacgtcggaaaaaccagaaaggtgtagtctacgaactttaagtgtgaaaggttcgggagttgtatttacgaacggggaag

SEQ ID NO: 59040 - DNA, 243 bp, Glycine max
  Peptide Sequence Number=SeqID_150725
atgggggagatgcttgccacccagctcgcccaggcgagcaaggtgacttcctccagaagcaaccgtcttctggaggaatcttctggagggcccaagtgggcctggttgctatttgcacccccatttctgctaaatacaccccctgccttttttggtgaaccttgcggattacataatcatccccttttttacttacggaatgttacggaacctcacgaattgtgcaacgatgcttccttttga

SEQ ID NO: 59041 - DNA, 794 bp, Glycine max
  Peptide Sequence Number=SeqID_150726
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59042 - DNA, 568 bp, Glycine max
  Peptide Sequence Number=SeqID_150727
atggatcgactttattttgatggcatagctatatgcagtcacgtaggcttcccaaatctttttattacttttacctgcaatccaaattggcctgaaattcataagctgctgacacctttgaatttaacaccaatagataggccagaaataatctcccgcattttcaagcttaaatatgagcagatgttatcatacattacaaagaatcacctgctaggcaaagtcgtcggatacatgtacacagtggaattccaaaaacgagggcttcctcatgtccatttattgttatttttacacgccaacaacaaatatccatctccaaatgatattgatcatattatatcaacagaaataccgtcacagaaagatgatcctgaactctataaattagtgcaaaatcacatggttcatggtccatgcggaattttgaggcctgcatctccatgcatgaaggaaggcaaatgcagtcgattttatccaaaaaagtttcgggccacaactattatagatggagatggttatcctgtgtatcgtagaaaaaatactggtcggacaataaccaagaatg

SEQ ID NO: 59043 - DNA, 651 bp, Glycine max
  Peptide Sequence Number=SeqID_150728
atggcctcgaggaagcttgcctcaaagagatctaggaaggataaagcggctgaaggaaccagttccgctcccgaatatgacagccaccgttttaggagtgctgagcaccagcagtgctacgaggccatcaagggatggtcattcctccgggagcgacgcgtccagctcagggacgacgagtataccgacttccaggaggagatagttcgccggcggtgggcatcactggttacccccatggccaagttagacccagacatagtcctcgaattttatgctaatgcttggcctacagaggagggtgtgcgagatatgcgaacctgggtgaggggtcagtggatcccgttcgatgcggatgctctcagccagttcctgggataccctttagtgctggaagagggccatgaatgcgagtatggccagaggaggaaccggtccgatgggttcaatgaggaggccatcgtccagttgctatgtataccggggcaggattttgcccggactgctgctggaagatgggtgcggatcatgcgcaccaacatgaccaccttgactcagatctggatgactttgcttgtcagcaacatccagcccagcgatcataattccgacctcccctaccgaagtgtcagctggtgtacgccatcctga

SEQ ID NO: 59044 - DNA, 249 bp, Glycine max
  Peptide Sequence Number=SeqID_150729
ttagattctcgtgaaagagtctaccccgtccaagtgatcgaggtaacgtcatccgaggaagaccctgaggaggatcttgaggagctaccttctgagcctgctgtggatgctcttgactttctagagggtgatgaggatccacttcttgaggtggattctcccgaggaagtcatgtcggcatctaaggcagattctacagaggatagtggcccgggggagatggcgatcagcggaggctcttcatcatag

SEQ ID NO: 59045 - DNA, 168 bp, Glycine max
  Peptide Sequence Number=SeqID_150730
atggaaggttcccaacaaaacgctcactatcctaaggaaaaattgtctaaaattattacacacaaatggaagtttggaaacctattggaggttcccaacacacttccactgaaaggtctttttgttacaaaacttgaaagcaatgaaaaggacataaaagcaagctag

SEQ ID NO: 59046 - DNA, 343 bp, Glycine max
  Peptide Sequence Number=SeqID_150731
cggtcagtacaagtataggaagaaagaatttgttagaagagacacagacactaggaaatgtggttgtcccttcaagcttcgtgagaaaccagtgcatggaggagaaggagatgatactgaaatgcaacacctaatgaggcttcttgaacgtgatcaatacattcattggcatagattgaaggatgaagttgtggtgcacagtacctacaaaacaaataggtacagactccgattgcttgactttgtgggggtgacaccaacagggatgactttctctgctgggtttgcatacatggagggtgagcgtgtgaacaatcttgtatgggcattggaacgattttga

SEQ ID NO: 59047 - DNA, 549 bp, Glycine max
  Peptide Sequence Number=SeqID_150732
atgaattttgcagcgagaaagcctatagaattcaccccaattccagtgtcccatgctgacttgctcccatatctacttgataattcaatggtagccataaccccaaccaaggttcatcaacttccatttttccgagaatacaactcgaacgcaatgtgtgcttgtcatggagaagccccggggcattccattgagcattgtaggggcctgaagcgtaaggtgcaaggtctaattgatgcaggctggctgaaatttgaggagaatcgcgtgattttcaactttcaccggaattgggtgcaagccattggtctatttgctcaagccacctgtgctcctgagtttggacttccaagaccgttcaatcggagattactcgtcttgcacgttggtggggcttccgtaaaacaacaagaatcctctacaacaagagacccacggtctcttaatcccttttcagaaataagaagagaagaagagatctctcttaaaagagatggattgtacaatgaagatcaatcaaaattccttattaaatatgcaagtggttga

SEQ ID NO: 59048 - DNA, 787 bp, Glycine max
  Peptide Sequence Number=SeqID_150733
aggactacacgtcctcgccattagaggcctgcacgccctcaccttcagatggctacacgccctcgccttcgtagggctacacgccctcaccttccgaggactacatgttctcatcttcagaggactacacgtcctcaccttcagaggactacacgtcctcgccttcagagggctacacgtcctttccttcagaggactacacgtcctcgccatcagagggcttcacgtcttctccttcagaggactacacgttctcaccttccgaggactacatgtcctcaccttcagagggctacacgccctggcctttgtagggctacacgccctcaccttccgaggactacatatcctcaccttcaaaggactacacgtccttacctttagaggacaacacgtcctcgccctcaccttctggaggactacatgtcctcaccttcagaggactacacgtcctcgccttcagaggacaacagggctacgcgccctcaccttccagaggattacaagtcctcaccttcagaggactacacgtcctcgccttcagaggacaatcacgtccctcgccctcattcaaagggacacatgtcctgaacttcagaggactacacgccaccctttgatctggaggagggccaactatgcaagtacaaccagaggaggaggctatcacgcagctactgtgcataccggggcaagatttcacccgtgccactgcaaagagacgagtgcgtatcatgcgcaccaacatgacaactcttacacagatatggatgacgttgctacttag

SEQ ID NO: 59049 - DNA, 345 bp, Glycine max
  Peptide Sequence Number=SeqID_150734
atggggaataacaccaacggcggatgggagtggaagctatcttggaggagggctctttttggtagtgaaattcaaatggcagataatttccttggagaactatcacagcagcagattcagccaaatagggaggataggtgcagctggaagcatgatcaaactggatactactcaacaaaaagcggatatgacttgatatgggaagcacagatgggagctaatcagaatttggactttgtggacatttggaagctcaaaataccaaatgtagaggaggagcctgctcatttagaaatatggagacagactttggaacacattttaatcagtggtcctccaacctaa

SEQ ID NO: 59050 - DNA, 282 bp, Glycine max
  Peptide Sequence Number=SeqID_150735
atggtgaagttgatgtgtgggattcataatcatgaattggccaagtcattagttggatatccatatgctgggcgattgactaaagctgaaaagacacttattgctgatatgactaagtcaatgggaactctagttgattgtccttcggagcagcagtttgatgagtgcctgaagaagtttgaaaggccattagaagagaatgagcatgtgattggaagcatgactaaaaatgttagtcagattgtcagattgattgtgaaggaatgcattgactgtatcccg

SEQ ID NO: 59051 - DNA, 655 bp, Glycine max
  Peptide Sequence Number=SeqID_150736
cgcccaatacgcaaaccgcctctccccgcgcgttggccgattcattaatgcagctggcacgacaggtttcccgactggaaagcgggcagtgagcgcaacgcaattaatgaaagtcaaggtagaggccggtttcttggatctgtacacggacagggagccagggtgcgggtactgtaagtactctgcgagggaacaggttttgggagaggtgaagcggttgatggagaagtatgcggacgaggaggttagtgttacgatagccggacatagccttgggagtgcgatggcgatattgagtgcctttgatattgttgaaactggggtgaatgtggggaaggatgggagaaaagcgcatgtttcggtgttttcgttttcggggccgagggtggggaatgttaggtttaaggagaggttggagggggagcttgggattaaggtgctgagggtgcataatgctcatgacatggtgccacagtcgccgggtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59052 - DNA, 622 bp, Glycine max
  Peptide Sequence Number=SeqID_150737
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctcggtttctcgccgtttcatgccggactgatgatgatcccgatggtgcttggcagcatgggaatgaagcgaattgtggtacaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59053 - DNA, 507 bp, Glycine max
  Peptide Sequence Number=SeqID_150738
atgccggacatggtcattagcggtatcaatgatggcgcgaatatgggcgatgacaccatttactcaggtacggttgcagcagccactgagggttacctgctaggcatcccctcttttgcggtttccatgtcgcaacatcagccatcccattttgaaactgcggcacacattatcgtcgacttggtcaggcaatataaccacagcgaattcactgaaccaaccttgctcaacatcaatgtacctgacctcccgctgcaagccattaaagggcgtcaaattacccgccttggcaaacggcataaggctgagccagtgattcagctgcaaacgccacgtggagaaaccgtgtattgggtaggggctgctggccaacccaacgatgggggcgaaggaactgattttcatgccgtggcgcaaggctatgtttccatctcgccaatacaggtagacctgaccaaacactcccagatcgcaaccatgcaacagtggctgcaatccaaaaattaa

SEQ ID NO: 59054 - DNA, 273 bp, Glycine max
  Peptide Sequence Number=SeqID_150739
atggcagcgcagttgatccatgatcgcgttgtgatggagtgcctagaggtacatctggagcaacccgcacgcacacttcagcagcctgtggaatggatactacctacacctactccatatcgactagttgagccggttcaagtgatagaggtgtcatcctctgaagaggatcttgaagaggacccagaggagttacctcctgaacctgctatggacgcccttgacttacctgaggatgatgaagacccactccctgatgttgattctccatag

SEQ ID NO: 59055 - DNA, 312 bp, Glycine max
  Peptide Sequence Number=SeqID_150740
atggaagaaaatcacacgatgattctcaagtccttaggtgttacaatatgcaaccaaattggtcacatcaaggccaactatccgtcaaatgaagaatggtcggagataagtgacaagaaaagatttgacgaaagaagaactaagaaagcatacattgcatgggatgacaatgattcatccgatggttcagaaaaagagattaatcttctaacccaagattatgaaagtgacgagacatctctcaaggaagaaaaacaaggagaaaagcatgatcctcatcttgaaaatctagacactttaatcttgaaaaag

SEQ ID NO: 59056 - DNA, 408 bp, Glycine max
  Peptide Sequence Number=SeqID_150741
atgtctcttgccactttatttggaaagttacaggaacatgaaatggaattgataagattgaatcaacatgaagaaaatgatagaaagaagaaaggaatctctcttaaagcttcatcttctaaccaagaagaaagtgataaggaaaactcaattgaaatagacgaagatgatgatctgagtctatttgtaaagagattcaacaaattcttgagaaagtctgaaaagaaaaattttagtgaaaagaaggcgaagaaggcctacatcacacgggatgacaatgatctggaatcatctgagaattcagaaaatgaagtgataaacctgagtctaatggctaaaagttatgaaagcgatgaagagatgcatttgctgatttgcatagagaatcaatcaaacttgcaaaattag

SEQ ID NO: 59057 - DNA, 123 bp, Glycine max
  Peptide Sequence Number=SeqID_150742
atgtggacactacgcaaaataggggagatgcttgccgcccagctcgcccaggcgagctcagctcgcccaggcgagccaggttgcttcctccagaagcaacagccttctggaggaatcttctag

SEQ ID NO: 59058 - DNA, 240 bp, Glycine max
  misc_feature (145)..(145): n is a, c, g, or t
  Peptide Sequence Number=SeqID_150743
atggagattgagtttcacagcccagctcccccgcttgaaagcttcatctttatgacatacctgccttgcccaccattacaagcaagccctgctcctgctctttttagtcgtttccagaagaaagaattgattgacgaatctccgnggttaactcccccactaacggactttactggcttgaactttcagttctgttactcgactagagggctttccctcacatcctactcttcattatag

SEQ ID NO: 59059 - DNA, 252 bp, Glycine max
  Peptide Sequence Number=SeqID_150744
atggcaggagctggtgacaatggtggtgtatatcatcaactggacggatctcagcgcttattactggaagcgatgactacacaaatgcaacgtttgttgaaccgtaacaatgaagagctctacaggcgaatagaaagattagagcaccaaatgaattcaaatgctaggagaccttatggtggcaacaaaagggtcaatgatgaatcaaaccgaatagaggggcaagacagaattgagggagtaaaactcaat

SEQ ID NO: 59060 - DNA, 774 bp, Glycine max
  Peptide Sequence Number=SeqID_150745
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaagtatttacggaagctgtcgtatccctcgcccaatactatgaccagccgttgaggtgtttcacgtttggggacttccaaatggtcccaactattgaagagtttgaagagatattaggatgccctcttggggggagaaaaccgtatcttttctccagctttcttccttccttaagcaaggttgcgactgtaattggagattcagcaaaagagttggatcgcatgaagcaaattcggaacagcgtagtgggcctgcctcggaaatacttggaaggcaaggcaagggatatggcgagccaagagaagtggggcccgtttgcggatgttttagctttgctgatatttggggttgtcctctttccgaacgttgacggcttggtagacttagctgccattgatgctttcctcgcatatcaccatagcaaggaaagtccagtggtagctatcttggcggatttgttcgacacctttgaccggaggtgtgagaaaaacagtgcatggattgtctgttgtttgcccgccctctgtgtatggttgatttcacacctattccgacaagacacgagacacccgtgtccgcttcaaagctatcgctcatgcgccgaaaaagggatcctctag

SEQ ID NO: 59061 - DNA, 264 bp, Glycine max
  Peptide Sequence Number=SeqID_150746
atgtggagttgtctaagaagggaaatcttcgcaatccgcccacttgggccttccagattcttcctccagaaggctgttgcttctggaggaagcaaccttgctcgcttgggcgagctgggtggcaagctcctcccctattttgctatagatagggggaggagtgaagagggaaggggttcagccttcttggcacttcttattctctcgaaattgctgaggataattgtttccgtgaagaaaatccaagccgaggcgctttcgtaa

SEQ ID NO: 59062 - DNA, 460 bp, Glycine max
  misc_feature (400)..(400): n is a, c, g, or t
  Peptide Sequence Number=SeqID_150747
cggatgccgggagcagacaagcccgtcagggcgcgttcagcgggtgttggcggttgtcggggctggctgaactatgcggcatcagagcagattgtactgagagtgcaccatatgcggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgaagcggtatcagntcactcaaaggcggtaatacggttatccacagaatcaggggataacgcaggaaagaacct

SEQ ID NO: 59063 - DNA, 159 bp, Glycine max
  Peptide Sequence Number=SeqID_150748
atgcttcaaccatatgggatcaacataggcttaaaggaacactcaaacccggtgacccccaaggcctacactccgaagactccgtcagggcctctccctcctgatttagatattgctcatgaattatacaatacccacgaccttacactcgtgttttaa

SEQ ID NO: 59064 - DNA, 309 bp, Glycine max
  Peptide Sequence Number=SeqID_150749
atgagggacacggttgagttccttccatatagggacctagatgacctagtccaactttgcataagggtagagcaacaacttaaaaggaagcctacttcaaaatcatatggctcacactcttatccaaagaaagaccaagatagtggttcatgttgcaattattgcagcacaagatttgtctctaagtttttccttgctatctctccccatccaaagccttacaaacttcaatggctcaatgagcaaggggagatgatagtcaatcaacaagtgaaagtgccattctcccttctccattggaacatataa

SEQ ID NO: 59065 - DNA, 495 bp, Glycine max
  Peptide Sequence Number=SeqID_150750
atgacaaaatacttcaattccatatgcttagcagccttagagtacttatccttctcagagaaaaataatgttgcagagttatcacaatacattttcagcagcatagctgtcgcaacctacccttcggcgggagggcgacgcgagactcgcgggatgcgtgttccacgaaaggaatacgcgcggagtcgccaccaacgtttattcgaggaaaacgtcggaaaaaccggaaaagatgcgatctacgaactttttatgaaaggttcgggagttgtatttacgcacggggaaggtattagcaccccacacgtccgtcccaagggacggcagcctttaatcgaatgtgcaaacatgactttgatttttacgttcccttttatgtccttatatcctttataccctttttatatttttctcttttttgtggtcgacagagggtgtttccctttgctcctacgtattcctcaatttggggatgagaaaatcagacctacgtag

SEQ ID NO: 59066 - DNA, 957 bp, Glycine max
  Peptide Sequence Number=SeqID_150751
ttcgtcctcggcgggaatcaggcgttcgtgcacgaagcggcgcacggcgtccagcaacagggtcagggtttcggtgtacagggccatgatgtcagtctctcgggagtgcggggcggcggcgctcaggggcgcatgccgccaaccacgcaccatccagttcagcatcgacagcacggcgcggccggtggcgggcacgtccagcggccggaacgcgccttcggccacgccctgcgcgatcaggtcgcgcaggcgcttctcgtagccgtcgcgcagccgggcggcgtcctcgcgctcgggcagcgccatgccggaatagccgatcagcatggtgacgaactcggcgtggtgctgctcgaaatagcgggcgtggccgaccatgaaggcgcgcaggcgggcggcgccgccctcggcgcgcgccacgtcctggccgacgctctggttcaggccgctcaacaccgccaggatgatggcgtcgtagatgtcctgcttggtggtgaagtagtgatagatggcggccttggacacgccaatggcggcggccaggtccgacaccgaactgccgtcgtagccgctgcgcgcgaacagcttggcggcttcggccaggatccgttcgcgcggcgccgccaggtcgccatgagggaacctggtgaggcggcgtcgaggcaggcaatgccggaccgcgggcggtcccgttccattgacagcggttcggcgcttgccgcacatccctttccgccatgcaagcgcggcttgggcgctcaacccgaaaccacacgtgacgccgttatgccccactccctagtgacagatctgtatggccagatgtccctgccggtcatcagcgcccccatgttcatcgtgtccaacccgaagctggtcgtcgcccaatgcacgagcggcatcgtcggttcgtttccggcgctcaacgcgcgtccgcagagcctggggatcctctag

SEQ ID NO: 59067 - DNA, 291 bp, Glycine max
  Peptide Sequence Number=SeqID_150752
atggacggggaaccggcacgaagagtcaccctagaggacttctccaataccgccactcctcagttcttcacgagcattgcaagaccggaggtgcaagccgccaatatttcctacccgtatttccttattcagctaatccaagggaacctcttccatggtcttccaagtgaagatccatatgctcaccttgcctcgtacatagaaatatgcaacaccgtaaaaatcgctggagtcccagaagatgcggagaggcaaaacgatggttgcactctttcaaaggcaacaacttaa

SEQ ID NO: 59068 - DNA, 210 bp, Glycine max
  Peptide Sequence Number=SeqID_150753
atggaccatttcaagtgcttgaaagaatcaatgacaatgcttacaaagttgagctacccgattcgggagtttgtatttacgtttgaggatggtattagcacctctcacgtttgtcccaaaggacaaatccttaagagggagattagaatgatggacatgaccaagagcaagggcaaggatccacttgaaggacttggaggaccaatttga

SEQ ID NO: 59069 - DNA, 242 bp, Glycine max
  Peptide Sequence Number=SeqID_150754
gttcctctctattgccaagaagtcaaaaagacaaaattccaccagaaggtatatcctgaagatatgatcaatcagtccaatgggcacctgaaggccaggagagcggctttccctctattagaaaacaagaatggaagtccatataaattagggggaaaggagaaagctcaagcgcgtggcacaaaacagtgggttcctgatcttgtcttccttcaggctaaagcttcaagtctcaatccgaa

SEQ ID NO: 59070 - DNA, 213 bp, Glycine max
  Peptide Sequence Number=SeqID_150755
atgttccttcatgggaagatgcccaggaaatgggttttcagaccttaccttgcttcaacataccaaacaccactaatacatggggagggaatgatgcaatcctactctgcaagggcattggatagaaggctccaagaagattgggccagagatgcaagagaagaccttaggattctcatgagccttaggatagatttcgggcccatgggctaa

SEQ ID NO: 59071 - DNA, 60 bp, Glycine max
  Peptide Sequence Number=SeqID_150756
gttttcgaccgttcttcgacgttcttcattcgttcttcatcgttcttcagtcttcaacgg

SEQ ID NO: 59072 - DNA, 165 bp, Glycine max
  Peptide Sequence Number=SeqID_150757
atgagtcatcattcacctaagagaataaaggtcattcctgagtggtccactccaccaagtgtcgagggaaggagtccagagtatgaaaaacctcgggatttgaggtcaaatcctttccaaggtggaggggatgatgcaatcctaccccccaagggtattggatag

SEQ ID NO: 59073 - DNA, 213 bp, Glycine max
  Peptide Sequence Number=SeqID_150758
atgtggcacttgaacgagagttttatgcaattgtgtatgatcctgaagacaagtcgccaaaacaagtcaagcacagtgtcacaacctacccttcagcgggagggcgacgcgagactcatgggtgcatcttccaagaaaggaaaatgtgcggagtcgccaccaaagtttattcgaggaaaacgtcggaaaaatcggaaagggtgtggtctatga

SEQ ID NO: 59074 - DNA, 462 bp, Glycine max
  Peptide Sequence Number=SeqID_150759
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagccacagcagcttccactaaagttagacaatga

SEQ ID NO: 59075 - DNA, 309 bp, Glycine max
  Peptide Sequence Number=SeqID_150760
atggttatggcagcactgcataattcttcgtactgtcatgccatccgtaagatgcttttctgtgactgcatttatcagggttattgtctcatgagcggatacatatttgaatgcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 59076 - DNA, 156 bp, Glycine max
  Peptide Sequence Number=SeqID_150761
atggggacaaatcaaaacggaaaaagattttatcaagtcaaggttaagggtcttgatgtcaccagcctcaaggaattgggacgattgatgggacctctccaaaggcaagccttctgcaaagtgtaccaaaagattctagatttgaccgcagcggag

SEQ ID NO: 59077 - DNA, 250 bp, Glycine max
  Peptide Sequence Number=SeqID_150762
ggatttggttcaaaaggctcttaacgaagggaggctcaaatttggtgaaaaaccaaaggttgcccaggcaaatgctgaaacatccaaagctgctgaaactctctatgcagagccccaagaaataatgatggtcgaagcaatggagttgtctcaggtgcaagttcagggcatatctgaagaggattacaacgaacaaatgaaggttgtgtatcctcaggctgaggaggatctaattgatttcttgaactga

SEQ ID NO: 59078 - DNA, 671 bp, Glycine max
  Peptide Sequence Number=SeqID_150763
atgacggtgaaaacgtcggacacatgcagctcccggagacggtcacagcttgtctgtaaacggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatacatctacttagggattgttatattgagaacaagagagagtacatctcttgtggatcagttcaagtggagggtacatccacttggttattcaaagagaataagggagggtacatcccttgtggatctttggcttgtaaaggtttttacaaggttgaaagaaatctcaagaaccacaagttgcttggggactggattcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctaatacggttatccacagaatcaggggataacgcaggaaagaacct

SEQ ID NO: 59079 - DNA, 642 bp, Glycine max
  Peptide Sequence Number=SeqID_150764
atggccgaaatagaaacaatatccaaaagatttgaagaacttgatgtttgtggcaagtttactctgaagactaaactttgggaaattgcataccctgatcagaattcgatgtgtcctcctccagtaaaggttaacacaaaaggggcaccgaagaaacctatgagcaggaacccaaggttaacaaagcatgatccatcttactgggagtatgtagatgcctttgaatctatgcaaaatagaaattcgtcggtgaggcaatctacatcatcctctgagcaaccgaatcgaagaacgatgatgcccatgttggatcagtttcagccatttatgcacaacttcattgataagattgttgatgtcaaagctgatgaagactatacccagctctttggtggcacgaagagatttgaggaattaaggatgtcactacatgttgatgggttaaccaaggtgactacggataagtggatggatataacggacatgggacatgtcattgcatcaagatataatgtgatcgttgtatccttgtctaaacaacaaagcatgacattttttcctcttagaagtgaatcgctgacatattcttcattgcatcgtataatttgtatcagtcatgtgtatgataatcattttgttgag

SEQ ID NO: 59080 - DNA, 63 bp, Glycine max
  Peptide Sequence Number=SeqID_150765
atggctttgaggtttaagagtaaagtgatggagggtgtgacggtggtgaccccggcttcataa

SEQ ID NO: 59081 - DNA, 585 bp, Glycine max
  Peptide Sequence Number=SeqID_150766
atgaaagataagaaggatgaggaagaaaaactagaaaaacaaaagaaaaagaaggatagtaaggccttgtcttcaaaggccaaggggaaggaaaaagaggaaaaggattcctccaagaagattgttaagaaggaaaatcattttgcaacaaaaggtgatatcaaaagagcactccttcttaaaaaatatttctaccttctcctatcatgggaaacatcccttagcaccgccatacctcttgagcttgaggttattcctcaagtaaaagagttgttggatgagggtttggttcacaagagcttaaatccttgtgctttgttggtgcctaaaataggtattattagacaccaaagccctatgataggtggtatgatgaatttgttgagtggtgcaacactcttttgtaaaatcactcatgcacccaacatcttcatgatttgtgtacatatggactcattaggtagtgatcaagggcttcccatggaccctaagagaataaaggtcattcttgagtggcctactccaccaagtataaaggaaatttggggcttcaatatcttaacaaacttttacaaaaggtgttga

SEQ ID NO: 59082 - DNA, 426 bp, Glycine max
  Peptide Sequence Number=SeqID_150767
atggagtcgaggattacccaatcaacatcgggcgagcaaggttcagtgcaagaacatttacatggtgaattgcccactggtcaatgcagtttccttcaaacagttttcaatgcaactaatgtgatgactggagttggcattctgtctacaccttatgcattgaaagaagctgggtggatgagcatgatcatactatacactgaattatattcatgttgtgtggaattaatcaccttggaaggagataacctcactgtgctatttcctggcacctcgttagatttgggtagtttcaagttagactttgtgcacttgtttggaattttggctgcacttattattatcctcactgtttggctgaaggatcttcgtataatctctattctgtcagctggaggagtttttgcaacactgttgggacaataa

SEQ ID NO: 59083 - DNA, 528 bp, Glycine max
  Peptide Sequence Number=SeqID_150768
atgtgggtttttcatatcggccgacaaattgattgggcacacttagtccgatatcgcatgcataaggcattgcgattaaatgctccattgccatatccacacctagtcactctcttccttcaacactttgacatccctcttgattctgaaccttatgttccaatcaagagatccttcttaatcggtgccgctgtgattgcatcttttggttaccgtaaagagcatgatggctcttggttggagaggattcctctcttcttcaaagaattttgggcaggttcgatggtcttcaaacctttgttggtgaaaggtttgatgctttggagttacaagtggacatgtgattcgatgagatggattcaaggatcaccaagggttgccatcatcaaaaaaggggagattgtagaagcaagcttcatgttgatgaatcaagttgactcaagtagttttgatgataacaaagatgatgacaaaaagcccaagagaatgatttcaagattgattcaacaagttcaagatcaagattaa

SEQ ID NO: 59084 - DNA, 735 bp, Glycine max
  Peptide Sequence Number=SeqID_150769
atgattatgaggggtcaagacatttgtagtagtcaagaggagactacttcttccctttcctctagtggtagtgaagatgaagtaagaggtgaagagtctaaaggctccttagagatcaatcttgtgacctatgtcaatcctaaagagagaacatccttgaacctcactatcattccacacccaaaaccttataaacttcaatggctcaatgagcaaggggaaatgatagttaatcaacaagtgaaggccaaggggaaggaaaaaaaggaaaatgattcctccaagcagaatgtcaagaaggaaaataattttgcaacaaaaggtgatatcaaaagagcactccttcttaaacaatctttctaccttttcctatcaagggaaacatcccttagcactttcatacctcttgagcttgaggttattcctcaagtaaaggagttgttggatgagggtttggttcgtaagagcttaacttcttgtgctttgttggtgcccaaaataggtattatgaggcaccgaatccctatgataggtggtatgatgaatgtgttgaatggtgcaaccctcttttggaaaatcaccgatgcatccaacatcttcatgattcacatgcatagggactcattagctgttgagggaagaagccaagagcttcaagaatctctggatttgaggtcaaatccttttcaagggggagggaatgatgcaatcctaccccccaaggacattggatag

SEQ ID NO: 59085 - DNA, 489 bp, Glycine max
  Peptide Sequence Number=SeqID_150770
atggatcagtacatcaaggacattggaaacttcgtgcagaaggaacaagagactttacttgaagccttggaaaggctgcaagagataattagaagtttctcacatcatggcttttcacctcaaaggctagttcacattttctatggtggagtgtcctcacacaattggacaagtttggatgctacttgtgagggtaatctcattttaaaaccccttactaatgacctcaagtgtagaagcaaagactttgactttgatgttttgatgatgccatatgattgtgatgttttgataccttatgaaaatgcgcttctcaagtttaattcaagacaaaaatccaagaatacaagatacaacatcaagaagatctctagtgatttaggaagggaattacaaattgaaatagcaaaaggtttggccaagaaatttaagctaaaatgtctttttcaagagatttactctctggtaatcgattaccagaggatgtaa

SEQ ID NO: 59086 - DNA, 156 bp, Glycine max
  Peptide Sequence Number=SeqID_150771
atgagagagattccaaaagaacttcattgtcaaatgagacagataaaggggaagagaaagataaaagataaaatagtggttgtcatcatcaaaaaggggaagaatgtaaatcatgaagattttgatgatatcaagaagaatttgtttgagaaatag

SEQ ID NO: 59087 - DNA, 276 bp, Glycine max
  Peptide Sequence Number=SeqID_150772
atgatgacaacaaaagatgatgaacaaaaagctcaagtgaatcaaagaacatctcaagagaatcaagaacaagtcaagagttcaagaatcaagaagaattcaagactcaagaagaaagcctacaaacaagtatcaagattcaagattcaagatctcaagaatcaagatcaagattcaagaatcaagaatcaagactcaagatctcaagaatcaagatcaagaatcaagactcaagatttgagaatgaagaaaagattcaatcaagataagtattaa

SEQ ID NO: 59088 - DNA, 78 bp, Glycine max
  Peptide Sequence Number=SeqID_150773
atggacatctgtctccgtgtgattggtgatcccatgaatggagttcaacgggggtgggggtcacaacccactctttga

SEQ ID NO: 59089 - DNA, 432 bp, Glycine max
  Peptide Sequence Number=SeqID_150774
atgaatttatatggtacaaccgaagtgaaagttgaggattttagcaatgaacctccacaattaagccagatcaacttggaggaaacttataatgaagatatggtgaaggaagaagagggtattaatgcatttcccagctatgttgctagccaatatttagatgttgtggagaatggtaaaggtaaaaggcccaagtatgaacatgatgatgatccaatcacttgtcttgaaccttcttgggtggaagaaacggttgatgttgtcatttccaaaatgtcgagatgtcctaaaccaaggtatgttagctgtcaaatcaattccttgggttgccccttgacttgtattccataccattctggggtgacaatatttgtgaatcaatgttcaccaacaagcaaatttagtctccctcctagctacgatcctaattaa

SEQ ID NO: 59090 - DNA, 189 bp, Glycine max
  Peptide Sequence Number=SeqID_150775
atggtggcaagctcctcaacgaagaagaagaagaacctcttcccgcaacctcctcttaacgacaacgaagaagaagaaaacgaaaacgactggaagaagaagcagaaagcttatgaggaagaacaaaagaaaaccgcaggaacaagaagcaaaaacgcaggcaaggtgggagagagagtctcgcgttaa

SEQ ID NO: 59091 - DNA, 267 bp, Glycine max
  Peptide Sequence Number=SeqID_150776
atggcagtgcaaacaaaacaagaaaggagaagcaaagatgatgacgaaaatcgtgaaaaaaaacaaaaaacaaagggcaataatgaaacgaaaactacgattcaatccacaggaatctcaccggcggctaaggtgcccaccggcgagatagaacagaacgaagcaagagatcacgaaaagaaagaaggaagaaagaaagaaagaatggggaagagaagaaaggaagaacaagagatcggagggaaatgtgagagaatgagggaatga

SEQ ID NO: 59092 - DNA, 327 bp, Glycine max
  Peptide Sequence Number=SeqID_150777
atgattgatccatccgtcagcctcacctccaaaagcttcacacctccgcccccacgcgaaggacatgtccggggcgttatggccgttgttgttgcaattatatgtaaaaaattaataaatacattatcaaaagagtcatcaagattgtttgcaacattttgtaaaactaactcgaatgtggatcttaaaaacctggcagaatccgcagtgttgcgagccattcggggaggcgtggtcgttctccagcggcgtggcgaggatgccaaacgaagcgtaggagggaccaaacgcgaaggctttgtggtggtggtggggaaagtgaaatga

SEQ ID NO: 59093 - DNA, 381 bp, Glycine max
  Peptide Sequence Number=SeqID_150778
atgcagaagcagaacacaggcaaagggaggcagacaaccacatcaagttggcaaagaagggtgatggggcttggcttaactagagatggtgtggtaggacaaatagtgtcgagatccttaaaacttatggtgtggctgattctgaagtgcttcacccacaaatcgttcattcccatgaaatgtttcctaaatcgctgggcgcagaagaggttcgagtttccttcaaaggcaaaaatgatgttatccggggcaatttcaggcaggacccacaccttctttctccacacgccgaacccttgttcgccaatggttctagatttgaaggtggagagagtgcagaaaaatctctatggtaccgacattccagtggcacatatatga

SEQ ID NO: 59094 - DNA, 294 bp, Glycine max
  Peptide Sequence Number=SeqID_150779
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatcccctcatgagaaccctagggccttctcttgcatctttggcccaatcttcttggagtcttctatccaatgcccttgggggggttggattaagttgttaactgctaggggtaaaatcctcataacctag

SEQ ID NO: 59095 - DNA, 188 bp, Glycine max
  Peptide Sequence Number=SeqID_150780
ggtacatcctttgtggtacaagtagagggtacatctacttggggattgttatactgagaacaagagagggtacatctcttgtggatcagttcaagtggaggataaatggcagcggaatggagaaggaagagagggaggagacgccacttcaaggagaagatgagtctagaaaaagctcaccaccatag

SEQ ID NO: 59096 - DNA, 942 bp, Glycine max
  Peptide Sequence Number=SeqID_150781
atgacgttgtttcactccccaccaccatcacataagttgtcgaacccaacaactcaggttcccaagaatgttgtcatcgttgatgccaaagcgagagcttgcagtgggcctggtgccattgatggacacaatggtgaagagtctctgatcactgtcatcatggagacagaggaagaagtggattctaacgaaatcattcccttcaatatgtcattctccaaacgcgtaatagaaattcagggagcttctgttgtgataatgtgtcacatgtttccactatcactaaagtctatcacattgaagtggtttcagtctttgccactgagatccatcaacctatggcttaatttgagggagaaatttagatctagctttgcaaccaacaaagagaggccaaaaacagtggtcgatgtgagattaatacggcaaggacctgatgagtcgttgaaagaatacatttcacggttcaacaaggaagcaagatctgtgggtaacatacaaactcggtgtagtgttgatgctggcaaaggatgtgcagcttatatacctgttgggcaacttcacttaatgccaattggttttaagatgaaatctaacatggtatcagagcaggctctaaccctgggacctctcattcgcttccgctgcgacaagcacccaccatttgtggttcacgcaccaagcccaataagtgctgggcgtgaagggggtgtattgggaaaatacccaagtctcacatcgactgcctcaatccttggagctctaaccctgggacctctcattcgcttccgctgcaacaagcacccaccatttgtggttcacgcaccaagcccaataagtgctgggcgtgaagggggtgtattgggaaaatacctaagtcccacatcggctgcctcaatccttggagtgcagcttatatacctgttgggcaacttcacttaa

SEQ ID NO: 59097 - DNA, 711 bp, Glycine max
  Peptide Sequence Number=SeqID_150782
atgggagattgcttagaggaaatgatttgtgatcttggacaagaatcttttcagcaagcacaagcccgtatgtatgatacattgcaaagtgattccaagaagcctttgtattcaggaaaaacaattggtgttaatgttgaagatgatgattcaacccttgaaagttgtctcactcttttctccaaaaaaatgtcgaggaacgtcaacggagaagaagaagttgatgacatcctcgcaaatcgtaatgatcatgatgaaggagaattaattaacatcgtgcacatggttacaccacccagctcacctcctcctcctcctgagtcagcaacaccttcttcatcgtcttcgtcaaagaagactagaaaagcaacacaacttagatcattggctactagaccaattgaggtgaagagaacagtggttcatgttgatcctgtcactaggaaagtcgatggagagcgatggaggcagattaagttaaatctgacctccaaatgggccctgacacatagcaaggagggcgaggatgataaagtctatgagaagtatgaaataagaaaagaaattgtagccagttttgttagagccatagagatccttcatgggagaaataaaaagttggtggaggagaagcaaaagaaacgattggaggaagtaacccaattcgggagcactgacacagtcattgatcctccacctcccatcagatga

SEQ ID NO: 59098 - DNA, 435 bp, Glycine max
  Peptide Sequence Number=SeqID_150783
atgtgggataataatgttggtgggtgccatatagaatggcctgacattgatggtcaaatatgctctcaaggtagaataaaggatgtagttaacaaaattggagattccatcccttccaaatctattttgcaaactgttgatgaagatccaagtcataatcgatcatgggtaaatcatcggagaagcccatctcctctgtcgctcttcttgctgccaacaatagtgacaagaaaaagatgctttcgaggaacaattttgagccgaccaacaaagcttccctcaaagaagttgaaagttgtcgaccttaaagatgattcaagaccaaccaggacttgcttggtcccaactaacaagcttagtggtcctcctatgtggatgtcttctggcttagagattgactgtatcattatgtcggaagattgggaagctttctaa

SEQ ID NO: 59099 - DNA, 354 bp, Glycine max
  Peptide Sequence Number=SeqID_150784
atgacatcagatcatctcgggtttgattttgacctggttaaaggtcttgccaatcaatctggtgatgctccctttctgccttgtggaacctcttattcgaggacaagctcactaagggcggaccatgggtttgacgagcctttggagacggtgaaccttgggtttgacaagccaaaggcaggcctagggtatgacaagcctttccttcccagttgtgtccttgctttcccgctcggggatctttccttgcttcacctcaaactcgccacactaggtcgccaagctgagaggctcaaggccaaaccttggtactgtatctttttgatgctcagagcttggtggtctcttccttga

SEQ ID NO: 59100 - DNA, 479 bp, Glycine max
  Peptide Sequence Number=SeqID_150785
atgaagggccctcttgatgagtcaatctcttgctttctcataagggtggagccttgggtactagtacctattgcctttagaggactacacgtcctcgactttaaaggactagacgtcctcaactttagaggactagatagggatacacgtcctcgcctcaaagggcttcacgtcctcacctttagagggcttcacgtcctcgccttcagaggactgcacgtcctcaccttaagagggcttcacgtccttacctttagaggactgaatgtcattgcctttagagggctacacaccctcgccgtaagagggctgcacgcccttgcctttagaggattgcacgtcctcgcctttagagggcttcacgtcctcacctttagagggctacatgccctcaccgtaagagggttacacgcccttgccttcagaggattgcacatccttgccttcagagggctacacatcctcaccttcagagggct

SEQ ID NO: 59101 - DNA, 411 bp, Glycine max
  Peptide Sequence Number=SeqID_150786
atgatcgccaatttcatggtgtccaaggtccttatcgaccaagaaacctcttacttttctttgattggtaggaaaacactaaacgaacttggagccatcatctccacaccatatctcaagatgaagttcccaaccttaacgggagagatcgtaactgtcaagctaagtaagcctaatctcagtttaggtgatagcagtcaactcatgagcgtggatgaagggttcccaatccaaatcctggccttctatgaagcaagtatggcagatcaagatgatgtattgaatgtggatttgcgtgatgacactgttgaaaaaggcccagagcctattaaaggacttgtcaagctacaactcggacccaaacccgaacaatatacacagctcagcagtgagcttaccacccacgagtaa

SEQ ID NO: 59102 - DNA, 768 bp, Glycine max
  Peptide Sequence Number=SeqID_150787
atgccaccaaggaagaacattgcctcgggagaaccagcagctaagaagcacggagacatgagagtggagtttgtagcaggagaggaagtcgctgataatcagacgcggctgctcaatctcatgtcgaccttttcgaagggatttgaggaagagggcaaaggtaaatctggtgggaatccgagactgaaaccagtcgaaggtgatgatttgacgaagttttgtcaattgatgaagaaaattgaactaccgtcattttatggtgatgacccagcagagtggattgcgagggccaaaatctatttcaacgttcaagaaatgcgcgaagctgttcgtgtgagccttgctcaactctgtatggaaggagttatgatacacttttttcattctttgttgaatgagtatgaaaatctgtcatgggaggatttgaagagggagatgttggagtcgtatggtggaaggggagaaggaagtgtttatgatcaattggcatcgttgaagcaatcagggagtatggaggattacattcgtagcttcgaatgtttgattgcccagggattgaaggacgaaattcgtgcgagaatgcgaatcctgcacgttgtgaatcctttgtccaggggacgaatgatgaacattgctcgtgcaattgacgtagaaatctctggacaaagcaaagtgtggcagggaagaggcgaaatatgtggagatggtagggcccaacctggaaaccgacccatttctagtattttaggtaaaactggcccgcggtag

SEQ ID NO: 59103 - DNA, 675 bp, Glycine max
  Peptide Sequence Number=SeqID_150788
atgaccggcggcggatcgatggggagattgccaacatggaaggagagagaaaacaacaagaggagagagaggagacaaagagcgatcgccgctaagatctacactggccttcgagctcaggggaactacaagcttctgaagcactgtgacaacaacgaggttgtgaaagctctatgcgccgaagttggttggatcgtggaagaggatggcaccacttatcaaaaggttcagcttcccctcaatttctcagatctactttcagtcacgggatgcaagagacccagcgcgagtgagattgaaggaacaacaacaaacataagctgtttgctttcctttgtgtcaactttcctttgtgtgcctgttatgttggaatataaaataatgtcattttacataagttgtttgcttgtgaggcaatcgttcttacacaatgatcccaagaattttgctaatgtaggaggagatgtctcaaccacgatgataattacccctgggcctgttgtggacttcttaatatccaatcaaaatgtgagagaccctttttcacttgactgggcaaaggcacttaaaagtagcaattatggttctgaaccaatgctacataattgtgagatctctataagccccaactttactgaagttgagggtcgggttttacaagctccgcggtggtga

SEQ ID NO: 59104 - DNA, 609 bp, Glycine max
  Peptide Sequence Number=SeqID_150789
atgtggcaaggaatgctagtgaggatgcacgttctatgtgttatcgtgaatatggcagtgccccagatgttcgcatttacggggatcctgattttacttttccctcacttgcatcttatggtatttgagttggttaagaactcgctgcgtgctgtccaagagcgttttatggactctgacgaagttgctcctcccattagaataataatagcagatggaatagaggatgttaccataaaggtctcagatgagggaggtggaataccaaggagtggtcttccaagaatttttacatatctctacagtacagctggaatctcattgtcagtcgaacatgaactttctgatattggaacaatggaaaatgtaacaatggctggatatggttatggacttcctatttgccgcttgtatgctagggtgatgttgggtcctatgacaagatgcagagcgttgaactggattccacaggcagcacttgctgaatactacgctcaaagatcaacaccaggtggatttctcatcagcgaaggcaccttgatctcccccactgctcctgggtactttacctatctctttccattattattcttttcaacaatatcataa

SEQ ID NO: 59105 - DNA, 2367 bp, Glycine max
  Peptide Sequence Number=SeqID_150790
atggcgtttctagtgctctctagagctcctcctccgattgctctattagggttcccaaacgttagagagaaggagaagggattgaagcctccattttgtactgccttcaaccatgcaactaatagtgagaagaaggtcaccttcacattgaccaaagatgagagtttttacttcatagcagcacattgggttgatcttcatggccttctgtacaatgcattgccatcaaatgtatttttgtggggtcatctttttctctctttccattttgctgatgataagggtccagtcatagtaaaggccaaagtactagaaactaacaaggttgtagggatagtaggggatttgcttgttgcagcagatggggttcttgagttttcaaatgttgagaattcaaaaaccatcactggcatcagaaaggtataccctgatgataagggtccagtcatagtaaaggccaaagtactagaaactaacaaggttgtagggatagtaggggatttgcttgttgcagcagatggggttcttgagttttcaaatgttgagaattcaaaaaccatcactggcatcataaaggtataccctgatctagaaaaatgcttgtactttgacttggcctctagcacacatactgtgttgtatgagcttcaaaacaagaagccagagcctaaagttaagggaacatcagtgacaatgaaagtaaatagtgacgtgatccagaagatgcaccaagaagcagaaaaagtttggattcctgagttgttcctaaaatctcgttctcgaacttgcgactcttccctcacatcaatgatcctcttcaagaaaatgtttgagctcgcagagcatcgatcgggtgcggatgtaggagaatacatagaattgcacccgccgatcaggagaacagtcgtcgctgcctatcacgcagtggaggtgctcgctgatgcagagggggatgtagctcaccctacaactcctcactgctttagaaacacaaacatgtctatattggatgcagcagtgctaggcaaatgcatagagaaatgggtagcagaaaagcttgaatcagctttagaagagtatcagttcattaggctaccagtcacttccaagcaagttctgcatgcaaggcatctcgggcgggcattaaggatgtctccactgatctttgccgcttttgccgccgagcccacagcatccgcacgtaggcaacgggaagttgcagctgttgttaagcatgctcctcacgtgggtgatgcagctaaagaggtattccaacatgttgaagaagttattgatgatgccgagggttttccaagcgagccgcgtgacctatcaatgttgactgcctatactgatcatgtagcagtcattgtttggaatggagagttatcctcccatggaaagaaggttcagaaatttgggaggtttgctgctaaaattgaaggactagtcgttgtcacaagattaactcttttgatcgcatgttcattggacactggcgattggggacttatatcgacttttgtcaagaggtggcataaggagacgagcaatttccatcttccagtaggagaggtcaccatcaccctcgatgatttacttaaagtctctaaagatgaagctagagctgagacagtacaatatcatgggacatacatacgcttatcgtgtctacgagagatttatgatagtaaatgtgaggccaaacattggattgtagccgctcgagcttatttgctacatttgttaggagttgtcgccctagtgcatatgtacaataatttgaatgatgcttgtaagagcggcgaccaacaacttgctggatatatcacactattacaatcttttccatctattgttgacacttttacggacccagactatgatgaaagatgccttacggtgaccaccgtgcagttcgacctcatttcatgtttttctggacatatccgatggggtcctattgtcgtgatacaccgaccaaagagggtggtgcaaaaatttaggtatgctcagaccattcctccacactctttgggatcaagattatcgttcgaagatattgacaacagattgatgcatttctctgagtaccttgcaccaggatccgcccaaacattcacctgcatgcaagatgagacatatgtggaaccatatatgcttgagttcccagtggcagcatcatctatggaggaagcacctacacatgcaccttctgatgtggagcagcctagacatgcagcggcttgtcaagcaattgcacaaaggttggagcatttgctcaacctaaggatagtgactgaaggcaaagaagcatacgatgtttatgtcaggtcacgacgaaggcggcacacggatcacgcttga

SEQ ID NO: 59106 - DNA, 333 bp, Glycine max
  Peptide Sequence Number=SeqID_150791
atggaagtaaccatcttgcaaaaattggggcaaaagatggatcgagttacatcgctacttcatctactgccaaacacatttaggactgttgatgtccttgttacttccagtttcaccttgacaaagatgtcatggaccataaaagaacacgctttacggcgcccttacctaacccgtgctagagttagagtaatggctgaagtagatggaggtgcaagagcagataaaggccgacatggaggccatgtaagagaaaatggccacaatgatggaggccatgatgagcatgaagaagataatggaagccaatgcggttacaattgccgctactag

SEQ ID NO: 59107 - DNA, 399 bp, Glycine max
  Peptide Sequence Number=SeqID_150792
atggctactccacccagctctcctcctcctcctcctcctcctactaaagcaacatcacagtcgtcatctaccttgaagcggaaaagaaaagccacacggctaagatcattggcgactagaccagctggggcagacagaccggtggtccacgtcgatcctacgaccgggaagactgaatttgatatccctgaagcatctgacgttaggacaaaaaagaaaatacttcagattgtgggggagcggtggagacagtttaagtctgatttgacgtcaaaatgggcacttgcagtcgacaaggatagtgtcgatgacattgtttgcgaaaaatatggcattagcaaggagaaatgggcccaattttgtcagagccgtagagacccctcgtgggaggatgtgtag

SEQ ID NO: 59108 - DNA, 4278 bp, Glycine max
  Peptide Sequence Number=SeqID_150793
atggagggcagaaacatatccagggttgatagtgcaagagccagtggttctaacatatggaggaacaacaacatggatgttttctctacatcagaacgcgaagatgatgaagacgctctcaaatgggcagccatagagcgactcccgacgtatcttcgcattcagagaagcatactcaacaatgaagatgggaaagggagagaggttgacatcaagcaactaggcctcacagagagaaagattcttctggagaggcttgtgaagatagcagaagaagataatgaaaggttcttgctgaaactcagggaaagaatggacagagttgggcttgatattccaacaattgaagttagatttgagcatataaatgtggaagcacaagtttatgttggaggaagagcattgccttcaatgctgaacttttttgctaatgtactagaggggttcttaaattatcttcacataattccaagtccaaagaaaccgttacgtatacttcagaatatcagtggaatcataaagcctcgaagaatgacattgcttttggggccacccggttctggaaagaccactttgctgttagcattggctggaaaacttggtaaagatttgaaacattctgggagagtaacatacaatgggcatgagcttgaagagtttgtgccacaaaggacttcagcttatataagtcaatatgataaccacattggagaaatgactgtgagagaaactctggctttctcagctagatgtcaaggggttggacaaaactatgctctcaatcagagttttgaattactccactttacagagattttggctgagctactgagaagagagaagcaagcaaagattaagccggatcctgatattgattcctatatgaaggctgcagccctaggaagacagcggaccagcgtggtcaccgattatattctcaagattttgggacttgaagtgtgtgctgacattatggtaggagatggaatgataagaggtatctcaggagggcagaaaaagagagtcactacaggggagatgctggttggacctataaaggtgttattcatggatgagatatcaactggtttggacagttccacaacttttcaaataatcaattctatccggcaatccatccatattctgaatggaactgcacttgtgtctctgctacagccagcaccagaaacttatgaactatttgatgatataatactattaacggatggccaaattgtgtaccaagggccaagagaaaatgtgctagagtttttcgaatcaatgggtttcaagtgtcctgaaagaaaaggagttgctgacttcttgcaagaagtgacatcaaaaaaggatcaatggcaatattgggtgcgtaaagatgaaccttatagttttgtcactgtcaaggattttgctgaagcattccagttatttcacataggtcaaaatcttggagaggagctagccagtccatttgacaggtctaaaagccatccaaatgtattgaccacaaagaagtatggtgttaacaaaaaggagctgctgagggcttgtgctagcagggaatttttgcttatgaagagaaattcatttgtctacatattcaaagtcacacaactcatctatttagctatcatcacaacaacattatttctacgaactaagatgcatcgcgatacggtggaggacggaggagcttacatgggtgcccttttctttgcagtcaccgttgcgatgttcaatggaatatcagagctaaatatggctatcatgaaacttcctgtcttttacaagcaaagggaccttcttttctatcctgcatgggcttattctcttcccccatggattctcaaaataccaattaccctcatagaagtagctatttgggaaggcatctcttactatgccattggctttgatcctacatttggaagggatgttatagttgcaaacactgctggaagttttgcattacttatagttctggttttgggaggatttgtgatttcccgagagaatgtgcacaaatggtttctgtggggttactggtcctcaccactgatgtatggacagaatgctatagctgtgaatgaatttcttggtcatagttggagaaaggttacacctaattccaatgaaacactgggagttttgatactgaaaactcgaggatttttcccagaagcttattggtattggattggagtgggagcattaattgccgaaaactttacttggatctcttttcccaccacagacttacttggatcttctgcagcattcagaaaggatcaagcatcagggctatcccaagagaaattgcttgagagaaatgcttcaacagctgaagagttgattcaattaccaaagggaaacagctcttctgaaacaaatattgtagaagaagcaaacataccatccagatctttttctggaagaattagtgatgataaagctagcggaagtggaaggaggggtatggttcttccttttcaacctctatctctcacatttgatgagatgaaatattctgtagacatgccacaggaaatgaaaaagcaaggagtttttgaggaacgtctagaacttttgaagggtgttagtggtgtctttaggcccggagtactaacagctctgatgggggtaagtggtgccggtaagactacattaatggatgttttagctggaaggaaaactggtggatacattgaaggaagtatcacaatatctgggtacccaaagaggcaagaaacatttgctcgtatctcaggatattgcgaacaatttgatatccactcacctaatgttacagtttatgaatctttattatattctgcatggcttcggttaccccgtgaagttgatcgtgcaactagaaagatgttcattgaggaagttatggagctagtagagcttaactcaataagagaagcgcttgttggattgccaggagaaaatggactttcaaccgagcagcgcaagaggcttacaattgcagttgaactagtagccaacccttcaataatattcatggatgagccaacctctggcctggatgctagagcagctgcaattgtaatgagaaccgtgaggaacactgtgaacacgggacgaaccgtggtttgcaccatccaccagccaagtattgatatatttgatgcctttgatgagctgttacttttgaagttgggaggggagcaaatatatgctggtccattaggccgccactgttcccatctgattcagtactttgaggctattcaaggagttcctaagatcaaagaaggttataatcctgcaacctggatgttggaagttacatcagcaggcacagaagcatctattaaggtcaacttcaccaatgtgtacagaaactcagaactatacgggagtaaagagcaagatcttttcaatgctatgggttcaatgtatgctgcagttaccttcattggagtgcaaaatggtgcctcggtgcagcctataatagcggtagagagaacggtcttctacagagagagagcggctggaatgtattcagctttgccatatgcacttgcacaggcccttatgtatggaattatcgtatatgccatgatgggattcgattggaccacatcaaagttcttgtggtatcttttcttcatgtacttcactttcttatactacaccttttatggtatgatgaccatggccattacccccaacgcacacgttgctgccatattgtccagtgcattctatgcaatatggagccttttctcaggcttcgttattcccttgtcttggtactattggatctgccctgtggcgtggaccttgaatggattggtggcttcccaatatggagacaacagggacaaacttgagaatggtcaaagggttgaagaatttgtgaagagttattttgggtttgaacatgattttctagggccttcctcttctccctttcacccgcaagacctatcatcgttttttgctacctgtgactgccttttgcgacctgtcaccaccatctcctcctcaccatcgttgttgctggggttcacgactgccattggggttcgtgactgccgcgaggtggagcatcctccgttggagtccgacatcaacgcaagatatgtgatgcaagctccattggagcttgtaggcctaggatcttcttcatcaatggattcctttgcttcttggaagatgaatggcagcggaatggagaaggaagagggagaggagacgccacttcaaggagaagatgagtctagaagaagctcaccaccatag

SEQ ID NO: 59109 - DNA, 405 bp, Glycine max
  Peptide Sequence Number=SeqID_150794
atggcatctaagaagaggaaagctccttctacccccacccaggccacatttgatagattcaggtggcctgaccaggagcccaacctttctccttctggaaggtgtggggcctccgcagcccaggagcctgcttctaaggagccagcagcagcagcagcagaaggcgaggatgagctcagccctactgagcctttttattttgatgcaggtatacacatggctcaggaggaggatgcttctatagaccagaccccagagccatccccagtacccatacctaatgatgccacaccatttgcaccagcacctgagttagagcagcctatctttcaggattcaccagctgctcaggtgttggaccttaatgagcatgcacaagagcaaacacaagagcaggacatttaa

SEQ ID NO: 59110 - DNA, 207 bp, Glycine max
  Peptide Sequence Number=SeqID_150795
atggggtgtatgactggtcccttcctagggaggattgcatcaaataggcccaggttcttgaaggtggatatggaagagggccgccactcgttgggttgccatcagtcgtcggacctggccatggtgtatctcagatgggccaatgtctaccccaccttgaatggtaatgggccgtccatggtgaacaaaggtcatttgaaggtgtga

SEQ ID NO: 59111 - DNA, 300 bp, Glycine max
  Peptide Sequence Number=SeqID_150796
atgtatcctcttgatttcaggattgtcatcatcaaaaaaggggagattgtggaagcaatgacttccaagattattttgatgatgccaaagaatcaagagttaagcaagttccaaagaatcaggagtcaaaaagcttcaagaatcaagtttcaaagaatcaagattcatgaacaatcaagtttcaagattcaatcaagtttcaagaatcaagattcaagaacaatcaagatcaagattcaagaatcaagagaagactcaatcaagataagtactaaaaaagtttttcaaaacattgagtaa

SEQ ID NO: 59112 - DNA, 432 bp, Glycine max
  Peptide Sequence Number=SeqID_150797
atggaagaaatgtttagattccggaatgaagtctgccaagctggacaaaactgcaacaagcacaaagcaaacaccaaggtcaacttgcacaagtcgaacaagagtcatatgccagataagcgccagcctctccccaaagggcccaaatacaagcgttacacacctctaacggccaatcgcaccacaatcctagaggaagcattcaaccttggggtacccatttggctaccccagacgaaacctttcaggccatggtcagacacaaccaaatgttgcagatatcaccgcgataccaaacaatcaccaagcaagagcaagacccgaaggacatcaagaggagcaacgcaggaaccaggaagcaaacataagaagaatagaagaccgaggcagacaaagacacttggaatagtggtgtcgcaacctacatcatga

SEQ ID NO: 59113 - DNA, 339 bp, Glycine max
  Peptide Sequence Number=SeqID_150798
atggcgagttcatacatgcaagaacgcatgaatatcatgactccactccataggcttgacaaaaccctgggcaaacacgtccttggcctaagccttgacaaacccaaggttacccttggcaagccctcttcattactcaattccatctccatagtaactcaaggcttatcaaaaacccaagatctacccttggtatcaaaacccaaggtctgcccttggtacaaaaacctaaggtccacccttgatacatacttccacaaaaacccaagcacccccgtggtcctctcacatgcagcaactacgacgaccactgtcaagggtccaagttcaaccaaatga

SEQ ID NO: 59114 - DNA, 495 bp, Glycine max
  Peptide Sequence Number=SeqID_150799
atgtggtaccattcatcaggaaatagcctaagcatgtccacacgacattcttacttaggaaaactaggcagcaagtatcgaggtcaccatatcgtgcataggaaacacccctctatggtgatcaacctaagtctcaagatatccatcattgtcactgcaccttcacgtacatacataacatacatcgtcacaatgacatttttagcatcgccaacatcacatctaaatgtgtttcgcatctcattagtcgaaaacattgtttttcttgaaaaccagcacacacagggacaaagttacattctcataattgggttccttgaccctaattatgcggcaagcaatggtggctcgtggtgggcactagtggtcgtgggtggtgaagaagaaggtgttagggtttggatcttgcttaacaagcttgtctcgctaaacaggagttcacttttggcgctaaacgtgacagtttgcgctcaatgcaatttcctcttgggttag

SEQ ID NO: 59115 - DNA, 330 bp, Glycine max
  Peptide Sequence Number=SeqID_150800
atggatggtccccagacgaaattagggtatgacactggtgcagtgacttcttttggataccgtaaagatcagaatggtcaatggctgaagaaggatgcatttcctcctcaagatgagcgtactccttctcctcctcctcagcgagatgattcagccctcatgactgaagttctttccaagttacggggtcttcgtacttatgttggcgaacattttaattctctggatactcgctttgccggcatggatatccgtctcacacagcttgaagaagatgtgggttatattcgtcagagctgcgaccttccaccaccacctccaccttcttag

SEQ ID NO: 59116 - DNA, 315 bp, Glycine max
  misc_feature (29)..(29): n is a, c, g, or t
  Peptide Sequence Number=SeqID_150801
atgcagagactaacgttgtcatctgcacncttttgtcaaccaagggcaagcaagcccgttgacacgcagagacttacatcgtcttctacacctttgtcatccagagacggcgagtccgatgagatgcggagatacccaagtgactcaaagtcaggtagtatgcagagactaacgtcatcatctacacccattgtcaaccaaaagcaagcaagcccgttgacacgcagagacttacgtcatcttctgcacctgtcatccagagacggcgagtccgatgacatgcggagatacccaagtggttatccgtataaatga

SEQ ID NO: 59117 - DNA, 429 bp, Glycine max
  Peptide Sequence Number=SeqID_150802
atgaaggccgacatgaaggccatgaaagaccaaatggccgctatgatggaggccatgttgagcatgaagaaaataatggaaagcaatgcgactgcagttgccactacgagtgtcgccactgagggagacctaactcacccatcgggcctcaatcaagtaaatcctccaatctcggatatggtaggccggggaggagaagcattgggaagtacaagcagtccctatgttgggcagagcaagaattctttcccaccatacaacttgcctcccaactacacatcatccaatgttgcacacactccaaatgagaatgtcaataactccactcccatactcattgagagccaacaaccccaatctgatcatgcacatgtctctcaacccgtgggggaggcacatggggcaccccaagaccataatctaagctga

SEQ ID NO: 59118 - DNA, 303 bp, Glycine max
  Peptide Sequence Number=SeqID_150803
atgaccaccaatggccgccatgagccgtcgttgcttgtcgctggaccatcacacggagagaaatgctttaatcagagtgatatcctcagaatccatctcaaggattcagtggaggacaacatcccaattctttctttcatagtttttctgaggtcacattggcgtggtcagaatttcaaaatgacgtctctttgtagtagaacccgaaattctcgtagccctttatgttttgacagggaactatgtgtttggaccaacgaatgtgaacgtgagaggtctctgagcaacatagagaggagctga

SEQ ID NO: 59119 - DNA, 438 bp, Glycine max
  Peptide Sequence Number=SeqID_150804
atggttgaaatgtcatgtgctgaacatgattggcatgcagctggatcacaatttatcacgcatactaccggaagatttttagaaaaactggagttggagagaacgccaattgacacaaagggctatgagactttgttgagtttggtggaaaatactgctggagatagttttgatctatactatgtgtgggtcccagccggcaccctcgtattcatcgtcaccgcagggttcttgtccgtgtgcggtttcggcgttgcactcgtggccgcgctgtcgtggatgtaccgttacttcagggggctccacccgcccggttccgaccgcgtcgactacgcgcggacccgcatttacgacaccgccagccacgtcaaagactacgccagagactacagaggctatttgcagagtaaggttaaagatgcagctcccggtgcgtga

SEQ ID NO: 59120 - DNA, 183 bp, Glycine max
  Peptide Sequence Number=SeqID_150805
atgccaaaagatagggggacttgtcttgatttcagggattgtcatcatcaaaaagggagagattgtagacaaatgatcaagctgaatgttttgatgatgccaaaggttcacatgcgtctcaaagctttattcaagacaaagaaattaaagatattcaagatggatgatcaagacagtctctag

SEQ ID NO: 59121 - DNA, 303 bp, Glycine max
  Peptide Sequence Number=SeqID_150806
atggctaccattgcattatcaagtagatatgggagcaagttagcatatgacaccggaatttggggtgaatcctacaggcttttcgctgcaaaattcatttcttggttggtgttttggtttgtgccaaaggtggtcttcatcattggaagtgcggtagacaggctttgtggtttaaggatggcctttgtggataactgggtggtgggtaaggaggaggaatggcagtcacagcatgggtttctccctctttctcaccctcttcatttgccccagttttctcattcgtccaagcaggatgattaa

SEQ ID NO: 59122 - DNA, 291 bp, Glycine max
  Peptide Sequence Number=SeqID_150807
atggcaatttggtactctctggaattttgccgtttaattgattttctgaaagatccaatgttttcaaggcagagaatattgaaagaggcgccagagagggtgagagccccgtcgtgcccggaccctgtcgcaccacgaggcgctgtcggcgagtcgggttgtttgggaatacagccccaatcgggcggtaaattccgtccaaggctaaatactggcgagagaccgatagcgaacaagtaccacgagggaaagatgaaaaggactttgaaaggagagtcaaagagtgcttga

SEQ ID NO: 59123 - DNA, 186 bp, Glycine max
  Peptide Sequence Number=SeqID_150808
atgcccaacattgtgaatttaatgtgtttcaacttcaattacagcgaggcctatgcgcttagcgagagtcatgcgctaagcgaggtactcagcccgcttagcgagttgggagaatttggaggagaatctgagaagcacatgcgtgctcagctcgctcagcgaggcgttggtctcttcatgttctaa

SEQ ID NO: 59124 - DNA, 321 bp, Glycine max
  Peptide Sequence Number=SeqID_150809
gtccctgtaggccggcctagcctattcccacccttatggctaattcatggcgttaatgctccaatacttcaagagagaaacaagatggcaccacatagggctgaagatttagtatttgttcatagcaacctacgacttctctcaaggaatactccacaatatcatcaagaggaaactaaaatgtgggatgtagctggagatgattttggatcacttgatgattgtggtattcttgaaattgttagtttgtctttagatgaaccagagttagagggtgtctttttcaatgatgatgatcacctaggggatgaaaggccttag

SEQ ID NO: 59125 - DNA, 509 bp, Glycine max
  Peptide Sequence Number=SeqID_150810
ggatcgcgcccacaaggcacccagtggacccggaggagtccaacagggccctgggggtgcccgcccccctagcaaggtcatgccatcgtgacataagggtcgcgcccataagacaccaagtggacccagagaagtccaacaaggccctggggtttccagctctaattacgggcctctgtcattcctacagggtgcccgtccccccaacaaggtcatgccatcatgacatagggatcgcgcccgcaagacacccagtggacccgaagaagtccgacagggtcctagggtttccagctctgattacggacctttgtcagttctacggagtgcccgtcgcccccagcaagttcatcaggccccctattaaccaggctttcatcaagaagtattgcgcccccaggcaggcgcagggcgagacatcacagcagcctagggatggccgacagcgggcaacaaacgcattgccactacctctagagttcacctcaactcatccacaaaaaggttag

SEQ ID NO: 59126 - DNA, 462 bp, Glycine max
  Peptide Sequence Number=SeqID_150811
taagcattgcctccgtagattccttctctgggcaaccttgcctgtccgatacagcagtgatggtggcccgggtgcccgggtgatgttggggaaaggttatgaactcggaatgggtttaggcaggaacaacgacggcagaaccagcctaataagcaccagaggaaaccatgggaagtttgggttaggctataaacccatgcaagcggacataaggaaaagtgtcgcaggaaggaagagcggaagccaaggttcgcaattgggacaaaaagtcgaagggggcccgccctgccacattagtaggagctttataagcgagggtctaggacacaaaggccaagtcgttgtgatatgtgaggatgactctccaagtgggtcggatttggtacgaccatgccctcctggtttccgacttggaaattggcgagtagagcagtgcccagacatttacgagacaagcataat

SEQ ID NO: 59127 - DNA, 443 bp, Glycine max
  Peptide Sequence Number=SeqID_150812
acacgcctttgtaaaatggtggtcacaattcgatacttcaaaggctgctccagatcaagtcaagaactggttccagagcaatcctgagttccttaaacctgctgatccggagacatctttggttctaaatcaaaagtcgcaactagcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgattcattctaccagaatgaagatgactgttttgtcctcgtcctcctttgtgaggcaccctttcagatagtcccagaatcagatctcccttgtcccgtcactgatcctgtgcggctctgccgccgcttcggtttctttgttttcgaaaacctgg

SEQ ID NO: 59128 - DNA, 690 bp, Glycine max
  Peptide Sequence Number=SeqID_150813
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttgttgattacttgtttgcttattgcaatattctttattcattccaggctaagtgccttgaaactggtgaatctgttgccataaagaaggtgttgcaagacaggagatataagaatagggaactccaggttatgcgcacagttgaccatcctaatgttgtcaaactaaagcactacttcttttcaactaccgataaagatgaattgtaccttaacctggttttggagtatgtacctgaaactgtctacaaagtttcaaaacactatgttaggatgcaccaacacatgcctatgtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 59129 - DNA, 255 bp, Glycine max
  Peptide Sequence Number=SeqID_150814
atgaccggccctctcaatgagtcaatctcttgctttctcataagggtggacccttgggtactagtaccctcaccttcagaggactacaggtccttgcctttagagggctgcacgccctcaccttcagaagactacaggtcctcgcctttagaggaccacacgtccttgccttcagaggactgcatgtcctcacctatagaggtctacatgtcctcaccttcagaggactacacgtcctcaccttcagagggctaa

SEQ ID NO: 59130 - DNA, 549 bp, Glycine max
  Peptide Sequence Number=SeqID_150815
cgtgagctggaatctctctacggacgcatcaaccgcgaaggtttcaccgtggtcgccctgtcactgtactggaaaaacgcctggtgcaaggtgaaggttggcgtcgcgaagggtaaaaagcagcacgacaaacgtactgacctgaaagagcgcgagtggcagcttgataaagcgcgcatcatgaaaaacgcaggacgaagtgaaatctggtatactcagttcaacactattggggctgattctggattcgacgggatttgcgaaacccaagcaccaactgtatatccaaccagtaaaaaggagagtgatatgtacgtggaattagtgtatgacaagcgcaatgtgcagggtttggcgggagctcagaaaatcatactgactgagctgacaaggcgggtacaccggattttcccggatgcagaagtgaaagttaagccgatgcagactaacgcgttaaacagcgactgcacgaaaacagagaaagaacggcttaaccgtatgcttgaagagatgtttgaagaatctgacatgtggctggttgaggaataa

SEQ ID NO: 59131 - DNA, 174 bp, Glycine max
  Peptide Sequence Number=SeqID_150816
atgcttcagagtattcatcagggacagattttacgactacaaaccttgcaagtggtagctcttccaaggttcattctatcggtagagcagttcattgagaagctatcctggcttggaaccttaccttctattgtgagaaagggtgaggatcccagtgctcaagtacctcaacag

SEQ ID NO: 59132 - DNA, 301 bp, Glycine max
  misc_feature (230)..(230): n is a, c, g, or t
  Peptide Sequence Number=SeqID_150817
atggaggccgacatggaggccatgaaagagcaaatggccgcaatgatggaggtcatgatgagcgtgaagaagataatggaagccaatgcggttgcaattgccgctaccagcgttgttgctaaggtgaacccgacgtccccatccggcatcaaccaaatgaatcatccaacctcagatatggtaagcagagatttgggaagtacggacgggccccatgatgtgcaaattcnaaataagcacgccttcccaccatatgggttgcctctcaagtatacaccagccaatgtagcgtacactccta

SEQ ID NO: 59133 - DNA, 171 bp, Glycine max
  Peptide Sequence Number=SeqID_150818
atggcgccaaaaacttgttcggcttccgacaagtgcaccggatcgcacaacctaatcctgatgaagcatcatccgcagattcctcttgtaagactaaactcaaccaggaccgcattaagacacacatactcaactaacttatcgcaccccaattccctcgtgaaagcatga

SEQ ID NO: 59134 - DNA, 584 bp, Glycine max
  Peptide Sequence Number=SeqID_150819
gagttgtggaaccgacaaaacctgcacataggccagatcatcatgtcgacgatcccctgtatctgatgacattgaccatcccacaactttttcttaagccgttgcaggttatgtgggatgctactgtgtttggagtgtttaatgacaacttctccttgtacataaagcatgaagatctgtttgaaatagcacatgatgtcaatgtctcaacatctctgttatacaattatggattctgtaagcatatgactgagacaagtatgcaagcgaggaatgtcgatgtgtatggattcctcaagccacgatccatacagagatctgagcaatcacaatttgaatcagaaagttatattaagaactggatgcagaattcaaagagggatgtgtacctaggagcctacttgaatggtgcacattggcaaatggttgtcattttgcctaaggaaaatgttgtcatctggttttgttcattgcataataggccagacaactacctcaaaggaattattaacagtgctttgaaaggatttgatgatactccacaaagtaaatccgagactgctgctaagtggattgttgttaaa

SEQ ID NO: 59135 - DNA, 785 bp, Glycine max
  Peptide Sequence Number=SeqID_150820
cgccgatgctaggcaggtcattggacagttgcggctcgcgcatatcttcttcactactgggttgcactctgtttgctaacaagagtgcaaccaatgtccatgttgtctacttggaggcccttcgtgatctcagtatgacagagaggtacgcctggggagtggctgctctggtggattgcgacgaagaagaccgtgaagagcattcgcacgccgtcgtacagggagtgcctgtaccgactccggattctggatgtctgttggatcccttatggagagcatcaggaggtccgggacttccacatcaaatcatgctattccggtctcttgcgctggggcctgttgctgtttattaccgaccggagagggtcgtgcggcagtttggctacacgcagaccattcctgctcctcctatcgattcatgggtctcgtatgataatatacacaacaggtggatgcactacgaggatcatatcgtaccagcaggtgaggtgtgcgttgtgtcaggggcatgtttcagtgactacatcgactggttcttccgcatctctcatcctttcatgacaccaggccacacattagatcctctgcctcatggtcacgccccgcagccccgagtcgtccctcaggccccgcagacggatatccctcacgtgccggagccaggagcatcgtccacatctgcggaggagcctagacatgcagtggaagtttgtgatgacattgctaagaggtcggagtgccatctgagtctaggggtggtcacgcctggctcatcgacacatgag

SEQ ID NO: 59136 - DNA, 212 bp, Glycine max
  Peptide Sequence Number=SeqID_150821
gagaagatgaaacagaacctgaagagaaaagaaaaagggaagacgaaacagaacatgtaggccgtggtggggccgaggaagaggaggtggtcgtggtggttgagggcagaggaaaagggggaaggaagggcaagagggaaaagggaaagaagggaagggaaggatggggaggggaaaggagggacaagggggaagaggaaggggttgtaggg

SEQ ID NO: 59137 - DNA, 126 bp, Glycine max
  Peptide Sequence Number=SeqID_150822
atggcagattccccaaggagtcacagtaacactcatcagaaggaaagaaacatagcaaacaaacaagagaattcaaaaatcaaatcagatatgttgtcagataaaagaaaaattacagggaattaa

SEQ ID NO: 59138 - DNA, 228 bp, Glycine max
  Peptide Sequence Number=SeqID_150823
atgagacacagctccgaactcgaaagtggaggacacatgaatgaaaacgcaattcatggagctccgaaaaagggggagaatggaggattgcttgagggtccgcacttaggcaatcatgaaacacagctccaaactcgaaagtggaggacacatgaacgaaaacgcaattcatggggctccgaaaaagggttggcaggaccgaacagtccaccgggtttttccacctaa

SEQ ID NO: 59139 - DNA, 318 bp, Glycine max
  Peptide Sequence Number=SeqID_150824
atggcgagttgcataaggaagtgggcttggatgagggtgtcggaggaggaatccagtgcgacgaggtgctgcatagtggactgcaggctcatgacagcgttaaggtactgtttggcttcttggcgtgtgttgctgaatagaggggcggtttggtcagaaggggaaataagttcccatttggaaatgatggcgcgagcggtttcgatgttttcgtccattagtgaatcggagaaggttcttgtgggagaagaggaaggtggcgaaggtgatgttttgaagaagaacaggccatcacaaggtccacaacagaatgagtaa

SEQ ID NO: 59140 - DNA, 494 bp, Glycine max
  Peptide Sequence Number=SeqID_150825
atgacggtgatacgtctgacacatgcagctcccggagacggtcacagcttgtctgtaagcggatgccgggagcagacaagcccgtcagggcgcgtcagcgggtgttgtcggatgcgtaaggagaaaataccgcatcaggcgccattcgccattcaggctgcgcaactattgggaagggcgatcggtgcgggcctcttcgctattacgccagctggcgaaagggggatgtgctgcaaggcgattaacttgggtaacgccagggttttcccagtcacgacgttatccgaaaatgtcaacatagtacttgatggtttgcctgatgaatttgagtctcttattactctcgttagtggaaagtttgaatctctctctgttgatgaggttgcaaccctacttttggctcatgagactcgattatcttgcaagaaagctcttactttgattaatcttactaaagctgataaatctagttttagcctaattcttctcaacaa

SEQ ID NO: 59141 - DNA, 477 bp, Glycine max
  misc_feature (52)..(52): n is a, c, g, or t
  Peptide Sequence Number=SeqID_150826
ttaccctcaccgttgagaggactacacgtcctcgccttgaggggactacgcngtctcaccatcagagggctgcacgccctcaccatcagaggactacacgtcctcaccatcagagggctgcacgccctcaccatcagaggactacatgtcctcgccttgagagggctacacgccctcatcttggttaccctcaccgttgagaggactacacgtcagagggctgcacgccctcgccttgagaggactacatgtcctcaccttcagaggactacacgtcctcgccttgagagggctacacgccctcaccttggaggactacacgtcctcgccttgagagggctacacgccctcaccttgggtactagttaccctcactgtcagagggctacacgccctcaccttgaaaggactacacgtcctcgccagcagagggctgcacgccctcaccttcagagggctacacgccctcgcctttag

SEQ ID NO: 59142 - DNA, 559 bp, Glycine max
  Peptide Sequence Number=SeqID_150827
acttggatttcctactctgatcactgcattatgtagagccagaggggttgtctctgaaagccttacttttgagcgcctaagcccggtcattaacttgacctacatcaggaagaactgttggaatctagaggatctaatagtttccatccgaggggctaggagggcaagggcaaggccagctgagcttccttccacttctgcagcttctactccagcagctccttgtgtcccagctcagacagattctcatttacaggtggtggcgcctccaggatctattccttcagttgagcagtttagggagatggtagcctggcccgggactcaaccttctcttcataggcaagtgagagacacagagcctcctgcaccagtggtggacctaccctcacctcagcacatagcaaatccctccactcttattctagagataccagaggacccaaccacaccagtcctggctatggacacttctcctccagctactccagtatttcatctgacagatgaggaggatgttaagacacaggataccctggaccagtcacaggaattctaa

SEQ ID NO: 59143 - DNA, 560 bp, Glycine max
  Peptide Sequence Number=SeqID_150828
atgcaatctcagggacttgcaccgcctcctgaccctttggttggtcccttcggtcctcgagtaagcacaaaggggagttgtgttgatccctcaggaaacgatcctgagacggtgactctgacagatcttgcccgcctggttgccatggggagagtttatgagggatcccctgttgttcataacactcctttgttgcctggccaagtaaaggtgagtgtggaggaggttacagatgcaaatgctccagttcctgtacccactgatgaggtttccttagtggggcaggcacttcacaccttccttgcttggccgacacatctggtagctgtgtctccggcaaaaccacctccgaagcccgatccggaggtcgatgatccactttatctgatgaaattgaccatcccagagcttttcttgaggccttatcaggttagatgggatgccaccgtgttcgaggtctttaatctagatttctccctctacataaagcacgaagacctctccgaaatcgcacacgatggtcaacgtctcaacatatcagtgttacagttgtggattct

SEQ ID NO: 59144 - DNA, 93 bp, Glycine max
  Peptide Sequence Number=SeqID_150829
ggtcagactcaactgtccgtggtcagatgccaggatgaagttggaggccgaaacccatcaaggtacttagggatggacgcaagtagaggctag

SEQ ID NO: 59145 - DNA, 87 bp, Glycine max
  Peptide Sequence Number=SeqID_150830
atgtgtatacagaaagaagaaggagagatgggagtcaattatttcaaatcgttttgggttggaactattgtgattgagatcaattaa

SEQ ID NO: 59146 - DNA, 162 bp, Glycine max
  misc_feature (124)..(124): n is a, c, g, or t
  Peptide Sequence Number=SeqID_150831
atgactaaagcacgtcaaaagggggtacggaaagaaaaaagggaggagcttgccacccagctcacccaggcgagctcagctcgcccagacgagctaggttgcttcctccagaaggcggtaccgncttctggtggaattcctgaaagacccaagtgggcctga

SEQ ID NO: 59147 - DNA, 210 bp, Glycine max
  Peptide Sequence Number=SeqID_150832
atgggtattgcctctagatctttttacatcaatggtgcctttatgtttaagttggagagtgtcgcaacctacccttcggcgggagggcgacgcgtgactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 59148 - DNA, 57 bp, Glycine max
  Peptide Sequence Number=SeqID_150833
atgccgaccaataggcgaccaagtccaaagccaaaggacacacctagttgctcatga

SEQ ID NO: 59149 - DNA, 153 bp, Glycine max
  Peptide Sequence Number=SeqID_150834
atggcggtgcgtctgttgcccgctgccggccatccccaggctgctgtggcactccgtagaactgacagagactcgtatttagagctggcaaactccaagacccctgttggacttcttcgggtccacaggtgtcttgcgggcacatctccgtaa

SEQ ID NO: 59150 - DNA, 141 bp, Glycine max
  Peptide Sequence Number=SeqID_150835
atgaataagggcaaggaacctttagaaggacttggaggacctatggcaagggccagaacaaagaaggccaaggaagctcttcaacaattacaagtggagaagcttcggattgttaattgcaccatgttccaagaagagtag

SEQ ID NO: 59151 - DNA, 251 bp, Glycine max
  Peptide Sequence Number=SeqID_150836
atggtgtctcctcaagggaggaatacatggaaagttgatgatctcgtgccttatatggagaaaataatgattttatccgaagagcaagagagaatcactgagcttgcatcacatggtctagcgcgtcaatttccagcacaagagtttcacattcttcagtcaagtgttgaaactcaggacataggcagacgaagggaggccgttgaagcggaagaatattcccagcaaatggcggagcgtggccatggaat

SEQ ID NO: 59152 - DNA, 431 bp, Glycine max
  Peptide Sequence Number=SeqID_150837
gacctcattgaagctcaaaggtccaacctccatagaagccccagaagcaagcttccatcagagaggtgtaatcttcacaaacgcctcaccaacttggctgatgggactattgatgttgctttggtgaaagaattttatgctaatctctacagctctgaggatccttcaccaaagcaaaccagagttagaggccacttggagggggagacattaccaacctactctaggtactgcaggttccccatagaccacagagagattgaggttgctctttgcataccagggagggggttcattatgaatgctgagggctatccggggaggattctcaggaaggatctgactaccttggcccaggtgtggagtgttctctcttactccaacctggcccctacatctcatacatcagaccttactgtggatagagccag

SEQ ID NO: 59153 - DNA, 414 bp, Glycine max
  Peptide Sequence Number=SeqID_150838
atgattggcaagtgggtttgtttttacgttgggctggtcctcttgaaacgtcatccatccggcttctatcaaactttggaccttgtgtttaaaggccaggcactattcggtggagtggcccggggttttcccatggtatgcgcaggttgcgtcagggttataccactttgggaaaggaggctggtagatccttccaagagatatcacagtcatctggctggcaacgagggatggcaagaggtcttcgtacgtcattgggatcggggtgaatgttggcctcgggggaaaatttcttatcgcgttggaaccggcgccaaagtgggcattgccggccgggcgagttggggttggagccgtagcttagggggtctccctctggatgggtgcaggcgccctagcttgtatgggtgttga

SEQ ID NO: 59154 - DNA, 192 bp, Glycine max
  Peptide Sequence Number=SeqID_150839
atggattttctccatcgaatcttcgaggaggattctgaggattccgttgcgattaaagtgttcctcttggtgtgggggtccaacgacaagcaacgacggctcacggcggtcaccggtggtcttgggtggtggaaaataaggcttgtcgcgctaagccgaagtccacttcttgcacttagcacaagaatttag

SEQ ID NO: 59155 - DNA, 744 bp, Glycine max
  Peptide Sequence Number=SeqID_150840
atgaatgcagtgaccgaaaccgtcgacctgcaggctgccccgcctgctcccctggtgttcaccgactcggctgccgccaaggtcaaggacctgctggccgaggaaggcaaccccgagctgaagctgcgcgtgttcgtgcagggcggcggctgttcgggtttccagtacggtttcacgttcgacgaagtcgtcaacgaagacgacaccgtgctggacaaggccggcgtgcagctgctggtcgaccccatgagcttccagtacctggtcggcgccgagatcgactacaaggaagacctggaaggcgcccacggcgttgcgccgcgatggcggcgggccacgcccgctcggccacaaaaaaagcccttcggttttccgaggggctttttgtcgtgcgggcggcgcgcgtcaggcgggatacaaggcgcccaggatgcgcgcgccacgcgcaccggtgacgccgggcaggccggcggggcggcgcgccaggaaggcctgggccagccaggcgaacgccagcgcctccacctgttgcgccgggacgcccagcgcgtcggtggcatgcaccgggcgctgcaggcaatacgccaactcacgcatcagtccggggttgcaggcgccgccgccgcagacatagagttcgcgcacgtccgtgccggcgcgtcgatggcgttggcgactgtgcgggccgtcaggcgttgcagggtggcctgcacgtcctgcggcgccggcctgggaccatcgtag

SEQ ID NO: 59156 - DNA, 277 bp, Glycine max
  Peptide Sequence Number=SeqID_150841
cgtcgatttttgtgatgctcgtcagggggacggagcctatggaaaacgccagcaacgcggcctttatacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 59157 - DNA, 1128 bp, Glycine max
  Peptide Sequence Number=SeqID_150842
gtgggcggcaatgccggctccgcgctcgggccgctgctcgccgcgctcgtgatcattccgcacggccagcacagcatcgcgtggttctcggcggccgcgctcgtcgcgatgatcgtgctcacgcagatcggccactggtacaagaagcatccgtcgatgaagaagaaggccgtggcggccggccacccgacgctgtcgcgcggccgcgtgatgggcgcgatcggcgtgctggtgctgctcgtgccgcgcagatccacctgttcgtgttcctcgcggcggtggcggccggcacgctgatcggcgggcccgtcggcgaccggatcggccgcaagtacgtgatctgggtgtcgatcttgggcgtcgcgccgttcacgatgctgctgccgtacgcgaacctgttctggacgagcgtgtctgaccgtgatcatcggcgtcgtgctggcgtcggcgttcgccgcgatcctcgtctatgcgacggagctgatgcccggcaagctcgcggacgcgacgagcatcacgttcgtctacaaggtgtgctcgttcctgccgctgatcggcgtgctgacggtgttcctgccgaacctcgaaagcagccggcgcaagaaggcatgacgaagcggccgcggcgccgccgtcgtcgcatgcagcgtcaggaaccgcttgaggatgccggacgaatagctgctcgcgatcgccgacaggaagtgcgagaacgactgcgtcgcatgatcgtcggccgtatcggaaatcgtgcgcaccagcgcgaacggcacgtcgtgctcggcgcacacctgtgcgattgccgcgccttccatctcgaccgcgagcgcatccggcagcgcctcgcgcagcgtgacgacttcgtgctcgctcgacacgaagcggtcgccgctgatgatcagcccgccatgcagcgtcgcgccggccagaccgaaacgctcggcgaactgctcgccctcttccgcgacgaacagcgtgcacgcggccttcaggcgagccgtgagtgccgcgtcggtcgcgaaccgcgtgatgccgagcagcggcacttcgtagcgcggaaacagcggcgacgcgtcgagatcgtgctgcagcagcatatcggccacgacgacgtcgccgaaccgcacc

SEQ ID NO: 59158 - DNA, 285 bp, Glycine max
  Peptide Sequence Number=SeqID_150843
atggcggcccgggtgatgttggggaatggctacgagcccggaatgggtttaggcaagaacaacggcagcaaaaccagcctggtaagcaccagaggaaaccgcgggaattttgaattaggctataaacccacgcaagcggacataaggaaaagtgtcgtggaaaggaagagcagaggccaaggttcgcaattgggacaacaagtcgaaggagccccaccctgccacatcagtagaacctttataactaagacacgaggctcaagtcgccacgatatgcgaggatga

SEQ ID NO: 59159 - DNA, 210 bp, Glycine max
  Peptide Sequence Number=SeqID_150844
atgaaaaagaagaaaaaaaatatgattttagagaagggtagaagtggaaaggctgtggacaaaggtgtggaagtaccatatcctgtggtaccttccaagaaagaaaaagatcgtcatttggcaagatttttcgatattttcaggaagttggaaataaccatgccctttggcgaagctctacagcagatgccactctactccaatttttga

SEQ ID NO: 59160 - DNA, 375 bp, Glycine max
  Peptide Sequence Number=SeqID_150845
atgaagcttttcttccacactcatgagacaagccaatgcatccccactgaagaaaacactcaagaaattcatttcatggggaatcagcagaggcaagggtatactcaaggaggatttttaggcttccagcaaggtccttataatcagcaaggacagacgactaagttggaagagaccttgactcagtttatgcaagtaacaatgtcaaatcataagagtactgagtcaacactaaagaaccttgaggctgtgatgactaggagtaaaaggtttgtggaagctgaggatgaagagagtgtggtgtacaaggagcaaatgggtgaaaagacaggtgctgaggctaaggaaaatgatgttaagggtaaagagaattag

SEQ ID NO: 59161 - DNA, 546 bp, Glycine max
  Peptide Sequence Number=SeqID_150846
atggcaagagtagcaaaggtagtaaaaatctcggtgcaagagttagaccatgttccatttattgacaccatcgcactattgatatttggagtcgtcctcattccaaatgtggaagggttagtggacctagcagctattgatgctttccttgcttatcaccatagcaaggaaagcccgaccatcattattttggccgatctctatgacatgcctacttgtccattacaaggtcaccgcttatgcgctaaaaagggaaaggcaaattgggagcaactcttggctagtgtggcaggggcatccatcaattggttcccctattggaaggaaggaagagctggagttttgttctcatgcgagggatttccaaatgttcccttaatgggaacaaggggttgtattaattataatcccgccctcgccttaagacagcttggctaccccatgaggggagcgccattagagggaagcatcacacatttcatcgcatggggttttagtgaccccaatgtgagggtacttcgaggagtctgcaaggcatgggatgcg

SEQ ID NO: 59162 - DNA, 435 bp, Glycine max
  Peptide Sequence Number=SeqID_150847
atggtggccttgaaggatcaagtggcttccataatggaagccatgttaagcatgaagagaatgatggaaagcaacacggccgcagttgccaccaccagcaccgccactgaggcgaatcctacccatccctctgccataaaccaagcaaaccaacccgccccgaacatggttggacaaggaggagaaggtcagcaaccccagcctgtaggaggcgcccgtgaagagccacgggagcatgctcaaggggactttgacccatatttcattttcaccgtcgagggactggtgtgggggccaccttcggcagtggaagggagagagatacttgatctcatcgaagagagattaagggttgtcaaagggtttggcgattaccctttcgccgacatgacaaaattatctttagtacctgatgtggcacaagtgggagcatga

SEQ ID NO: 59163 - DNA, 693 bp, Glycine max
  Peptide Sequence Number=SeqID_150848
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccccactgccacacttgtgagcgcgagatttccgccgtggcggcatcttccatcaggttgtggatcggcacgcaaccggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 59164 - DNA, 252 bp, Glycine max
  Peptide Sequence Number=SeqID_150849
atgagaccgagcccatattcctaccaagaagagcttattggagctaacctcataggacgctctgttggcacaaaacaagttgctatccaagcaactagaggcattaacagaaacactcagttgcaggatgtacaatttgtggtggatctcatgaatctagatgttatatccctaatgaagagcaaattgcacatgaagttaattatatggggaatcagcccagaggaaatttcaatacaagtggatttctag

SEQ ID NO: 59165 - DNA, 469 bp, Glycine max
  Peptide Sequence Number=SeqID_150850
atggctaagcgacagctttgtgtgctaagccatcaaagctcgaaaagagacaacacaacggctaagcgagtatggcatccaggaaaaggaaaagcactgctttcaggcctcaagcttaactggaggatccttccagaaaggaatgttaagatttatcatactgagtttgacgagtttaaggcagagttggagaggcgtaacctacacaaacgcctcgccaaccttcaggaggaaagcatagatgtggtggtggttaaagaattctatgccaacttatacagcctggaagaccagagccctaagcaagtgagggtgagaggacacttaattaggattgatgccgacagcctgaataccttcttagagaccccagtagttttggaggagggcgagacactgcctacctattccaaatttacgaagatgaagattgatcctcaagagtttgatgcccgtctctacatccctg

SEQ ID NO: 59166 - DNA, 291 bp, Glycine max
  Peptide Sequence Number=SeqID_150851
atgcaattaaacatcttcatagatggtctacgaacacagtcaaagcaactccttgacgcattcgtagggggaaaaatcaagttgaagacaccgatggaggcaatggagctgatagagaacatggcggctagtgatcgcgccatccttcgtgatcgagcatacacgccaacaaagaggagccttctggaactcacagtccaagatgcaacactgggccaaaacaagctattggcccgacagatagaggccctcacagaaaccctcagcaagctccctcaacaactacaagca

SEQ ID NO: 59167 - DNA, 225 bp, Glycine max
  Peptide Sequence Number=SeqID_150852
atgtcggccttcatctactctggcacctcctcgacgtcacccattactctaactctagcacagattttcaacatggtccatgacatcttggtcaaagtgaaactggaagtaacagggacatcaacagtcctaaatgtgtttggaagtaaacaaagtagcgatgtaactcaattcatcttttgccccaattttttgcaaggtggttacttccatacttcaacttga

SEQ ID NO: 59168 - DNA, 352 bp, Glycine max
  Peptide Sequence Number=SeqID_150853
atggcctactatgaccccttgcaacgtcatgctctagttccaacacctaatgccctattaggtactcaatggaatgtacccggagcaatacctgatatggatgaattattaggtgttgatttacgtcaccagttttctgctgaggctgatcaagttgaagataggagacatcgtggcagaagaaatcttgatagacacgcacaaaaatggaaacaaccatatggttcgagtcaatccatctcattcctcatccttgttgattttggccgacctttcgcacgaattgtacttggagtagggataagtgtcaatgagccatcagaaggaggaattgttgcttcattcccaagag

SEQ ID NO: 59169 - DNA, 768 bp, Glycine max
  Peptide Sequence Number=SeqID_150854
atggggacaaggggttgcatcagctacaatcccgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaggaactcaggggcagtaacaatgggcccattggtggctatcgtaagtggttaaaagcccacgtgcaaggtttggattggctcccaagtttgagaaccgctaaaagggaggaagttgaggcaccggaggaagacgaagaggtgcaggcccttaggacggaactcaagaaagctcaaacagtcaaagaaaggttcaaatcaacagctcttaaaatccgaaaggagaatgccaaactgagagatataaatatagctaccaccaaggctttggaacaagagaccaagagggctcgtagggaagatcacggccggaacaagttccgaggggctctgtggggtagcaacagcgagcttaaactccgaagagaggaaagggaccaatcacgagtagacagtttgatcttgaaagatgagttgaaggtttgctcaaggtctaagagaacatatgatagacttaatggcctgatgcaatcctaccccgcaagggcattgggtagaagactccaagtagattgggctagagatccaagggaaggccctagggttctcatgagccttagggtagatttcgagcccatggactaa

SEQ ID NO: 59170 - DNA, 395 bp, Glycine max
  Peptide Sequence Number=SeqID_150855
atgggaacaaatcaaaccgacaagaggttctaccaagtcaaggttaaaagcttagataccaccagcatcaaggaattagggcggttgatggaacctctccaaatgcaagctttccgcaagacttacggaaagatcttagagttgaccttagcagagaaaacccatatctttcatcccgggtgtctccccctctttgagcagaattgcaactgtggtcaaggattcaacaagaggtttggaccgcataaaacagactcggaacggcatagcgggcctaccacggaggtacctagaagacaaggcgaggggtatggccaatcaaggagattgggtcccgtttatggatgtgttagctttgctaatttttggggtcgtcctctttccaaacgtggatg

SEQ ID NO: 59171 - DNA, 297 bp, Glycine max
  Peptide Sequence Number=SeqID_150856
atgacgggacttctacctcaaacggtaacacagcctccatcccatataccaatgagaacggcgttgccccagttgacgttcgcactgaagtccggtaaccgtgtaacgcgaatgggagcatctcgtgccaatccttgcatgcaagcttggcactggccgtcgttttacaacgtcgtgactgggaaaaccctggcgttacccaacttaatcgccttgcagcacatccccctttcgccagctggcgtaatagcgaagaggcccggaccgaatcgcctttccaacagttgcgcaggctga

SEQ ID NO: 59172 - DNA, 402 bp, Glycine max
  Peptide Sequence Number=SeqID_150857
atggctcacaaattttgctttgaagcacttgatcaaagcttaagagacattgttagaaaaaaaccaaactcccatcaaatttttggaggtaaagttatcgtatttggtggagatttttgccaaatactgccagtcattccaagagggaactgctcagacattataaatgcaacaatcaattcatcgtatctatggcattcatgtgaaatattaaccttaacaaaaaacatgcatttacaaagcaatgtagaatcaattgatcaacaagaaactgccgcatttgctaaatggattctagacattggagatggaattattggtgatcaaaatgatggttgtgctaaagttcaaatcccttcccagctgctcataactgaatacgatgatccaatcaatgctata

SEQ ID NO: 59173 - DNA, 351 bp, Glycine max
  Peptide Sequence Number=SeqID_150858
atgcggtgtgaaataccgcacaagatgcgtaaggagaaaataccgcatcaggcgccattcgccattcaggctgcgcaactgttgggaagggcgatcggtacgggcctcttcgctattacgccagctggcgaaagggggatgtgctgcaaggcgattaagttgggtaacgccagggttttcccagtcacgacgttagggtacatctacttgggtttgactgagaacaagagagagtacatctcttgtggatcaattctagtggagggtacatccactaggttgttcaaagagaacaagggagggtacatcccttgtggatctttgcttgtaaaaggatttttacaaggttga

SEQ ID NO: 59174 - DNA, 273 bp, Glycine max
  Peptide Sequence Number=SeqID_150859
atgtcctctcccctcggtggggatttcctcttcagcgaaggtgaggtagttgttggctgtgatgttattgatgattcccctaaagctctctacggagatgtcttgggctatgtgagcttcattcaagacttttaccagcaaagctcgatgaggctcagagctcatgagcagttccaaaagggagactctaactggggttttgttgagttgttcaatgactttgaactcgctttgttggataatgcagaggaactccccggcctccttgagtga

SEQ ID NO: 59175 - DNA, 501 bp, Glycine max
  Peptide Sequence Number=SeqID_150860
atggcctcctatggtggtgagcttcttctagactcatcttctcctcgaagtgacgtctcctctctctcttccttctccattccgctgccattcatcttcccagaagcaaaggaattcattaatgaagaagatcctaagcctacaagttccaatggagcttacatcacttcacaccagaaccacattctgcgcgcctcttcttcgctaagcctagaggtgcaagcggtgcacttagcgagtttgactctcgctcagcgcacctgtacaggtcatcttcttccagtttcttctatgcgctcagccaatcatgcttcgcctagtggatcatgcgctcagccagaggaggatgactcagcgaactgcaaaaatcaaacttcaccaaacttgcttattttacctgaaattgaaatggaaatgttattaaatacacaaaagtgggatactaagtacttattacctaaatttacaaaaagttcttacaatactacaaaagaactgtaa

SEQ ID NO: 59176 - DNA, 243 bp, Glycine max
  Peptide Sequence Number=SeqID_150861
atggtagccataaacccaaccaaggttcctcaacctccatttttccaaggatacaactcgaatgcaacgtgtgcttgtgatggagaagccccggggcattccattgagtactgtatgacctcgaagcgtaaggtgcaaagtctaattaatgtggcctggctgaaatttgaggagaatcacttgttgaatcctaacactgaaaagcgacaccacacatggggcaattttgaaagctgttgttag

SEQ ID NO: 59177 - DNA, 243 bp, Glycine max
  Peptide Sequence Number=SeqID_150862
atgacacaacctccaccccgtgagaggactctaagggaaatggctgcacctgatttcacctacgaaatcttgtgcatccaataccctgatgaggatgtcccatatgttcttaaaactggactgatccatttgcttccaaagtttcatggccttgcaggactcagtaacatggagaaaagtatgatagatgctgccagtggtggagcccttggagacatgaccctgctgaagccaaaaatttaa

SEQ ID NO: 59178 - DNA, 461 bp, Glycine max
  Peptide Sequence Number=SeqID_150863
aggactacaagtcctcaccatcagagggctgcacgccctcacctctagaggactacatgtcctcgccttgagagggctacacgccctcaccttgggtactacttaccctcaccgtcagaggctacaacgtctcgccttgagaggactacacgtcctcaccatcagagggctgcacgccctcacctctagaggactatgtcctcgccttgagagggctacacgccctcaccttggaggactacacgtcctcgccttcaaagggtcatgtgccttcacctttgtagggctacacgccctcaccttcagaggactacacgtcctcaccatcagagggctgcacgcccttacctccagaggactacatgtcctcgccttgagagggctacacgccctcacctcttgggtactagttaccctcaccgttgagcggactacacgtccacgccttgagaggactacac

SEQ ID NO: 59179 - DNA, 137 bp, Glycine max
  Peptide Sequence Number=SeqID_150864
gtaaattgtataataaactccccttacctatcgtgagctaccccgcggattcctcgtcgcgtcacttgaagattccttttcatccttactcatcgattcccataagcctctaccatgccaaaacgaaggagacttag

SEQ ID NO: 59180 - DNA, 540 bp, Glycine max
  Peptide Sequence Number=SeqID_150865
atggaatgtagacattgcaatgcaaaaatgtggtatgatgaaagaatttcaaaagatagaaatacaacaggtccaaaattcagcttatgttgtggagatgggaaagttgagcttccgttattacaaagtccactgaaatatcttgaacgacttctgtttgatggtaaagcaagtgatagtaaaaattatcagtgtaacatacagacatacaacatgatgtttgcctttacgtctgctggtattaagctacacaaatcaattaatgaaagtagaggacctcctacaattagaattcagggtcaaccatgccatcgaataggcagcttgttaccaatgcctggaaagcaaccaaaattttcacaattgtatatctttgatatgcataatgaagttgaaaatagaattaatgcaatgagtcaacatgttgaaattcaaccagagattgtttcaactttaagtcaaatgttggatgagtacaatgtccatgcaaaaagttttagaatggccagggacagattggcagatagtcaagtcgataat

SEQ ID NO: 59181 - DNA, 342 bp, Glycine max
  Peptide Sequence Number=SeqID_150866
atgactagtatatatgtgaggggtagagggtgtcacacttccaacaggccgcctcaacaagggcctaacatttttcagaggacaaccaagctagaggagactcagactcaattcatgaaggtgacaatgtcaaatcacaaaagcactgagtcagcattgaagaaccttgagatccaggtgggccaactagccaaacaattagctgaaaagtcatccaatagctttggggcgaacacagaaaagaatccaaaagaggaatgtattgctgtgatgataagaaacaagaagagtttggtagttgaggatgaggatagggtggctttggagaaacaaatgttgtaa

SEQ ID NO: 59182 - DNA, 855 bp, Glycine max
  Peptide Sequence Number=SeqID_150867
cgcccggaagagatcgccggtgccgcctccgcgctgctggccgatgccagaccattcccgcgtccggactatacttttgccgatatcgttggcaccggcggtgatggcagcaacagcattaatatttccacggccagcgcctttgtcgccgccacctgcggactgaaagtggccaagcacggcaaccgcagcgtctccagcaaatccggctcttccgatctgctggccgctttcggtatcaatctcgacatgccggcacagcaggcacggcaggcgctggacgatctcaacgtctgcttcctgtttgcgccgcagtatcacagcggtttccgccacgcgatgccggtacgccagcagctgaaaacccgcacgctgtttaacgtgctgggtccgctgatcaacccggcacgcccaccgctggcggtgattggcgtctacagtccggaactggtgctgcctgtcgcccagacgctgaaagtgctgggctaccagcgtgctgccgtggtgcacggtggcggcatggatgaagtggcgctgcacagtgcgacccaggtcgctgagctgcgtgacggcgagatcaccagttaccagctgacgccggaagactttggcttcagcttccagccgaaagaggcgctggccggcggcacaccggaagaaaaccgtgacattctgacgcgtttgctccagggtaaaggccagcccgcccacgagcaggccgttgcggtaaatgtcgcaatgttgctgaaagtattcggaaatgaagatttgcgcgataacgctgagcgcgccatggctgccattcgcagcggtcaggcgtacgagcgcgttgtggcactggcagcgagaggatga

SEQ ID NO: 59183 - DNA, 303 bp, Glycine max
  Peptide Sequence Number=SeqID_150868
atgaataaaggaaagagtgatcttagtcacttactcagtgggcaaaagcatactaccgataagattggtttggggtataacaagcaaattaagttttataagaaaaccaagtttgcatcctccaaaaaggtgaacccaaacaaagtctccaaaaagaaaaacatagtgcatcctaagtctaaagcaaagacttgtcattattgcatgaaaatagggcacacatcctataaataccatgttaggagatttgatgttcctagaggtgtgcctaaaagcaagagactcactatgatatttggatag

SEQ ID NO: 59184 - DNA, 429 bp, Glycine max
  Peptide Sequence Number=SeqID_150869
gaaggcaaggagggagttcttttctcgtgtggggactaccctaatgtttcgttgatagggaagaggggttgtattaactataatcccgcacttgccataagacagctagggtaccccatgatgggagcgccaacagaagaaagtctctcgcctttccttgtgagggatttaggcgcgcaaagtctcaaggtgatacaaagagtccacaaggcgtggagaagtccgttgaggaaagacaaggagcttagaggcatccgtaatggcgtcatcggtggttatcatggatggctaagagttcacacgcgagggttggattggctctctaaattgaaagttatcgatgaggagaacttcgaagctccggaggaagatgaggaaggagtgcagcgagttacgagaggaaaacgcggccactgcaagagcccttga

SEQ ID NO: 59185 - DNA, 774 bp, Glycine max
  Peptide Sequence Number=SeqID_150870
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcacacatcctagacctcactcccattggagagaaaaggaaagaaagcctcaagaggctaacattaacctcctatacttccataggaaggacaatgtagaggctaacttagattgggaaataagggtagagcaacaacttaaaaggaagtctacttcaaaatcttatggctatcactcttatccaaagaaagaccaaggtcaaggcatcttaggggtgacaccttctaagcccaaagatgataaggggaagacaatagaaaatcaaccccttaaggctagtatgcaagagaagactacctccataaagtgctttaaatgtcttggaagagggcacattacttctcaatgccccaccaagaaaaccatgattatgaggggccaagacatttatagtagccaagatgaggctactacttcaccttcctctagtgaaagtgaagaagcaaaaggggaagaatctaataaagagatctacccccaagaagagggacaacctttaatggttaaggaggactgtaaggagacacttgttagcattgccacacctcttaggcttgagtttattcctcaagtaaaggagttgttggatgagggtttggttcgcaagagctga

SEQ ID NO: 59186 - DNA, 320 bp, Glycine max
  Peptide Sequence Number=SeqID_150871
ggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaacggctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 59187 - DNA, 1290 bp, Glycine max
  Peptide Sequence Number=SeqID_150872
atgttatttaaaacccatggggtaaggcataatgttccgtacacgacatacagtcgtactagatcaacttcaacatgtatcttattgaaccggattcagtccaattctagtaagacattaatattcccgcaccctaagttactaattccgtctttggagtatagagaacctgtatcggtccaggatacagccctcctcagccatagtgtgatgtctctcttagtaagctatgtttatcctgtcttattagggtacgcgaaagctaatatcatattctattttaaaaatagagaagtaggtgatatcgctaaaccactaaataaacagtctattcccttaacgtttgatgatggtagtcctatttctaagtcagagatatatgctagtgtgtttagtagtatatttaaattaattgatatttatgacggttttggggttgttagaatagctattcgagcacattttgaagaaaatatccccggccctcttcaacctttaaaagaggagttgctagaggaggctctctctgaatgcattaagccatcttctggagaaatcgatattagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaataggtctgctaaaacaatctactttcataatttaggtcgattcgatagcattttcctacttaagcatcttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacatagttaaataa

SEQ ID NO: 59188 - DNA, 177 bp, Glycine max
  Peptide Sequence Number=SeqID_150873
atggagaattgggtaacagcgctatgcaataacttcgcgaggctccagactcgcaataacattcatggggctccgaaaaaaagtggagaatggagaattggcgaacagcactacgcaataacttcgcggggctccagactcgtaggtggaggatgcatgaacagcgctaggcaataa

SEQ ID NO: 59189 - DNA, 246 bp, Glycine max
  Peptide Sequence Number=SeqID_150874
atgaattttgcaacgagaaaacctgtagaattcaccccagttccagtgtcctatgctgacttgctcccatatctacttgataattcaatggtagccataaccccaaccaaggttcatcaaccttcatttctccgagaatacgactcgaacgcaacgtgtgcttgtcacggagaagcctcggggcgtcccattgagcattgtagggctctgaagcgtaaggtgcgaggtctaattgatgctggctga

SEQ ID NO: 59190 - DNA, 237 bp, Glycine max
  Peptide Sequence Number=SeqID_150875
atgagggaggagcttgccacccagctcgcccaggcgtgcgagaacttcacgtattgtgcaacaatgggtgccaagtacctcgaagcgcgctacacaatcaattcatggggctccgaactcgatggtggaggacgcatgaacagcgctaggcaatcaattcatggggctccggactcgatggtggaggatgcacgaacagcgctaggcaatcaattcgtggggctccggactcgatga

SEQ ID NO: 59191 - DNA, 499 bp, Glycine max
  Peptide Sequence Number=SeqID_150876
cgcccaatacgcaaaccgcctctccccgcgcgttggccgattcagtaatgcagctggcacgacaggtttcccgactggaaagcgggcagtgagcgcaacgcaagtaatgaatagaagggagaggagagagagaaccaaagcgagacagagagagggtacatgtctgagtatcgccggaaataggaaaggatatcaacaaagctacatgcgagagaattggagagaccataaggatgtaacgtctttctacttcacttggttccctgatgatgcaactgaagaagatttatggggtggaggacaaacgccaattagagaggaagttggactcgtcttcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59192 - DNA, 526 bp, Glycine max
  Peptide Sequence Number=SeqID_150877
gtactgtcgcaacgtgcccttttgcgggcgagcgagggcgaggctcatgggtgcgctttccaaaggaggaaagatgcacggagtcgccaccaacgtttatttgtggaaaacgtcggaaaaaccgaagaaaaccggtcaaaaatgaaaattctaagtttgggagttgtatttacgtttgaggaaggtgatcattttaaggcgttggaccttaaaaatgatccattttacttgcaaaataggggagaagcttgccgcccagctcgcccaggcgagccaggttgcttcctccagaagaaacagccttctggaggaatcttctggaaggcccaactttcgaagaagttacggaaacttacggattgcgcaaaaacgcctcttttcgacttccgccacattacggaatttcacggatcgcgcaagcctgcttcctttagatttctgagacgtctcgggacttcatttattgtgcaacaaaggacgccaagtatctccgaaagcggcttaaccaaagattgcctgtcatcaa

SEQ ID NO: 59193 - DNA, 564 bp, Glycine max
  Peptide Sequence Number=SeqID_150878
atgaattgcgttttcgttcatgcaacctccatccacgagtttggagccatgcgtaataattgctttgtgcaattctccatcctcgccttttttcggagccccatgaatttattgcctagcgctgttcatgtgtcctccaccttcgagtctggagccccgcaaagttattgcatagcgctgttcgccaattctccattctccacttttattcagagacccatcaattcattgcctagcgttgttcatgtgtcctccaccttcgagtctggagccccgcgaagttattgcgtagcgctgttcgccaattctccattctccatttttattcggagacccatgaattcattgcctagcactgttcatgtgtcctccaccttcgagtctggagccccgcgaagttattgcgtagcgctgttcgccaattctccattctccatttttattcggagacccatgaattcattgcctagcgctgttcatatgtcctccaccttcgagtctggagccccgcgaacgctgttcatgtgtcctccaccttcgagtctggagccggggatcctctag

SEQ ID NO: 59194 - DNA, 96 bp, Glycine max
  Peptide Sequence Number=SeqID_150879
gcttgtagtgagcttcagaacaaggaaagggaaacaaggctcaaaagggctatcaaaggaatatcgaaatttttcaagagcaaaaactatggctag

SEQ ID NO: 59195 - DNA, 695 bp, Glycine max
  Peptide Sequence Number=SeqID_150880
gattgtacgtcctcgccttcggagggctacacgtcctcgtcttcaaaaggctgcacgccctcgcctccagagggctatacgtccttgccttcagagggctacacgtcctcgcctccagaggactgtacgtcctttgccttcagagggctacacgtcctcgccttcatagggcagtacatccttgccttcagagggctacacgtcctcacctccagagggctgtatgtcctcgccttcagagggctgcatgtcctcgccttcagagggttgcacgtcctcaccttcagagggctgcacgtcctcgcctccagaaggttgtacgtcctctgccttcagagggctacacgtcctcaccttcagagggctgtacgtcctcgccttcggagggctacacgtcctcgccttcagagggatgcatgtccttgccttcagagggctgcatgtcctcgcctccagagggcttcacatcctctcctttagagggctgtacgtgctcatcttcggagggctacacatcctcacctttagagggctgcacgtactcgccttcagagggctgcatgtcctcgccttcagagggttgtccgtcctcgccttcagagggctgcacatccttacctttagagggttgcacgtcctcgcctttagagggctgtacattctcgccttcagagggctacacgttctggccttag

SEQ ID NO: 59196 - DNA, 147 bp, Glycine max
  Peptide Sequence Number=SeqID_150881
atgggtaccgagctcgaattcgtaatcatgctcactgaccgctttccagtcgggaaacctgtcgtgccagctgcattaatgaatcggccaacgcgcggggagaggcggttcgcgtattgggcgctcttccgcttcctcgctcactga

SEQ ID NO: 59197 - DNA, 57 bp, Glycine max
  Peptide Sequence Number=SeqID_150882
atgtggttgatacctgtgatgatcacgaaccttgttcatgggagcagaatgacagtg

SEQ ID NO: 59198 - DNA, 48 bp, Glycine max
  Peptide Sequence Number=SeqID_150883
atggcggtgcgtctgttgcccactgccggccatccccaggctactgtg

SEQ ID NO: 59199 - DNA, 351 bp, Glycine max
  Peptide Sequence Number=SeqID_150884
atggtaaattcactactgcccaagtctctcaaaaacttaagcagcttggtttgtatcttcctctgcccaaggatggtaaattcactactgcccaaggggtgcttctccttaactaacacagcaatcggcattgatgtccctgcaaggactatgcagatgctaaagaaaatgaaaaagcaacccctcttgtttgtggaactccttttctggaagactcggatggaatgccattacatcaatgctgaatatttgttgagcgagcttggtcatttgaagaaagaaagtgccaattggaataacactcagggagatgaagaaattggttcatccccagcaaaggtgtggacatag

SEQ ID NO: 59200 - DNA, 177 bp, Glycine max
  Peptide Sequence Number=SeqID_150885
atggtttctagagatatcatcctctttgataacaacattgtggcaatagggacccaacatcaaaagaggaaaactctagatgaggcttcactgttatcaagcgagtcggagacccaacatggccatagatcaacctccacttcctatgtctcacacagactcgggtataaggcctaa

SEQ ID NO: 59201 - DNA, 1044 bp, Glycine max
  Peptide Sequence Number=SeqID_150886
atgggatcaagtcaaaagccttcacttaaaaagaggttctatcaagtcaaggtcaagagcctaggaatcaccagcctaaaagagctagggcaattgatgggtcagctccagtggcaagcttttcgcaaagcttacggtaaaatttgggacctagccatggtagaagtctccacagagtccattgcctccctcgcccagtattatgatcagtcgttgaggtgctttacttttggggacttccagctatcacccatggaagtagaccgccaaaagcaagtcgaaaatggggtggtcgggataccgagaaaatgtttggatgcaaaagcaagaatcttggcaggtagaagcgaatgggccccgttcatagacgttctcgcactgttgatctttggaggagtcctctttccgaatgtggatgggttggtggacctggcagtgatcgatgcttttctcgcctatcataaccacaaggaaagctcggttgttgctatgctagccgacctatatgaaaccttcgaccgaagatgtgagaagagcagtacgaggattgtctactgtacttccgctctttatgtatggttggtttcacacttttttcgccaagaggtaaggcatgcttgcccgttagaaggtcaccattcatgcacagagaaaggaggcgcaaattgggaccaactcttatcaaacaaagaaggagcgtctgtcaactggttacctcgatggaaagaaggaagaaccagagttcttgtctcatgcggaggatttccgaatgttcccttgatggggacaaggggttgcatcagttacaatcatgttcttactataagacaacttggctaccctatgagagggccaccactagaggaagagctcgcagctgtcatttcacgagggttcaatgagaccaacgtggagatccttcagaaggtccgcaaagcatgggaagtggtacaaaagaaggacaaagagctcagaggcagcaacaatgggcccattggtggctaccgtaagtggttgaaagcccacgtgcaaggtttggattga

SEQ ID NO: 59202 - DNA, 498 bp, Glycine max
  Peptide Sequence Number=SeqID_150887
atgacggtgaaaacctctgacacatgcagctcccgggacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagagacaaagtgggtcgtgctagatttacatggtagtgaacattatcttttgcttcccacttttgaatacacatcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 59203 - DNA, 777 bp, Glycine max
  Peptide Sequence Number=SeqID_150888
atggaagtcgttgtatcactcacccaatactatgaccagcctttgagatgcttcacgtttggagacttccaattagtaccgactgttgaagaatttaaggagattctaggatgtcctcttgggggaagaaaaccgtatcttttcttcgggtttcttccctccttgagcaagattgctattgtggtcagggattcagcaagagagttggatcgtgaaaagcaaactcaaaacagtgtagtgggcctacctcggaagtacttagaaggcaaggcaagggatatggcgaatcaagaggagtgggtcccgtttatggacgtattagcattgctaatctttggggttgtcctctttccaaacgtggatggtttggtggacctagccgcgattgatgctttccttgcatatcaccatagcaaagagagcccagtggtagctatcttggcggacttatttgatacatttgaccgaaggtgcgagaagagtagcgcacagatcatctgctgcttacccgctctttgtgtatggttggtttcgcacctattccatcaagacataagacacccatgtccgctccgaagccatcgcttgtgtgtcgaaaagagaagagtagattgggaccaacacttggctgggataggaggcagaacaatcaactggtttcctcgatggaaggaaggaaaggagggagttctcttctcatgtggggactacccaaacatcccattgatagggacgaggggttgcattaactacaatcccgcacttgctataagatag

SEQ ID NO: 59204 - DNA, 480 bp, Glycine max
  Peptide Sequence Number=SeqID_150889
gagcaggctacacagggatccttcatccccaatggacgtcaggatgttctcaccgctgctattggacgtcgagagcatcttggaagtgttcgtgctgttggagccgacgtcccgcaactcttcctccctgcctcccgaagaattgcaacagctgacccagcaaatcaaggaccagctagaggagtccatcacagaaaaattgatgcggcagctcatggcatcattcagccagatgcagtcccagatgcaatcttagggacttgcactgcctcccgagcctctggaaacgatcatgagacgggtgactcagataggtgcagcttgtacatcgaagaagatcctgcccgcctggttgccctggggagagtttatgagggatccactattgttcataacactcttttgttgcctgaccaagtaaaggtgggtgtggaggaggttacagatgcagatgctccaattcctgtacccattgatgag

SEQ ID NO: 59205 - DNA, 321 bp, Glycine max
  Peptide Sequence Number=SeqID_150890
atgaaatgctttcatcaagaagtactgcgtccccaggcaggcgcagggcgaaacaccacaacagcctggggatggccggcagcgggcaacggacgcaccgccatcacctctagagttcacctcagctcatccacaaaaagtcatagcaggacacacctagttgttcatgatcctaggaatttaaataaaacaagcacaagcttggaaggacatcccctttatccccgaaccgctggccaaaccctgacatatatcatgaccaaccgttctacaagccttgagccaaaatcccaacttatcataaaccttgacccagggtga

SEQ ID NO: 59206 - DNA, 216 bp, Glycine max
  misc_feature (30)..(30): n is a, c, g, or t
  Peptide Sequence Number=SeqID_150891
atggtccctggtaatcgattaccaaggggntgtaatcgattaccaggcttagaaacgaaggcagcaggttttcatgtcctgaagctgtgtgattcgagtttggcctctggtaatcgattaccaaggctgtgtaatcgattaccagggatgaaaagccttgagataccccttttacttgcatgtagtggtcatgagacgtattgtgttgcggcgtag

SEQ ID NO: 59207 - DNA, 738 bp, Glycine max
  Peptide Sequence Number=SeqID_150892
atggacctcatcacggttgctggactgctgaagactgtcaccaagttgggagattgctatgagagtctagtcagggaattcattgtcaacattccctctgacataacaaacagaaagagtgaagagtatcaaagagtgtttgtcagaggaaaatgtgttagattctcccctgctgtgatcaacaaatacctgggcagaccaacagatggagtggtggatattactgtctctgagcaccaaattgccaaggaaatcactgccaaacaagtccagcattggccaaagaaagggaagctgtctgcagggaagctcagtgtgaaatatgcaatcctgcacaggattggagctgcaaactgggtacccaccaatcatacttccactgttgccacagagaatctcctctatccctgcattacaaattgtttgaggggacacatgtcccagacattgtctcgacaagctgctgcctcaggtgctgtgtccaaggatgctctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaagaagctgctgaggaagaggaagatgcagcatcagatgatgattctgaagccaccccatga

SEQ ID NO: 59208 - DNA, 231 bp, Glycine max
  Peptide Sequence Number=SeqID_150893
atggagatcgattttgacaagattcagtcagtaccaacaaggaaagaaggacagattagctctaaaaccttaacttgcttgaatcttcggagatctgagtatcggcaactccctcaacagcttcactcgcttaaaggactacagcataaagtccttgcattgctctttttccctagtttcttacttccccttagtgtaggtcgtgttggacttgatatacctcgaccctag

SEQ ID NO: 59209 - DNA, 609 bp, Glycine max
  Peptide Sequence Number=SeqID_150894
atggtgcaaaagaaggacaaagaactcaggggcagtaacaatgggcccattggtggctaccgtaagtggttgaaagcccacatgcaaggtttggattggctcccgagtttgagaaccgctaaaagggaggaagttgaggcaccggaggaagacgaagaggtgcaggcccttagggcagaactcgagcaggcccaaacagtcaaagaaaggttcaaatcagtagctcttaagatccgaaaggagaatgctgaactaagagatataaatatagctaccaccaaggccttggaacaagagaccaagagggctcgtagggaagagcacggccgaaacaagttccgaggggctctgtggggcagtaatagcgagcttatgctccggagagaggaaagggaccaatcacaagtagacagtctgatcttgaaagatgagttgatggttttctcaaggtccaaaagaaacttgtctcagcggttatgcgagacagagaccaacatgttagccatcatcaacaagtaccaagaagaactaaatctagccatgacccacgagcatagagtggtggacgagtatgcccaagtgtacgcggaaaaggaggctagagggagg

SEQ ID NO: 59210 - DNA, 174 bp, Glycine max
  Peptide Sequence Number=SeqID_150895
atgaaaacaaaagggatgcagtgccccatgtgtgcagttaagaaggtgatatggaccttccggcttcccgtgacaaaagacgagatcaacatacaacgtatgtgtgacgacatgatgcagatgcgcaaaagcgcaacagggggatgtacacaagatggcaatatcctcaaataa

SEQ ID NO: 59211 - DNA, 579 bp, Glycine max
  misc_feature (19)..(19): n is a, c, g, or t
  Peptide Sequence Number=SeqID_150896
atggccacaatgatggagnccatgatgagcgtgaagaagataatggaagccaatgcggttgcaattgccgctacccgcgttgttgctaaggtgaacctgatgtccccatccggcatcaaccaaatgaatcatccaacctcagatatggtaggcaaagatttgggaagtacgggcagcccccataatgtacaaattcaaaacgagcacgccttcctgccatatggcttgcctctcaactatacgccacccaaagtggcgtacactcccaataagaatgtcaataactccactcctatacccattgagagccaacaacctcaatctgatcatgcacatgtctctcgacccatggaggagacacatgaaattccccaccatgatctagccaacttcgagccttgcctcggatatgctgctgaagggcaagcagttggtggtatacccctacaaaaccctttggagggccctcagtatcacccacaactgcacctcttgcattccacagcggttaaaaacccttatgactatggcaggaatgggaaagttggatcatctagaggaaaggctcagggccattga

SEQ ID NO: 59212 - DNA, 52 bp, Glycine max
  Peptide Sequence Number=SeqID_150897
atggacaacccttcccttgtgttcaagaatcctttacaacaagagaccctag

SEQ ID NO: 59213 - DNA, 168 bp, Glycine max
  Peptide Sequence Number=SeqID_150898
atgggtgccaagcacctcacgaggaccaaagaatggtcgcacgtcatcgagcaaaggtccccggacgaaattaggggtgcggataaccgtaagggtgcggataaccgtaagggtgcggataaccgtaaggtatctccgcgtgtcatcgggcccgccgcctctggatga

SEQ ID NO: 59214 - DNA, 81 bp, Glycine max
  Peptide Sequence Number=SeqID_150899
atggatgtttgtgataacctgagccctttcgctcagttcatggggtgccccaagcggttaattaagactggacctaactag

SEQ ID NO: 59215 - DNA, 480 bp, Glycine max
  Peptide Sequence Number=SeqID_150900
atggcaaagtttgatatcgcagaagctacgaaggtgaagacgaaggttatgtcaacagtagcgacgagatggcggcaatttaagtccacattgactagcaaatttgtgtttgctaagactgaaggtcaacaaacacaggatgttgtgacaaaatatggactagatcctgaagcgtggaaacaatttgaagaaacccgcctgacacctaactgggagaaattgttagaccagaaacgaaaaaggatacaagaggaagcattgttgagtgaaaatccagcaagtgttgatgaaccctcatccccaataaaaaggcatgttaagtggaaggttgctcggaccagggctgttggcaatatgacatctgactccgcacaggaaattgcagataaaatagactccttagaagagcaggtaacgcagggttcgtttgtaccccatggtcggcaagacatactgaacactgccacttggccgacctga

SEQ ID NO: 59216 - DNA, 306 bp, Glycine max
  Peptide Sequence Number=SeqID_150901
atgggctccatattacccgaattatgtggtgttggactacaatggaaagacccgcactatataagagttagaaaatttggtaaccgagtctacattgctgatggtctcaaacacttcaggagggatatgggaatatatgaaggtgtgatgatcacatttgcagcgccggacatcaattggaagtttgatatccacttatcaccgccactacatgcacagacatgtgacaggcctgtccattctgccagagaatatgtgtttactgtggatgtcgacaatcggatgattgctagactttatccattg

SEQ ID NO: 59217 - DNA, 414 bp, Glycine max
  Peptide Sequence Number=SeqID_150902
atgtccttaaaattgccttactatcctgaactagttagagtcttttacagtaatttaaaaattcaggatggtgtgattcgttctaaggtgcatggaatttctatgatcattgatcaatctttgttcttttcattaactaaattacccagtcaaggtgcaccttttgagggcaccattgttgatgaatggaagtttgactattctagtcatgatgctcgccgtatgagatcctttgctataggtgctggtgcagtaacttcatttggttaccagttatggggcctccgcacctatgttggtgaacgattcgattccttggatggtcgctttgaaggcatggatacccgcatcacccaacttgaagaggatatgacttatcttcatcggtgctttgaccttccaccaccttcttag

SEQ ID NO: 59218 - DNA, 528 bp, Glycine max
  Peptide Sequence Number=SeqID_150903
atgaccacggcgccccgtgcgcccggcctcctcgtcctcgcgacaaacacaaaccccggcgcttcgtgcgccaaggaactcaaatctgttaagtgcgactcccgggggcccggagacgaatcccgtgaacatcgagtcttgaacgcaagtgcgcccgaagccattaggccgagggcacgcctgcctgggtgtcacacatcgtttccccaacgcaaacatgtaacaatgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcaggtcaggcggggctacccgctgagtttaagcatatcaataagcggaggaaaagaaactaacaaggattcccttagtaacggcgagcgaaccgggaaaagcccaccatga

SEQ ID NO: 59219 - DNA, 300 bp, Glycine max
  Peptide Sequence Number=SeqID_150904
atgtcacgatggcatgaccttgctgggggggacaggcaccctgtaggattgacagaggcccatgaccagagccgaaaaccccagggccctattggacttctccggggggagatcagagttgtggtggtgcgcatgatccacactcgtcttcctgtcgcggtctgggcgaaatcttcccccggcatgtatagtagctgcatgatagcctccctctttggttgtgctcgcacagttggccctcctccgggatcagggggtggccaaggaactgataaagggaaactattggcccctcactag

SEQ ID NO: 59220 - DNA, 715 bp, Glycine max
  Peptide Sequence Number=SeqID_150905
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccgtatgactgtagagtatgattattgtatgcatcgtataactgattcccaatcgccaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaacttcggaaaaagagttg

SEQ ID NO: 59221 - DNA, 603 bp, Glycine max
  Peptide Sequence Number=SeqID_150906
atgaattgcattttcgttcatgtgtcctccacccacgagtttggagccatgcgtagtgattgcttagtgcaattctccattctcaatctttttcggagccccatgaattgcgttttcgttcatgggtcctccacccacgagtttggagccttgcgtagtgattgcttagtgcaattctccattctcaatctttttcggagccccatgaattgcgttttcattcatgtgttctccacccacgagttgggagctatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcgggtcgttcgactgcggcgagcgggaaatggcttacgaacggggccggagatttcctggaagatgccaggaagatacttaacagggaagtga

SEQ ID NO: 59222 - DNA, 363 bp, Glycine max
  Peptide Sequence Number=SeqID_150907
atggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttaatcctcaagtaaatgagttgttggatgagggtttggttcgcaagagattaaatccttgtgctttgttggtgcccaaaataggggttcccatgaaccctaagagaataaaggtcattcctgcgtggcctgctccaccaagtgtgttgagggaaaaagcccagagtttcaagaacctcgggatttga

SEQ ID NO: 59223 - DNA, 669 bp, Glycine max
  Peptide Sequence Number=SeqID_150908
atggttaagcttgccccacttgaaaagcctcttttgaatggtgactctaatgtaagcaacaattatgttcccattaaggctagaggaaatgaaaatttaacctggtattcaaatgttggatttttcagcattcttactttctcatggatgattcctttaataactctagggaatgagaagactttagagcatgaggatctcccacatcttgctactgatgacagtgtggatgggattttgccaacttttacaaacaaacttgagtcagagtgtggagtgagcaacgaaggtcgttcaacacaagggtggggtgagcgccacagcgacgatgacgagctgagggtggctatgcgagacttagtgtcggggggacgacggcctgagggtgcctttgcgagagtgagcgtagggggtcagggagaagcaagagtttgggagagactgatgagtgcgagaagagagaaagcttttcagttttggagtcacgatggcagtggcagtggtggtggaggtggtattggtggtggtggcgatgtcaatgatagtgacagtgacgacgtggtgttggtagcaagtgattgcgatggtggtggtggtgacaatgatggaggttatattagtggtggtagtggcggcgacaattgtaacaccccatttttcgtaaaataa

SEQ ID NO: 59224 - DNA, 540 bp, Glycine max
  Peptide Sequence Number=SeqID_150909
atgactggcatcatgcactatataattgttagaattttgcttccccgttcttcaaatttggcacaagcctctgaggaggatttgattctaatgtgggctttccttaccggtcgtcagatcgactgggctcacttggttcggtaccgaatgcataaggcattacgggccaatgcacctctcccttaccctcaattgataactttgtttctgcgtcattttcaaattccgcttgatgatgagccatttgttcaagtcaagtgttcctttgcaattggtgttggtgcagtgacttcctttggataccacgcattccctcctcacgatgagcgtactccttcacctcctcctcagcgagatgatttagcactcatgactgaagttctttccgaattacagggtcttcgttcttatgttggtgaacgtttcgactcactggatacacgttttgccggaatggatatttgcctcacacagcttgaagaggatgtgggttacattcgtcagagtttcgatcttccaccaccacctccaccttcttag

SEQ ID NO: 59225 - DNA, 165 bp, Glycine max
  Peptide Sequence Number=SeqID_150910
atggataagagcttgaaggtaggagaagatgagtggagggagagggagagaaggagtatgcaattttatgcctcaaatgaggtatggttcagcccactaaaacaagatcaagtccaagattctccactaagtgcgcttaggcgtcatgaggcatgtaaagcatga

SEQ ID NO: 59226 - DNA, 486 bp, Glycine max
  Peptide Sequence Number=SeqID_150911
atgacgaccctctttatgggccgacctctttttctcataaaggtggacccttgggtactcagtacctatcttcatcagagggctacacgtcctgccattagaggactacacgtcctcggccttcaggggctacacgccctcaccttcagaggactacacgtccttgccttcagaggattacacgtcctcgccttcagaggactacacgtcctcgccttcagaggattacacgtcctcgccctcagaggattacacgtcctcgccttcagagggccgcacgccctcgccttcagaggactacacgtcttcaactttagaggactacacgtcctcgccgtcaaagggtcatgtaccttcacctttgtagggctacacacccttaccttcagaggactatacgtcctcgcctttagaggactacacatcctcgccatcagaggactacatgtcccccattttcaaagggcgacacgccctcacctttag

SEQ ID NO: 59227 - DNA, 195 bp, Glycine max
  Peptide Sequence Number=SeqID_150912
atgcccttttgcgggcgagcaaaggcgaggctcactggagcactttcaaaaggaggaaaggtgcacggagtcgccaccaacgtttatttgtggaaaacgtcggaaaaaccgaaggaaactggtcaaaatgaaaattctaagttcgggagttgtatttgcgtttgcggaagattaggcgagaaacgacttaaataa

SEQ ID NO: 59228 - DNA, 645 bp, Glycine max
  Peptide Sequence Number=SeqID_150913
atgaatcttcattcttcatctagtgttaatgatgagggttctactcctaaggaccccttaaaaacaagagagaaaagaaaaggaaaaaaaagagtgaaagaaataagtcaagatgaaaaagagaaaataagggaagaagaaagaaggaaaatactaaaagagttaagaaaagaaaaacatgcctcctatagtagtcataactcttgcaagagcctaagtcaagaacttcgtgactattatgaaggaaggcataggtcacatcttagacctcactcctatatgagagaaaatgaaagaaagcctgaagaggctaacattaacctcccatacttccatgggaaggacaatgtagaggcttacttagattggaaaataaggatagagcaaaaacttaaaagaaagtctactttaaaatcttatggatctcactcttatccaaagaaagaccaaggtcaaggcatcttagtggtgacaccttctaagtccaaagatgataagggaaagataatagaaaaacaaccccttaaggctagtatgcaagagaaaactagctctataaagtgctttaaatgtcttggaagaggacacattacttctcaataccccatcacaaaaacccatgattatgaggggcccagacattaa

SEQ ID NO: 59229 - DNA, 340 bp, Glycine max
  Peptide Sequence Number=SeqID_150914
gcccagcccaacagtggagctaagcgcgagtcaggcgctaagcgagcaaccaaatgtagacgctaagcatggcattaagcacgaaggagcagaaaccggcgcgctgagcgcgcgatccgaacgcgctaagcgcgagtcccaagtgtcgcaacgtgcccttcgcgggcgagcgagggcgaggctcacgggtgcgcttcccaaaggaggaaagatgcgcggagtcgccaccaacgaaggtattagcacctcttacgtcgacaaaagcggggcttttgctcctacgtaccctcctttggagaggaaatcagacctacgtagttcttccttatgcgtgaatcaa

SEQ ID NO: 59230 - DNA, 213 bp, Glycine max
  Peptide Sequence Number=SeqID_150915
atggagaaatggctccaaagaaactctccacgaagaggtctagaagagacgccacaggagaagggtccagtgccgccccagagtttgatagtcatcgtttctggagtgccgagcaccagcagcactttgaggcctttaggggatggtcgttccacagggagaggcatgtccagctcagggaggatgagtatatggacttttaggaggagatag

SEQ ID NO: 59231 - DNA, 513 bp, Glycine max
  Peptide Sequence Number=SeqID_150916
atggcggtgtgtctattgcccgctaccggccatcccaatgctgctgtggtgtctcgccctgcgcctgcctggggcgcagtacttcttgatgaaagctcgattagtagggggcctgatgcccttgctggaggtgacaggtactccgtagaactgacagagacccgactgatagaggcccgtaaccagagctggaaaccccagggccctgttggacttttccgggtccactgggtgtctcttgtgggtgcgatccctgcaaacaatagatgggggagattggcgttgcggtcgctgggaagaatgttgctaagtagcaatgtcatctatatctgtgtaagagtggtcatgttggtgcgcatgatccgcactcgtctctttgcagcggcacgggtgaaatcttgcctcagtatgcatagtagcagtgcgatagcctccctctctagttgtgctcgcacagttggccctcctccaatatcagggggtggcccaggaaccgttaaaaggaaactactg

SEQ ID NO: 59232 - DNA, 213 bp, Glycine max
  Peptide Sequence Number=SeqID_150917
atgaagttcatggaatttctagctaaaagtcctttcgctaagcgcaagccttgtgctaagcgcgtctttggtcatgccctaagcctagagtctcaagcgcttagcgatcaacccttgcatctgaggttgatttggtccgctaagctggccaaggctgagctaagccaacttcaattcgatctaaattcggctaagctgcagcctgatcgctaa

SEQ ID NO: 59233 - DNA, 168 bp, Glycine max
  Peptide Sequence Number=SeqID_150918
atgggtgccaagtacctcgaagtggtcaaacgagggtcgcatcccaacaacagatggtccctggacgaaattaggctttgtaaatcagtcttgaaaacaatgctggctactagtaatcgattactaccttctagtaatcgattaccagagagtaaaactctttggtaa

SEQ ID NO: 59234 - DNA, 122 bp, Glycine max
  Peptide Sequence Number=SeqID_150919
gtgttgaggaaagaatccctgagtttcaagaacctatggatttgaggtcaaatccttttcaagggggagggaatgatgcaatccctttccttgttttgaagctcactacaagacttaagtga

SEQ ID NO: 59235 - DNA, 333 bp, Glycine max
  Peptide Sequence Number=SeqID_150920
atggacataaatgtgtcagcattgatcggtaaatctgttcctcacattcctgagaaatgtaaggacccagagtcagaatacactaaccatgttgcaagaagtacatatacttctgaattgctttatgaggtacaggctgaggaaccttcttcttctcctaccctggttcctcccactgttcatccaccacccacaccagagttgaagcccttaccagcaaccctcaagtacgcttacttggaggataagaaaaaattttcagtgatcatctccgcctcccttgatgctgagcaaagggagaagttgttgctagtgctcaagaagcacaagtag

SEQ ID NO: 59236 - DNA, 1082 bp, Glycine max
  Peptide Sequence Number=SeqID_150921
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaacgccagcaacgcggcctttttacggttcctggccttttgctggccttttgctcacatgttctttcctgcgttatcccctgattctgtggataaccgtattaccgcctttga

SEQ ID NO: 59237 - DNA, 200 bp, Glycine max
  Peptide Sequence Number=SeqID_150922
gggaggaagtgaagaagaaaagggttcagctccttaggcacttctctctcttacgaatttgcttggaaaaattgtttccgagaagaaatctaagccgaggtgcttccgaacgtttccgtaacgttttccgtgaggaattcgcaaagttcaatcgtccttcgacgttctcatcgttttcatcgttcttcgatcttcaacgg

SEQ ID NO: 59238 - DNA, 204 bp, Glycine max
  Peptide Sequence Number=SeqID_150923
atggctccgagaaagcttcatgcaaagagatccaggaaggacaaagcggctgaagggaccagtgtcgctcctgagtatgacagccatcgtttccggagtgctgagcaccagcagcgtttcgaggccatcaaaggatggtcatttcatggaagagatagctcgccggcggtggacatcgctggttacccccatggccaagtttga

SEQ ID NO: 59239 - DNA, 300 bp, Glycine max
  Peptide Sequence Number=SeqID_150924
atgtcgcgaaactttacggattacgcaaccatcccctctttgacttctggaatgttacggaactttacgaattgcgcaacaatgcttcctttcgacttccggcatgtcgcggaacttcatggattgcctaacgatgggtgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59240 - DNA, 518 bp, Glycine max
  Peptide Sequence Number=SeqID_150925
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccggtgcgccttatccggtaactatcgtcttgagtccaacccg

SEQ ID NO: 59241 - DNA, 219 bp, Glycine max
  Peptide Sequence Number=SeqID_150926
atgggggttaagtacctcgaggctgtcaagcgaaggttgcatgccaccaaacaatggtccccggacgaaattagggtacctttgacatcaattcgagggcgaattcttcccaagaaggagggtatgataaaggactatctaaggagaaagagtttggcttgggtgggctcaacatggatagaccaatcattagaacacggagtacgagattttccataa

SEQ ID NO: 59242 - DNA, 617 bp, Glycine max
  Peptide Sequence Number=SeqID_150927
atggctgaagagccaagaagagtcaccttggaagattattcaagttctaatgtgccacaatttttcaccagcatttctcaaccagaagttcaagcacaagccattacatatccaccatcattgattaagctgattcaaaataatttgtttcatggtttaccaattgaagacccatatgcacacttagccacctacatagatatatgcaatactattaggttggatgaggttgtggagaaatttctcaagaaatattttcccgagtctaagactgcagaaggcaaagccgccatctcttcttttcaccaatttcccgatgaatctttgagtgaggccttggaaagattctgtgatggaaaaatcaaattgaagacccctgaagaagccattgatctcattgaaaatatggctgcaagtgacattgatattttgagagatagagctcacattcctactaaaaagagtttattggagctaacctcccaagatgcattgttggcacaaaataagttgttgtctaagcaacttgaggcattgactgaaacagatgtaccatctgtgggggagctcatgaatctggatgttgtatccttattgaagaataacccactcatgaa

SEQ ID NO: 59243 - DNA, 135 bp, Glycine max
  Peptide Sequence Number=SeqID_150928
atgatgaactcactaagcgagcatgctgcgctaacgttatctgaagaactcgctaagtgcgcttaccgcgctaagcgagttcatcttttgaggatgaacactcatcctcttgctgaactacctgtggctagctaa

SEQ ID NO: 59244 - DNA, 96 bp, Glycine max
  Peptide Sequence Number=SeqID_150929
atggagaaaactaagaaattgaagttcgaagaatgggtcaatgacaagtcccgtgaatttgctgtccaaattacaaggggaaagtgtacgggttag

SEQ ID NO: 59245 - DNA, 465 bp, Glycine max
  Peptide Sequence Number=SeqID_150930
tcgttcggattccctgtcgcacctagcaaggtgattcggccgcccatcacccgagcttttattgagaagtattgcacgcagagacaggcccagggggatgctccgcaggccgcagatgcgccgccacctcatcaggccggtccagccggatcgtttgatacggagcagtatttgtggcatttggttcgccagcaggcggccaaccaccgggcacatgtacagacccatgattgtctttatcagatgagcctcagcctgcagagccagggctttacttcttttctgtgccctactctggaccagttcagggcagaggtcgcatggcctggagattggcctgaggcccgggcaggagaggcacctgcagaggcaccagcagaggctcccgacgaggcagatgaggcccgcgaggacgaggagatggccgatttacttgatttcttaggaggaagcggggccacatga

SEQ ID NO: 59246 - DNA, 279 bp, Glycine max
  Peptide Sequence Number=SeqID_150931
atgggactccaacctatgttggtgaaaggtttgatgctttggaacaacaagtggacatgtgatttgatgcaatggtctcaaggatcacaaaggattgtcatcatcaaaaagggggagattgtggaagcaatgacttccaaggttattttgatgatgccaaagaatcatgagctaagcaaattccacagattcaagaatcaagtttcaagaatcaagattcaagaattcaagattcaagaattcaagaatcaagtttcaagaatcaagattcaagaataa

SEQ ID NO: 59247 - DNA, 488 bp, Glycine max
  Peptide Sequence Number=SeqID_150932
atgaggctactacttcaccttcctctagtgaaagtgaagaagcaaaaggggggagaatctagtgaagaaatctatatccaagaagaaggacaacctttaatggttaaggaggaatgtaaggaggtaagtgtctcctccaagaggttagctaagaaggaaagacattttgaaataaagacaaatattaaagaaatttcccttcttagacaacctccacattttctcctttgtaaaaatacacttgttagcattgccacatctcttaggcttgagtttattcctcaagtaaaggagttgttggatgagagtttagttcgcaagagattaaatccttgtgctttgttggtgcccaaaataggtattattaggcaccaaatccctaaaataggtggtgtgatgaatgtctcgggtggtgcaacactcttttgtaaaatcactcgtccacccaacatcttcatgatttgtgtacatagggactcattaggtag

SEQ ID NO: 59248 - DNA, 127 bp, Glycine max
  Peptide Sequence Number=SeqID_150933
atgagttatgtccccgaatcggacatccgtgtgaaaagttatgaccattcgatttctcgagagcttccggtgttcatgtcgagcgtctacatgagtgatgtctccgaatcggacatctgtgtgaaag

SEQ ID NO: 59249 - DNA, 462 bp, Glycine max
  Peptide Sequence Number=SeqID_150934
atgagtggaaagggattgcagcatgttcggaaatcactttctcaatatcagcgtcttagagcatgtttggaaatcaaatgggataccaattggaaaagaggggcaagaacactcgaaaggtggcaatgccactcaagaaggcacgacttcggctacgtggcggtggtgggagcagcaggtccacttcggcttcaagtacttcacggcgggaaacaaaacgtcagggtggtagcgggatggagttcacggcgggatgaagtagttcaggcaatagcgggggcgctaggtttttggagggacggtgtacctacaagcaccgtctttgatgacttccatcaaaactacaacgacggggttatagacaaatgtcgttgtacaacaaacgcaccacataaaaacttatataattacgtaaatgccaccgtgttgacaactacgacaggttcttcaacatcgacgtag

SEQ ID NO: 59250 - DNA, 819 bp, Glycine max
  Peptide Sequence Number=SeqID_150935
atggggcaggcggacttcacgcgcagcgatgccgtgatcggatacggcgggggagcggtgaccgacctggcgggtttcgtcgcggcgacgcggctgcgcggggtgcagctggtccaggtccccaccaccgtcctcggtctggtcgacgccgcggtcggcggcaagacgggggtcaacactgcagagggcaagaacctcgtcggcgccttctgggctccgagcgccgtgatcggcgacctcgacgagctcggcagcctcagccccaacgaggcgacggccgggttcgcggaggtcgtcaaggccgggttcatctgggcgcccgagatcctcgacatcatcgaggccgaccccacccgcgccgtcgacacctcgaccgaggagttccggcgggctgtggagctggccatcgacatgaaggcgaaggtcgtgtcggacgacttccgcgaggccggtcttcgcgagatcctcaactacggccacacgctcggccacgcgatcgagcacgcggagcgttaccggtggcgccacggcgccgcgatctccgtcggcatgctctacgccgccgagctctcgcgcctggccgggaggctctcggacgccgctgctgaacggcaccgcacgatcctggagtcgctgggccttcccacctcgtaccgggcgggtgcctggccacagctgctggcgaccatgcagcgcgacaagaagagccgcggcggcatgctgcgcttcatcctgctcgacgacatcgccaagcccaccgtgctgcaggccccggacgagtcgctgctgttcgcggcctaccaggaggtgggcgaatga

SEQ ID NO: 59251 - DNA, 1344 bp, Glycine max
  Peptide Sequence Number=SeqID_150936
atggggacaaatcaaaacggaaaaagattctatcaagtcaagattaagggtctagatgtcaccagccttaaggagttgggacggttgatggaacccctccaaaggcaagccttccgcaaagtgtacgaaaagattttagatttgaccacagcgaaggtatttacggaagccattgtatccctcgcccaatactatgaccagccattgagatgcttcacgttaggggacttccaaatagtaccgactgttgaagaatttgaggagattttaggatgccctcttgtgggaaaaaaactgtatcttttctccgggtttcttccctccttgagcaagattgtagctatgatcagagattcagcgagagagttggattgtatgaagcaaactcgaaacgacgtagtgggcctaccgcggaaatacttggaaggcaaggcaagggatatggcgagtcaagaagagtgggtcctgtttgcggatatactagctttgctgatctttggggttgtcctctttcctaacatggacggtttggtggacctaaccgcaattgatgctttccttgcatatcaccatagcaaggagagcccggtggtagttatcttggcggacttatttgatacatttgaccgaaggtgcgagaagagtagcgcacgaatcatctgctgtttacccacctttgtgtatggaggcagaacaatcaactggtttcctcaatggaaggaaggaaaggagggagttctcttctcatgtgagaactacccaaacatcccgttgataggaacaaggggttgcattaactacaatcccacacttgctataagacagttagggtaccccatgaggggagcaccggcggaagagagcctctctcctttccttgcgagagatttcggtgcgcagagtttcaagattatacaaagagtccataaggcgtgggaaagcccattaaggaaagataaagaacttaggggcagtcgtaatggcatcatcggtagttatcatgaatggctgaaagttcatacgcgagggttagattggctctccaagttaaagattatcaacaaagagaacttcgaagctctagaagaggatgaagaagtccgagctctaaaaatagaactaggaaaagcaagacttgccaaagaaaaattcaagttggttgctactgacgtttggaaggagtgtgccgagttacgagaagaaaatgcagctaccgcaagagtccttgaacaagaaaccaagagggctcgcaaggaagagcatggccaagacaaatttcatagatctttgtggggtagcaacaatgagctcaagcttcgaagggaagagagagaccaatcatga

SEQ ID NO: 59252 - DNA, 528 bp, Glycine max
  misc_feature (248)..(248): n is a, c, g, or t
  misc_feature (394)..(394): n is a, c, g, or t
  Peptide Sequence Number=SeqID_150937
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgnctttctcccttcgggaagcgtggcgctttctcatagctcacgctgtaggtatctcagttcggtgtaggtcgttcgctccaagctgggctgtgtgcacgaaacccccgttcaggccgaccgctgcgccttatccg

SEQ ID NO: 59253 - DNA, 1057 bp, Glycine max
  Peptide Sequence Number=SeqID_150938
gcaagcttcaaaagctttatcctaaggcatttcccaaaaatcctgcccccaaggtgcctttaaaaattggcattattgaagatcttcaattacgatctgatgagattggcatttccaaggaggatttacagttggcaattaaaacgtggtgcaaaagctctcgttactggcaagcatgtaaagaaggggctgatcgtttagatttagatggcaatgcagttggagtagtagacgcaaccggagcatctcatgctaaagggatgacaccttatgtgccagtggatacatcactgcaacccttggagatagcagaacagttagcagaacagtttgcatttactgccattgatcgtgaccagcgaggtggtaccccaaaacatgagagagacgccattagacaaagcggccttctaagtttgatcattccaaaagagtatggtggtttgggatcaagctgggaggagactatgcaaactattcgaatcttagccagtgtcgacagctcggttgcccatgtatttgaaatgttaatcgtatctgctgttgagcatacatctggagagttgattattgcggctattccaagccagagaagtggtattaaggttttaaatgactggaaaaatatgggtcagcgtcaaacagacagtggctcaatcaactttgaaaaagtgcgtgtagagcaaaacgaaatccttagcgatccaggtccgctcagcagcccttttgcttgcctcaggccgctgatcgctcagttgattcttacgaatatttatctaggaattgccgaaggtgcattcaaggaagctaaaaactatacattgtcggaaatgaggccttggaataactcaaatattgccagcatttccaatgacccatatgtactggctcactacggcgaattctgggcttcattagaagccacaagaagcctaacggacatagctgcaaagagacttgatttggcatggggcaagggtatttcattaaccgaatccgaacgcggagaggttgcaacaagtgtcaccacagcaaaaattattgcaacgagaacggg

SEQ ID NO: 59254 - DNA, 1374 bp, Glycine max
  Peptide Sequence Number=SeqID_150939
atgccatcgctgccggcggtggcaaaagtggaggcgcagaccggcaagccggtaattacggccgccattgccactacgtacgctctgctgaaggcgctggagctggagccggtggtgccgggcgcgggcgcactgctgtccggtgcgtgggctacaccacgccgggcgccgcgctatttgccccgggcgtggtagaggcagtggccgctgcacagggcctgctggcggcggcgcgccagtgcgcgattccggtgatccatacgcagattcgctaccacccgcagcatcagcaggacggcgggatctgggtgcagaaagctccggtgatgcgtgacatggtggaaggcaatccgctggctgagttttgtccggcggtgcagccgcttgccgcagaagtggtgatcaccaaacagtatgccagcgcgttttttggcacgtctctggcatcgatgctgatggcgcagggcattgatacgctgctgatcgccggctgctccaccagcggctgcatccgcgccagcgcagtggatgcgttgcaatacggttttcgcgccatggtggtgcgtgaatgcgtgggcgatcgccatgatgcgccgcatcaggccaatttgtttgatatcgacagtaaatatggcgacgtgtccgtttcggctgcggctgagacgcataacaacatctccccgacgacggggttattgcgcccggagaacaccatgactgacgtttcaacccgtcctgctgcgctggcagccgaagacaccgcttcgatttatcgcaaaatcacctggaagctgattccgtttctctgcctgtgttatctcgcggcctatcttgatcgcatcaatatcggcctggctaaactacagatggcgagcgatctggcgctgagcgagaccgctgccgagcaacctgatcctgcagcgggtcggcgcaaagatctggatcgcgcgcattatgattacctggggcctgctctcgaccgccacgctgctggtgcaaacgccgacccagttctacatcatccgctttttcctcggcgcggccgaagccgcctgattggcggaccgctttccggctggatcatggggcattttcatgaggtttacggcatgcgcggctggcagtggctgtttctgctggaaggtctgcccagcgtattactgggtgtgctgacgttctggctgctgccgaacagcgtcgagagcgccagctggctcagcagcagtgagaagcaggcggtgctgcgcgaactggcgcgcgacgaaggtgacgccaaagggctgaaacacagcctgcgcgatggtctgctgaatattcgcgtggtgatgctcggcggcatcgacttctcgattctgctcagcgcttacgccatgg

SEQ ID NO: 59255 - DNA, 144 bp, Glycine max
  Peptide Sequence Number=SeqID_150940
atgggcgtcaatatcagcggcgtagatttcatcccggcgttgccggacaacagcaaaaactacagccagaagtggggctatagcgatattgaaagcgagttcggcatggcgaaggcggaatatgacctgagcgatagctggacg

SEQ ID NO: 59256 - DNA, 252 bp, Glycine max
  Peptide Sequence Number=SeqID_150941
atgaggataaatggatcaaagggcccgtcgccgggccagttatttttattgctcgttcaggtcgatgcgtacgacgctgtccgggcctttagtggtgtggtctttattgaagggctgtttgacggtgacaaacagcgtctgaccatcggcggaaagcagcaggctgttgggattggccggcagcgcccagcttttcttcagcgtgtagcggctgtcgtcaaggctgataaccttgccggattcacgctgtga

SEQ ID NO: 59257 - DNA, 495 bp, Glycine max
  Peptide Sequence Number=SeqID_150942
atgacttccatgatggatgccatgttaggaatgagacaacttatggagaataatgtggccaccactgcctctgttagttcggctgccgaagcagacccaactctcccagctaccgcgcaccatcctctccgaaacgtggtaggaggagaaagaagcacactggggcacatcagcaacccccatttgggatacaaccgggtggcgtacccttatggattaccacctaattacacaccactagtcatgcgtgatgacgcgggtcatgtcccttcccccatccttgaaagggagcctcctcgacagtcggacgaggttcacgaggatcgtagagagtatgcccaaggaggcatcgatttctaccccccggtccccgtcgaggggctggcacccaacatactgcctcagcccaacctcccagcactaccaatattcttgtccacagaaggaccaccctcggcagcggaagaaagaaggaaactcgatctcatcgaatag

SEQ ID NO: 59258 - DNA, 228 bp, Glycine max
  Peptide Sequence Number=SeqID_150943
atggcggtgcgtctgttgcccgctaccggccatcgccaggctgctgtggcactccctatgccacgacgacatgaacttgctggggggaacgggcgccctgtagggccgacagaggcccgtaaccagagctggaaaccccagggccctgttggacttcttcaggtccactgggtgtctttgtggggggagattggcattgcggtcgctgggcagaatgttgctaagtag

SEQ ID NO: 59259 - DNA, 204 bp, Glycine max
  Peptide Sequence Number=SeqID_150944
atggagaattcgtccctaacagtcaaccacttaatccaaccctatttcaatttactaagcgaaaatcaacttaggggagaactgccaggaaaccacattacaagcgaaacctcaaagagagttgggtttcgtcctcaaaaggaaacaccaccacaaaaatctagccttccatggattcgaacagaaaacgaaaatgaaacatga

SEQ ID NO: 59260 - DNA, 150 bp, Glycine max
  Peptide Sequence Number=SeqID_150945
atggtgattttccaccaaggagatgcagcggaagacaaaggagaagagcttgaagaggatgcttcaatggaggaaaagaaagagggagagaaagagagaggggggagcacgaaattgaaggaagaaaaagggagagaagttgaactttga

SEQ ID NO: 59261 - DNA, 345 bp, Glycine max
  Peptide Sequence Number=SeqID_150946
atgacattgaccatcctagagcttttcttgaggccttaccaggttacacgggatgccaccgtgttcggggtctttaatccagatttcctgctctacataaagcacgaagacctatccgaaattgcacacggttgtcaatgtctcagcatatcacttatacagttgtggattctacactggcagatggtggtcatcctgcccaaggaatacctagttgtctggttttgttcattgcataacaggccagacaactaccttaaggggattattaacagtgctttaaaaggtcttgatgatgctccacagcctaaatcaaaggctcctgctaggtggattgtcgtcaag

SEQ ID NO: 59262 - DNA, 583 bp, Glycine max
  Peptide Sequence Number=SeqID_150947
cagagaccaagtttggtcattctgcacccttgtatcatccagaggcggcgggcccgatgatacgcggagataccttacggttatccgcacccttttgtcaaccagaggcggcgggcccgatgacaagcagagaccaaatttggtcattctgcacccttgtatcatccagaggcggcgggcccgatgatacgcggagataccttacggttatccgcacccttttgtcatcaagaggcggcgggcccgatgacaagcagagacataatttggtcattctgcacccttcagagaccaaatttggtcattctgcacacttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagag

SEQ ID NO: 59263 - DNA, 346 bp, Glycine max
  Peptide Sequence Number=SeqID_150948
gcccgtaaccagagctggaaaccccggggccctattggacttttccgggtctactgggtatcttgtgggtgcgatccctgcgaacaatagatgggggagattggcattgcggtcgctgggcagaatgttgctaagtagcaatgtcatctatatctgtgtaagagtggtcatgttggtgcgcatgatccgcactcgtctctttgcagcggcatgggtgaaatcttgccccggtatgcatagtagctgtgtcatagcctccctttctggttgtgctcgcacagttggccctcctccaatatcagggggtggcccaggaactgttaaaaggaaactactggtcccttaa

SEQ ID NO: 59264 - DNA, 483 bp, Glycine max
  Peptide Sequence Number=SeqID_150949
atgagattttgtagtaaacaatttgtcttgcaggccaagtttgatatctcagaagccctagatgcaaagaaaaaggtgatgtcaactgtggccactagatggaggcagtttaaatcatccctgacaagtaaatttgtgtttagtatttctgaggaccaacataaagaagatccttctgtcaaatatggctttaatgcacagatatgggaggaatttgcggcaacccgcaaaacccctagttggcagggaattaggaagaagatgcaggaaatccaaaagaataatgactgtccctatttgctttctcgcgggggatatgaattgctagaaaagaagctgttagacgagaaaatgaagaaaaggcaacatgacacattgatgactgaaaatccagcactcattgaggacccccccatctcccattcaaagacatgtcaagtggaagatggcccgcacgaatcgatatgggaagatgacatctga

SEQ ID NO: 59265 - DNA, 555 bp, Glycine max
  Peptide Sequence Number=SeqID_150950
atggccacagccgaatcattggaatgggaaacaaagaaggcccgaaaggaagaatggggtcgaaacaagttccgaggagctttgtggggcagcaacagcaagctcaagcttcgaaggactgagagagaccagtcgagagtcgagggcatgatattagaggacaagttgaaggcttgtcaaaggtcaaataagagtttgtccgaacaattgagtaggatggaagaaaatatgtgggccatcattgatcaatacaaagagaagctaagtctagctttaacccatgagcaaaggcaagaggatgagtatgcgaaggtatcgatcctgcaagcagaaagggaagcaagggagagggtgatagattcattacacaaagaagcaatgatgtggatggataggttcgctttcactttgaatgggagtcaagagcttccaaggctgctagccaaagccaaggcgatggcggacgtgtactcggattctgaggaagttcatgggctcctcgattattgtcagcacatgatcaatttgatggcccacataattaggaatcgctaa

SEQ ID NO: 59266 - DNA, 339 bp, Glycine max
  Peptide Sequence Number=SeqID_150951
atgaaggaaaataaagcgaaattggccgtgttgtccacgaggatatcgatgtgtggtaacggaaaattgtccttgggactggcccgattcaggtcccggaactggcacgatgttggcaacccattctggataccgagcgacggccagaaatccagcgtcaaactgcttcttcacttcttcttttatcttcaagggatgtttcgggcttcatcctcctcaatttctgctttactggggaacactcgggatttagaggtaatcgtgtgctgtacaatgtcagaactcaaaccgggcatatcttggtatgaccaagcaaaagatgtcttggtagtctcttag

SEQ ID NO: 59267 - DNA, 625 bp, Glycine max
  Peptide Sequence Number=SeqID_150952
atgacgaaaggcaacgattggtacctcaaagccttacactggggcaatgaggggcacccgtgcatgagcctcaaaggactacacgtcctcgccaacagagggctgcacgccctcaccttaagaggactgtgtgtcctcactttcagaggattgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcatagggctacacgccctcacctttagaggactacacgttctcgccaatagagggctgcacgccctcactttgagaggactacacgtcctcgccaacgtagggctacacgccctcacctttagaggactacacgtcctcgccttcagaggactccatgtcctcaccatcagagggctgcacgccctcacctccagaggactacacatcctcgccttgagaggactacatgtcctcaccatcagagggctgcacgccctcacctccagaggactacacgtcctcgccttgagagggctactcgccctcgccttgg

SEQ ID NO: 59268 - DNA, 456 bp, Glycine max
  Peptide Sequence Number=SeqID_150953
atgaccagaaggcttcttgccggttcattggcttttgaaagccgcatccttcattatctcattgtgcgtatcttgcttccaagatcttcaaaccttgcacaggaattgcgattaaattctccattgccatatccacacttagtcactctcttccttcaacactttaacatccctcttgattctgaaccttatgttccaatcaagagatccttcttaattggtgccgctgtgattgcatcctttggttaccaaaaagagcatgatggctcttgggtgaaaaagggtgctcaaccaaatgatggagaaggacatttacaaggtggagaagattcctctcttcttcaaaagattttggacaggttcgatggtcttcaaacctttgttggtgaaaggtttgatgctttggagttacaagtggacatgagatttgatgagatggattcaaggattaccaag

SEQ ID NO: 59269 - DNA, 309 bp, Glycine max
  Peptide Sequence Number=SeqID_150954
atgagttgtacaggttcgctaagcgcattgcttcatctcactaagcgcaccgcttcagttcatccgctaagcgagaaagagagtttggactgggattcagagctttgcatgtctagggtttctagagagagaaaggtccaagttcgaaagagttttgagagattttgctgtgtgaagatctgcagagaccagagcttgatactcggttcttaccgttttatactacttgtgcgatccagtgcacttttcggaagccgaaaaagtttttggcgccgttgccggggaacttctttttatttgggaagttag

SEQ ID NO: 59270 - DNA, 198 bp, Glycine max
  Peptide Sequence Number=SeqID_150955
gggagggggaaggtcgcggagcgacggtgcgagaaggaagaagaaggtcgcacgaggggggagagggaaggggagagggagaaggaaggttgcaagaggggggaaagtgagaagaagaaaaagagagtgtgggagatgaagaggctgagaggcaggaggaggaaaagtggggaaaatctaagtaggggaaggagatga

SEQ ID NO: 59271 - DNA, 447 bp, Glycine max
  Peptide Sequence Number=SeqID_150956
atggattgcgcaatacacctcttttcgatttctgtcacattacggaattttcacgaatcgccccatgttcccaaaatctaccctaaggctcatgagaaccctaaggccttctcttgcatctctggcccaatcttcttggagtcttctatccaatgcccttgcaaggtaggattgcatcattccctcccccttgaaaaggattttgatgcaagctccattggagcttgtaggcctaggatcttcttcatcaatggattcctttgcttcttgaaagatgaatggcagcggaatggagaaaggaagagagagaggagacaccacttcaaggagaagatgagtctagaagaagctcaccaccataggaggccatggataagagcttggaggaagaaggagatgaatgaagggagagggagagaagagcacgaatttttgtgctctaaatga

SEQ ID NO: 59272 - DNA, 499 bp, Glycine max
  Peptide Sequence Number=SeqID_150957
atggtagaagtctccacagaggccattgcctccctcgcccagtattatgatcagtcgttgaggtgcttcacctttggggacttccagctatcacccatggtagaagaatttgaagagatcctaggatgccctctagggggaaggagaccatccctcttctcagggttctatccctcattagctagaatttctaagatagtccaaatctcggcgcatgaattagaccacagaaagcaagttggaaatggggtggttggaataccgagaaaatatttggaggcaaaagcaagaatcttggcaggtaaaggcgaatgggccttgttcatagacattctcgcactgttgatcttcggaggagtcctctttccaaatgtggatgggttggtggacctagtagcgatcgacgcttttctcgcctatcataaccacaaggaaagcccggttgtcgctatgctagccgacctatatgacaccttcgaccgaacgtgtgagaagagca

SEQ ID NO: 59273 - DNA, 813 bp, Glycine max
  Peptide Sequence Number=SeqID_150958
gcgcacctcgccctcgctgccgtcatccagcccggccaaaatgcccagcaaggtcgattttcccgatccggattcgccgatcagggcgatcgtctgcgcgggtttgacaagcagctcgactccggtaaggatggtgagctgatgctcaccctgaccaacgtgtttactaagatgatgaacttcaagaacgttttccgctggcatcttcccttccttttgctgttgggattattcagtttacgcgctgtcgctgccgataccttgttgattttgggcgacagtttaagcgccggctaccgcctgccgatcgagcgggcctggccgacgctgttggccgaacagtggcagaaaaaaccgggcgcgccgcagctggtcaacgccagcatcagcggcgacaccgccgcacaggggctggcgcgtctgcccgcgctgctgaaacagcatcagccacgctgggtgctgatcgagctgggcgccaacgacggcctgcgcggtttcccggcgcaggacatgcagcgcgatctcggccagatcatcacgcaggtgcagcaggccggcgcacagccgctgctgatgcaaattcgcatcccgccgaactacggccgccgctataccgaggcgttcagcgccgtctacccggcgctggccaagcagttcaacattccgctgctgccgttctatatggaacaggtggtggtgaagccggaatggatgcaggatgacggattgtaccccaatggggacgcccagccgtttatcgccacctggatggcggagcgcctggaaccgctagtaaaacctgagtctaactaa

SEQ ID NO: 59274 - DNA, 381 bp, Glycine max
  Peptide Sequence Number=SeqID_150959
atggttctagagtttgcaacaacaggaatcgaccatgtatcacccacttcttctttgtctttaaactctgttttgctcatacctggttgtcctttcaatataatatctcttagtcagcttactcgttctcataattgttcagtaacatttgatgctaactcatttgtcatacaggaacgtggtacgggtcggacgattggtctttactacctcaagcctaatctttcttggtgcagggcattctccatcagtcctcttgtccccatactcctcaacagaatggcattgccgaaaggaagaataggcatcttgttaagactgctcagacattattacttcatgccaatgtacttgtccggcattggggtgatgcaattttga

SEQ ID NO: 59275 - DNA, 246 bp, Glycine max
  Peptide Sequence Number=SeqID_150960
atggcagctatacaaatgaccagccttgtctctatgacgtgttggacctgtttaagtctgcctttggtcatgggcccttcaagtgcttcatggtccttgcccttagttgtgtcctcatcactgtgttgggcctatttgagtctgcctctggtcatggggccttcaagtgcttcatggtccctgcccttagttgtgtcctcatcagggtccttagtgaatctaagcaaaagagaaacctactcttag

SEQ ID NO: 59276 - DNA, 170 bp, Glycine max
  Peptide Sequence Number=SeqID_150961
atgcagagtgggtcccaatctgaaccgtttgatctagatatgggagatcggttagaggacatgattcgtgaccttggacaagagtctttccagcaagcacacgcccctgtggtgcaagaattacttaaccctgtcgtctgcttgttaagtctggttaatgtgaaggccag

SEQ ID NO: 59277 - DNA, 621 bp, Glycine max
  Peptide Sequence Number=SeqID_150962
gagagaaaaggaaagaaagcctcaagaggctaacattaacctcccatacttgtatgggaaggacaatgtagaggcttacttagattgggacataagggtagagcaacaacttaaaagaaagtctacttttaaatcttatggctctcactcttatccaaagaaagaccaaggtctaggcatcttaggggaaacaccttctaagcccaaagatgataaggggaagacaatagaaaagcaaccccctaaggctagtatgcaagagaagactagctttataaagtgctttaaatgtcttggaagaggactcgttacttctcaatgccccaccaataaaagcatgattatgaggggccaagacatttatagtagccaagatgaggctactacttcaccttcctctagtgaaagtgaagaagcaaaaggggaagaatctaatgaagaaatctaccaccaagaagaaggacaaccattaatggttaaggaggagtgtaaggagataagtgtctcctccaagagtaaaggagttgttggattagggtttggtgtgcaagagcttaaatccttgtgctttgttggtgcccaaaataggtattatgagtcaccaaatccctatgataggtg

SEQ ID NO: 59278 - DNA, 828 bp, Glycine max
  Peptide Sequence Number=SeqID_150963
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgttgatggagaaacacctgggaaagtcgatagcgacggagggaggtacgccggagaagaaggacaaaccggaatctagtgaggtgaaaaacgatgtaacactagagttccgtcagtcagccaagaaggtggagctgccgtcgttcgacggtgacgatcctgctggttggatctcgcgtgctgaggtgtactttcgagtacaaggaactacgccggcggtaaaggtgagtctagcccagttatgtatggacgggccgacggttcattttttcaactcgattctgcgagaaaatgaggatctggggtaccgagctcgaattcgtaatcatggtcatagctgtttcctgtgtgaaattgttatccgctcacaattccacacaacatacgagccggaagcataa

SEQ ID NO: 59279 - DNA, 276 bp, Glycine max
  Peptide Sequence Number=SeqID_150964
atggcgaaaaagggaaagttggatcatataaaggaaatgctcaaggacattgaaggaggcagagattatgcttttgctaacttggcagagttgtacctagtgtctgacatggtcattcctccgaagtacaaggtgtcggacttcgataggtacaaggagactagttgccctaagaatcacctgaagatgtactgcaggaaaatgggaggatatgtgagagatgaaaaaaccttcccaagtccattcttggaaggacctaatgatggccttcattag

SEQ ID NO: 59280 - DNA, 279 bp, Glycine max
  Peptide Sequence Number=SeqID_150965
gacatcgtatccgacatcgtggatcctgcagcttcactacttgacttttatcttgcattgtacaacaactccagtattctcgggcaggatgtcctggacattgtatccgacatcgtggatcctgcagcttcaattcttcatttgacatttcatcttgccttgtttcatatcgataagaatgtgaaggcgaagtgcaaatctttaattggtcaaaaaaatgcttgggactatgtaatggataactggggtactttggttgattgtccgtccgaacactag

SEQ ID NO: 59281 - DNA, 324 bp, Glycine max
  Peptide Sequence Number=SeqID_150966
atgcagtggttcgacagcaagcaaagacggctcgtggcggtcaccgctgatcaatggaggtggaggaggaggttggggattttaggggagcctgcaacactcgcccaagcgaaatttggctcgcctgggcgagctgatccagctcaaattttactgcttcggttaaaatatcgtatgtcatgctcaagatgttatattgcaaatcccaacgatcagaatgtgaaacattgggttgtaagcctagagtccaaatctgaaagcgatccaccggttaacaaatccaggattgcggttttagtggaaacaggtttaagtaaaacttga

SEQ ID NO: 59282 - DNA, 231 bp, Glycine max
  Peptide Sequence Number=SeqID_150967
atggagcaacacaatgcgtctcataaccactacatcctggtaatcgattaccaaaggcctccaaaacatgctgccttcatttctaagcctggtaatcgattacaccccttggtaatcgattaccagaagccctctaaacttcctgatctcatttttaagcctggtaatcgattacactcccttggtaatcgattaccagagaccatcttatcttcctgtcttcaattttaa

SEQ ID NO: 59283 - DNA, 456 bp, Glycine max
  Peptide Sequence Number=SeqID_150968
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccctggatcaaaccggaatcgagaagcgctga

SEQ ID NO: 59284 - DNA, 516 bp, Glycine max
  Peptide Sequence Number=SeqID_150969
aggcaatccatctgacttacaaccctttgatcctgagatagataggacatttcatagattagttaggcatcattttataccttttgatcattctgagcattccattactggtgaatctgtgcattctgttattggtgattttgaacatcctgatcttgagcattataattttgattctgagcattctgattttgcacattctgagaacatggcacaacctccaccccatgagaggactctaagggaaatggctgcacctgatttcacctacgaaagcttgtgcatccagtaccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccaag

SEQ ID NO: 59285 - DNA, 168 bp, Glycine max
  Peptide Sequence Number=SeqID_150970
atggttttaagacacgttaaccgttggatcatgatgaaatttgaacaccaggtgatgagaatcctgaaactggccaaatacaggctaaaggcccaagtggagaaggatgaaggcccaaaggcagagacactatcaagactattaattgttgctgaaggcccaaactaa

SEQ ID NO: 59286 - DNA, 805 bp, Glycine max
  Peptide Sequence Number=SeqID_150971
tctagatgtcactagcctcaaggaattgggacgattgatgggacctctccaaaggcaagccttccgcaaagtatacgggaagattctagatttgaccgcagcggaggtatttacggaagttgtcgtatccctcgcccaatactatgaccagccgttgagcaaaagagttggatcgcatgaagcaaacttggaacggcgtagtgggcctgcctcggaaatacttggaaggcaaggcaagggatatggcaagccaagagaaccgccattgatgctttcctcgcatatcaccatagcaagaaaagcccagtggtggctatcttggcatatttgtttgacacctttgatcggaggtgtgagaaaaacagtgcacggattgtctgttgttacccgctctctgtgtgtggttgatttcacacctattccaacaagacacaagacacccgtgtcctgcaaagttatcgctcatgcgccgaaaaagttgagtctattgggaccaacatttggcggggatagggggcagcacgatcaattggtttcctcgttggaaggaaggcaaggaaggagtctcttctcgtgtggggactaccctaatgttccactgatagggactaggggttgtattaattataatcccgcactcaccataagacagctagggtatcccatgaggggagcgccaaccgaagaaagtctctcgcctttccttgtgagggatctaggcgcgcaaggcctcaaggttatacaaagaatccacaaggcgtggaggagttcgttgaagaaagacaaggagctcaggggcatctga

SEQ ID NO: 59287 - DNA, 348 bp, Glycine max
  Peptide Sequence Number=SeqID_150972
atggagttgattgaaaacatatatgcccatgatcacgccattctacgtgatagagtgcatcaacccactaagaagagtttactggagttatcatcacaagacgctgtgttagcacaaaataagttgctctctaggcaacttgagatcttgacagaaaccttgagtaagttgctaactaacttgtctaatggtcaacctgtacaaccttctattttgcagattacaggttgtaccatatgtggtggtactcatgaatccggcctttgcattccttttgaagagcaaatgcaagaggttagctacatggggaatcaacaaaggcagggatacaatcaaggtggattctaa

SEQ ID NO: 59288 - DNA, 519 bp, Glycine max
  Peptide Sequence Number=SeqID_150973
atgaccaaaaccctgaaatgcgacgtgctggtggtcggcaccggcattatcggttccatggcagcgctttatctgcagaatgccgggcgtgatgtcgtgcttcttgagcgtggcgatatctcccgcggtgcgagttccggtaatgccggcatattggcctttccggaaatcatccccattcccgcgcccggtatcatgaaaaaagccccgcgctggctttttgatccgctcggacctctcagcgtgccgccggcctatgcaccgaagatcgccccgtggctttggcgtttctggcgcgccagcgccgaacgcagtttccgtcatgggctgaaatcactcatggaaatcaaccggctggcggccatcgaaatggcccacatcgctgccatgcccgagctctcgtccttcatctcaaaaaccggcacgcttgatatctatgatagcgaggcgagcctcaacgccgcccgtagggattgggacgaaaaggaaaaagcccggcttcgcattccagcgcgttga

SEQ ID NO: 59289 - DNA, 762 bp, Glycine max
  Peptide Sequence Number=SeqID_150974
atggtcattgaccaatccctattctatgacttgacccaattatctagtgagggtgtaccatttgaaggtgcactaaatgatgattggaaatttgatttctctgtacatgatgcccgtcggttggtttgcaccaaccaagcagatatgaccggaaggctacttgccggatcattggcttttgaaagccgcatgcttcattatctcattgtgcgtattttacttccaagatcttcaaaccttgcacaggtttctgaagaagatcttattgtcatgtgggcttttcataccggccaacaaattgattgggcacacttagtccgatatcgcatacataaggcattgcgattaaatgctccatttccatatccacacctagtcactcttttccttcaacactttaacatccctcttgattctgaaccttatgttccaatcaagagatccttcttgatcgatgttgctgtgattgcatcttttggttaccacaaagagcatgatggctcttgggtaaaaaagggtgctcaacccattgatgatgaaggaaacttactagttggagaagattcctctcttcttcaaaggattttggacaggttcgatggtcttcaaacaaatgtaggtgaaaggtctgatgctttggaattacaagtggacatgcaattcgatgagatggactcaaggatcaccaaggttgaaggagatgtcacttacatctgcacatgctttgatctaccacaaccaccaccaccaccatcgtcttag

SEQ ID NO: 59290 - DNA, 423 bp, Glycine max
  Peptide Sequence Number=SeqID_150975
atggcacctaccaggcaccctctggacctagataagtccaacagggcgctggggttttcggcgctgatcacaggcctctgccagtccttcggagttcccgtcacccccagtaaagtaatccgaccgccgatcacccgggccttcatcgagaagtactgcatgcctaggcatgcgcagggtgatgcacatcaggccacagacgcactgccaccacctcggcaggccgatcccgttgggtcactaggcatggagtgttatctactgcatttggttcgtcagcaggcggccaaccaccgtggagactggcccgaggcccagacaggggaggagcctgcaggatcccccggtgaggtagatgaatcccatatggatgaagagatgactgacctgctcggtttcttgggagggagcggagccacatga

SEQ ID NO: 59291 - DNA, 354 bp, Glycine max
  Peptide Sequence Number=SeqID_150976
atgaaaggaagaggacagaaattcttcaaagccagattgccactcgaaatcattctcgattggcaatatcccaccccacatgaacgaagaggaaaagaccgaaacacccagcttcctctccacatacaccaccatcgagaaaatcctattgatagggggaggagtgaagaagaaaagggttcagccttcttggcacttctcattctctcgaaattgctgaggaaaattatttccgtgaagaaaatccaagcgaggcgcttccgtaatgtttccgtgagtaattacgcgaagattctcgaccgttcttcaagattcatcgttcgttcttcgttttcttcagtcttcaatgggtaa

SEQ ID NO: 59292 - DNA, 939 bp, Glycine max
  Peptide Sequence Number=SeqID_150977
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgctgactgtgaaagagtttgaagaaatcctgggatgcccactgggaggaaggaagccatatcttttctctgggttctatccctccacgacaagagttgccaaggtagtgataatctcagcacaagagttggaccgtgtaaagcaaaacaggaatggggtagtcggagtaccaaggaagtgtttggaggaaagggcaaaggccttgcaaatcaaggcgaatgggctttcttttattgacatcttggcgcttttgatctttggagttgtcctctttccgaatatggaagggttagtggacctagcagcgattgatgctttcctcgcctttcatcatggcaaggaaagcccggtcgtcgccattttggccatgattctatcttcatgcgaaggatgtcccatgagaggagtgccatcagacgaaagcatcacgcctttcatcgcacgaggtttcagtgaccacaacgcgagggacataaagcttaggggaagcagtaatgggatcatcggcggctatcataagtggctgagagtccaaacacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaagtctga

SEQ ID NO: 59293 - DNA, 429 bp, Glycine max
  Peptide Sequence Number=SeqID_150978
atgcatctattcaaaaccttttccagactatccaaacaaatatcaaaagaggatccatatacagtaaaatcatccataaacatctctatgcaattttctaaaaaaatcactaaaaatactgatcatgcaccgctggaaggtaccaggggcattgcacatgccgaaaggcatcctcctataggcaaaagtgctgaaggggcagtggaaaatgtagaagcaaagcttcatgatgaatcaagaatgattcaaagatgttttgatgataacaaaggtgatgacaaaaagctcaaaggtcaatcaaagaatgagttcaagatgttcaagatagaatcaagaaagaatgagtttaagatgttcaagatagaatcaagaacacttcaagattcaaggatcaagcttccaagaatcaagatcaagattcaagactga

SEQ ID NO: 59294 - DNA, 662 bp, Glycine max
  Peptide Sequence Number=SeqID_150979
gaaaagccaagaggtggctccattcatttaagggtaatagtctgaagacatgggaagaagttgtcgagaaatttcagaagaaatacttccccgagtcaaagactgtcgaagggaaaactgcaatttcatcatttcatcagttccttgatgaatccctaagtgaagcattggagaggtttagaggttgtaccatatgtggtggtactcatgaatccggtgtttgcattccttttgaagagcaaacacaagagggtggaccttccaataggccgcctcaacaagggcctgacatttttcagaggacaaccaagttggaggagactctgactcaattcatgcaggtaaccatgtcaaatgacaaaagcactgagttagcattgaagaaccttgagatccaagtgggccaactagccaaacaattagctgaaaagtcatccaatagctttggggcgaacacagaaaagaatcccaaagaggaatgcaatgttgtgatgacaagaaacaaaaagtgtttggcagatgaggatgaggatagtgtggctttggagaaacaaatttttgtaaaggatggcactaagaaaaaggaagaggaggtaacagatgtgaccaatcaggagagtgaaaaaccaataatggttgaggagaaagaaataaacgactag

SEQ ID NO: 59295 - DNA, 546 bp, Glycine max
  Peptide Sequence Number=SeqID_150980
atgacacgcagagacaaaatttggtcattctgcacccttgtgtcatctagaggcggcgggcccgatgacacgcggagataccttatggttatccgcacccttgtgtcatccagaggcggcgggcccgatgacacgcggagataccttacggttatccgcacccttgtgtcatccagaggcggcgagcccgatgacacgcggagataccttacggcggcgagcccgatgacacgcggagataccttacggttatccgcacccttgtgtcatccagaggcggcgggcccgatgacacgcggagatacgttacggttatccgcacccttttttcatccagaggcggcgggcccgatgacacgcagagacaaaatttggtcattctgcacccttgtgtcatccagaggcggcgggcccgatgacacgcggagataccttacggttatccgcacccttttgtcatccagaggcggcgggcccgatgacacgcagagacaagatttggtcattctgtacccttgtgtcatccagaggcggcgggcccgatga

SEQ ID NO: 59296 - DNA, 162 bp, Glycine max
  Peptide Sequence Number=SeqID_150981
atggataagagcttgaaggtaggagaagatgaatggagggagagggagagggagagaaggagcacaaaattttgtgcctcaaaagaggctaagcgcgccatgtgcgctaagcctgagtgtctttctgttgaggctgagctaagtgccaacatgctgcgctaa

SEQ ID NO: 59297 - DNA, 519 bp, Glycine max
  Peptide Sequence Number=SeqID_150982
atggagggaattgacaaacatgatgcaaaatgtcgcggctccactagaggcttttttctagaccgtttacgtcagagaccaggtcatattttcagtgaagttggtaaggtatatgctgtcaagtggaatgatgtactggacaatgtatggcatttggttgacaaagaagaaaattatcataacgttgtgtacaacaaagatttggaccaaccagccattgtagcaggaaggacaacactacaagatttttaccagctgaccgaagattatccagtctccttaactcattatgttccctgcccaagtcattcccaagatgacactctgtataccatcaagtgccagattctatcatcttcaaggacgtttcaagtagcatgtattattttcttaaagacaaaggttgaactcatttgcacttggaggatgttgcagaatgccggctcgtgttcaatcattggaggaagacacttaaaattggagccggatggaaacatttctgcgagatcttgttgttaa

SEQ ID NO: 59298 - DNA, 96 bp, Glycine max
  Peptide Sequence Number=SeqID_150983
ccttgggattcgtgcaaggctattctgttatgctattcattattcagagcttttgttttagggttttacgttttctgctttgatgctactgttcac

SEQ ID NO: 59299 - DNA, 318 bp, Glycine max
  Peptide Sequence Number=SeqID_150984
atggcgactaagatgaagctatgtccgtttgaagctttaggcccgatggctccgatcatgtctatgccccacatagagaatggccaaggtgctaccaagacattcagaggcctagcacttatggcatttccacacatggatgcaacaatcgctctccatagtgagccagtaataccccgctctcagaatttttcgggccatggcatgtccattggcatgcgtttcaaaggatccctcatgtacctctaccagcatttgctcaacctctctggcatttacacatcgaagcagtaccatgtcatgattcctcttgtatag

SEQ ID NO: 59300 - DNA, 153 bp, Glycine max
  Peptide Sequence Number=SeqID_150985
atgggccacacattgtttgtctcctacttgcaggttcacgaccgaccgtcgtctcttcccggcattagacaagcagagtacgtcgctgcaagccagcccatgggttcaagtagccaaacgctaacccataaggggatggggagccatggctaa

SEQ ID NO: 59301 - DNA, 435 bp, Glycine max
  Peptide Sequence Number=SeqID_150986
atggaaccagaatactgggacaagaatcctttcaaagcaaccgccaaaccacgatattatggctcaaacttaaaccaacccaaaaaattttctgcaccatttgaccctgcagaatataattattgggattacattgacgcctggaccaatgtgttctggcatcaaaataataaattcaagcattcatggctaatttacttcaaaaataacactgtgtataattttccaaattggttcctccaatggtggaactacttcggaccaattccacagatattcccagaagaagtccaacagggattccaacaattcaacaagctctataatagcaaggaatcacgtattccggcagatttaaagtacttttccagttttgccttgtcatggattttttcatggcaatacagatacgaaaaaaccgaaaacagaaaatag

SEQ ID NO: 59302 - DNA, 387 bp, Glycine max
  Peptide Sequence Number=SeqID_150987
gtcgactctagaggatcccctggtacaggagatatgtcgcgagggtcaggagaccttggggacgtcagctgtgaactttgtttgatatatgggatatggcctttggtaatcgattaccaagggcttaaaaacgagatcaggaagctaagagggcttctggtaatcgattaccaagggatcgtgatggtgacgcagctaatccatgatcgagtggagatggagtgcctagagggagcttgggagaccctcgaaggcaacatgaggtgccgaattcggggcatgattcgatttacggctacttcattggtgcatccagacgaacccgcgcgtatgcttcagcgcaactatggagtggatactacccaagccttacaccatatcgtctag

SEQ ID NO: 59303 - DNA, 111 bp, Glycine max
  Peptide Sequence Number=SeqID_150988
atgggggtggcacatggaggtggggaccacgtggttttatcatggcttgtgacattggaggaagaaaaggggatattgatcttaatcatttgggagatatcaaaactctag

SEQ ID NO: 59304 - DNA, 714 bp, Glycine max
  Peptide Sequence Number=SeqID_150989
atgaaacaacactttgatcttgaagtggtggcctcagcagaatatgaatctgaagttagcagcaaggttgcttccaatatatctatccaagaaacctatgcaggtccttgcagtgacaacctcaccaactcttccaatgtgacaaatccaatagagcttcatctccattcagatgctatctcccttgacttaactctcaaattcaacaacaatgacttctcattctcaagcacaagtgagagcagcaatggtcctctctctcaaactaatttagcagccaacccgcgagtcttctcttgcaattactgcaagcgcaagtttttcagctcgcaggctcttggcggccaccaaaatgcgcacaagagagaaagaacaatagcgaagagagctatgcgaatggggatattctctgagaggtccttaggaataaaggcacactcttcactgcaccacggcttttcgccaacaatgaggcctcctgagatgaaaagcagtgcaagatttgagcaaggatatgttggtcttccaatattcttggaggaggatgaggcagaactcttgtggcaaggtagctaccatcaggttccctctgagggaggccatactcatcagaatttcacactcagtggaagttcaaatttgagttttgttggttcgagtcttccaccagttgacttagagaactcaacacctgagttgacattgaaactttga

SEQ ID NO: 59305 - DNA, 564 bp, Glycine max
  Peptide Sequence Number=SeqID_150990
atggagaaagcaggctctaacagtcctaaatctgctttgaagtttgtgaagaacacttctcagtctgcagctcaatggagcagtactaattctagaggaatgacaaaagatgtactcaaagacaagttctatgacaagactaaagcttcacgaaggtctccacccaaagaaagtaacatggcttcaccaaggtctccacccagagaaaatactaagccacaagaatttaaactccacacccaagaaagagctgtcaagcgtgcaatgttcaattatgctgtgacgacaaaattctatatcatggagctgcaaaagaaacaagaggaaaagctgcaaaagttgattgaagaggaagaggttcgtttgctgaggaaggaaatggttccaagagctcaattgatgccttattttgataagccattcttcccacaaagatcaagcaggagtattccaagagagtcatgcctccacatgatgagcagcaagtgttggagctgctcggttggcaatgaaatctacaacttgcaccactatggtcatcaaactctcaagcccattaagtag

SEQ ID NO: 59306 - DNA, 975 bp, Glycine max
  Peptide Sequence Number=SeqID_150991
atgaagctcgacgtagatgtcttgagatatctctccaaagatgattttagggttctcactgccgttgaattggggatgcggaatcatgaaatcgtacccaccgaactcatcgaccgaattgcgcgtctcaagcatggaggcacgtacaaggttttgaaaaacttgctcaaacacaagttgttgcatcacgactcttctaaatatgatgggttccgccttacctaccttggttatgattttcttgccattaagactatggtgaacaaaggagtgtttgtagctgttggacgccagattggtgttggaaaggaatctgatatatttgaggttgcccgtgaagacggaacagttctggctatgaagttgcataggcttggaagagtctctttccgagccgtcaaatctaagcgtgactacttgagacatcgcagtagttataattggctctatttgtctcgcctcgctgcacttaaagaatttgctttcatgaaggctttggaaacacatggcttccctgttccaaatgcaatagaaagcaatagacattgtgtagtcatgtcactcgtccaaggttatcctcttgttcaggttaagcagttactgaatccagagacagtttttgaggcaattcttggtcaggtcgttcggttcaatctttcttttcaagaaagcatagatgatattgatggttctgatgaagggagagatgaagctggaaagccaagtttttcttcaatagaaagaagtgctggttttctagatagagagcttgctgccagtggctttactagaaagaatgaagaagatattcagaggttcattgaaggtggggcagaaagtgatacaaattcagatagtgaaggggttgacttggtggaagacctgaatgaagcagacactgtagatgatgattcttcacatttgtcagaacagcctggtggaaatagggaagctggtttcatcagcattggttag

SEQ ID NO: 59307 - DNA, 123 bp, Glycine max
  Peptide Sequence Number=SeqID_150992
atgagaagcatacttggcatagagagagatgagggcattggcaacgaagggggagtcgaagtgcaccattttgagtacgacggcgtgaacttggaggccaaaatggaagtggtggaggagtga

SEQ ID NO: 59308 - DNA, 1164 bp, Glycine max
  Peptide Sequence Number=SeqID_150993
atgattttgaacgtggaaatgagatgggtagtggctgaacaaagcaacaagaggtccctctttcagctcatggattcagctccttcttgttcttggctacaagccttctccttcttagcattggtttggttatttaactgtggatgtgtccatggagccaccccagcagtgaaagtaggtaacttttcaaaggtggaagatgctggaaacttccatatttactatggccagaccttcaaagtcattaagaattctgctgatggccagagctaccttcttctccagcttttaggtttagtggagagcttgaaaggcataacctcagactatgtggcttctccatgtgtgttgaaactgtacgaaggaggacagatagaattgttcaataatagtgattaccaaaagcttgcagagttctcttcatactttcttagtgacactgatcagcagccagcttgcaattttgcaacttttgttccatttatagaggatatccctttgcagagagcagaatggatcaaattcatgggagcttttgcaaatgttgaagctagagccaatcaagtctatacagcagttaaggcaaactatttgtgcttggctaaaattgctacaagtaggacaacattcaagccaacggtagcttggatgaggtataaaaatggtctttggtcttttacacaggaaaagtatcaattgaagtacgtgcaagatgcaggcggagagattttgggtgccaacaagaacacttacaatgtctctgatcctgatgacttggaggaatttcatgccatcctatgtaccgtggaagtagtcattgatgaaacactaacatctgatccagtcaactacaccttttcaacatttatccaaaatctaaacgttgaagatcgttcttgtttttcttttatttcaaacacaagtctatggagatatgacaaaagggtttataattctgtagctcttgactggtataatggagcagtgtcccaacctcaattggcactagcagatcttattgaagttttatttcccactgaaaattacacaacgacctattttaggaacattgcaaaggcagaagtacctataaatattggtcttgaaatgtgtgacagggacacatccacagcaatggagcctaccatagtagcatgtggatga

SEQ ID NO: 59309 - DNA, 2778 bp, Glycine max
  Peptide Sequence Number=SeqID_150994
atggaaatagcaaaaatcatgtatggtctaataaatagctcaccatttacagataagatatgcaaggacaaagcccaagctgcttcttggtttgttggattgaaagctgtgatttctaggtgtcagcatcctagagcttttagtagtttaagaagttgcaaaggggtgcagagttgtgctagtagtccagctggaatcttaagaagaaagaaaaatcttggccttctggacgatacctctcagtttactcaggtacatagcgtatgtgcaagtcccactttgtcactttctgaaaggtgcttttctgatggcttgtcatgtacctctgataacttttattcatcgtcatctttcctttccaacactcatggcgtaacagataattcagtgccaagttctccatacattgatcctgataatcatagcaacattgagtcaacccgcattgataaggagcacaagaagaatttgtcctataggtatctgatgcattccacttccccacatgtaggaaaaaataatgtgttgaaagatgtaatgatatggggtggagggattggatgtcttgtagggattgtgaatgaaaggtttgttcagcctagaatttattctttagtgccaaagttactagaatccactgcaatgttagatgttcataacatagctttaggaggaaaacatgctgccttagctacaaaacaaggggaagtgttttgctggggtcacgatttattgattgaagggagaactagaagtcagtggataccacaaaaacttggtggatccttagatggtattagtatctcaagtgttgcctgtggggaatggcatactgcaattgtctctagttgtgggaggttatttacttatggagatggtacatttggggttcttggccatggcgatcttcggagctattcaagtccaaaagaagttgaatctcttagtggtctacgggtgaggtctgctgcttgtggatcatggcatacggctgctattgttgaagtcatgtttgaccgtttcaggtacaatagtgctagtggtaagttgtttacatggggtgatggagatgaagggaggcttggtcatgttgataatggaagcaagcttgtaccaacacgtgttacacaacttgttgactatgattttgttcaagtgtcatgtggaagaatgttgactgtagcactcactaacatgggcaaggtttttgcaatgggaagtgccaaatatggacaactaggaaatccacatgccagggataaagcagtcatggttgaaggacaactcaaacaagagtttgttaaggtgatatcaaccggttcataccatgttgctgttttgacttctggggggagtgtctacacatggggcagaggtgaaaatggccaactggggctaggtgatactgaagacagatacacaccttgttttgttgaggctctaagagacagacaggtaaatactatcacttgtggtccaagcttcacagctgcaatcagtttacacaaacctatttctattagtgaccagtcaacttgtactggttgtaggttgccatttgggttcacaaggaagaagcacaactgctatagctgtggtcttttgttctgtcgtgcttgtagtagtaaaaagattacaaatgctcctctagcccctagtaagagcaaggcttttcgagtttgtgatcagtgtttcgataaacggcaagggggtacacatcctgtaatggcatcaaagtccagaaatcacaactctcagcaattgttgaagcatcaacacaaaattgctgatgtgactgaagataggggagagacaactgtgacacaaggtcctttgttatcacttggtcaatcatgctacaggaaaagcatgccaagtggacgtaaggattggaaaagcaatcaagaaagtcagcaggatgtagaagatagttctcctatgctaggtggaatgccacagtgggggcaagttccttgccctgccatatttaaaataaattctacagaaaatccagttgctcatgtttcttcatccaaaaataaattagccacagtttctccctttaatgtggaatctacaacatataacttctccaatgtagagacagatgcaacaaagtctgacaaggtgctccttgaagaagttcataggctgagagccgaggctaagagacttgaagagcagtgtgagctcaaaaaccataaaatacaagagtgtcaacaaaaaattgaggagagttggtttgtagcaagagaggaagctgctaagtgcaaggcagcaaaagaggtcataaaagctttagcactaaggcttcatacaatatcaggaaaagataacgttggacaagaaggaaaagctgggccgaatgaatttgtgcccaatgtggcacccatacatacagaaatgaagagtccacgtgatgttaatgtggatagtctatccaattcccctatagtattctctgacacattaaaatccaaatttgggagaagtttgttccccaaaattgataattctaatagagcagaatctcaacaggacaatattgatggcttgaaggctgaatgggtagaacaatatgagcccggtgtttacatcacatttacaactttgcaatgtgggaaaaaaggccttaagcgagtgagatttagtcgaaagcgattctcagaaaaggaagctgaaaaatggtgggaagagaatcaaggcacggtgtatcacaagtatgggattgaaggatatataaataataacactagccaaagtcaggtgaaaggctaa

SEQ ID NO: 59310 - DNA, 99 bp, Glycine max
  Peptide Sequence Number=SeqID_150995
atggcagacaagggacacagaaaagagtccttccttggttttcacaataagtggaaccttatcattaacagcaaaatgattgatgagagaagaacataa

SEQ ID NO: 59311 - DNA, 747 bp, Glycine max
  Peptide Sequence Number=SeqID_150996
cttgatccttttgaacagcatgttgagtggagtaagatccagacgcctacggatcaagtagtggtgccttatgacactttggcaccaattcctgatgaggtgaagaacctcttggacaagcttgtggtgttgaagctcaatggaggcttggggacaactatgggttgtactggcccaaagtgggtaaacttaaaagcagttaaaaggcttgttgaagctgatgctctgaagatggaaattattcccaatccaaaggaagttgatggagtaaaagttcttcaactggaaactgcagctggtgcagcaataaggttctttgacaaagctattggaattaatgtgcctcgatcccgcttccttcccgtgaaggcaacttcagacttgcttcttgtccagtgggacctttacactttacaagatggattggttattaggaaccaagctagggcaaatcctgaaaatccttccattgaattggggccagaatttaagaaggttagctacttcttgagccggttcaagtcaatccccagtattgttgagcttgatagtctgaaagtggcaggggatgtatggtttggagttggtgcaatccttaagtcagagttgcgtgatagtactttaggagctcagaaatctctgcaaagaggcaaagtaagtattcttgcaaaacctggtgtgaagcaggaaatacctgacggagctgtgatcacaaacaaggaaattaatggccctgaggacctctga

SEQ ID NO: 59312 - DNA, 1848 bp, Glycine max
  Peptide Sequence Number=SeqID_150997
atggacaaccttcaaaaatgccaagcaaactacacagcactcacacctttaacgtttttgatgagggctgctgcatgctatgcaaacagaacctcagtgatacatgaaggaacccgtttcacttgggcacagacttatgagcgttgtcgccgcctcgccttctccctccgtgcccttaacattgctaggaatgatgttgtatcagtgctggcccctaacatcccagcaatgtatgagatgcatttcgcagtgcctatggcaggtgctgtgctgaacaccatcaacacccgtcttgatgccaagaacattgccaccattctgcgccactccgaagccaaagtcttctttgtggactacgagtacgtgtccaaggccaaagaagccctcagattgctcatggacgacaacaacaacaacaacctcaaaaagggtgttccaaaaccaacaaatcaaccacactcaacgacattttctcttccactagtcattgtcatagatgacataaacacccccactagaatccgtcttggtgagctagaatacgagcaaatggttcatcatggtaacccaaattacttccctgaaggaatccaagacgagtggaccccaattgcgctgaattacacatcaggaacaacctcggagccaaagggtgttgtttatagccacagaggagcatatcttagcaccctaagcctaatcttggggtgggaaatgggtagtgaacctgtttatctctggacactacctatgttccattgcaatgggtggaccttcacgtggggcgtggctgcacgtggtggaacaaacgtgtgccttcgcaccacagctgcacgtgacatatacaggaacatagtagtccacaatgtgacacacatgtgctgtgcccccattgtgttcaacataatcttggaggcaaaacaaagtgaaaggattgacataaaggtaataaatgggaagagaaaatcaccggttgagattctcactgggggagcaccaccaccagcatcattgctagagcaaattgagtcacttgggtttcatgtcacacatgcatatgggctaactgaggcaacaggcccagcacttgtgtgtgagtggaagaaggagtggaacatgttgccaaagaaggagcaggcccaacttaaggcccgtcaaggggtgagtgtgttgactatggctgatgttgatgtgaagaaccttgagacaatggagagtgtggctagggatgggaggacaatgggggagattgtgctgaagggaagtgggatcatgatggggtatttcaaagatcataaggcatcttcaaaggcttttgggaagaatggcgattggttcaaaactggggatgttggtgtgatacaccctgatgggtatttggagattaaggataggtctaaagatgtgatcatttcaggaggggagaatattagtagtgtggaagttgagtcacttttgtataagcaccctagggtgttggaggctgctgtggtggcaatgccacaccctaggtggggtgaaactccttgtgcttttgtgtccttgaggaagaacaacaacaactcatcatcatccaaaattgatgatgtcactgaggctgagataattgcctattgcaggaagaatttgccacactttatggtgcctaaggtggtgaagttcatggaggagctgccaaagacttcaactgggaagattcagaagtttgagttgagggtcatggctaaggttttcgtgcagaccaagaataatactaccactgtcaacaagaagtcttgccaagtgagtcaaaatagtattgttggggggtacaataatgagcaagttttggctgcgtctcgtctttga

SEQ ID NO: 59313 - DNA, 117 bp, Glycine max
  Peptide Sequence Number=SeqID_150998
atggagaaaatgatttcccctactagagataaggatgtattcattgtagagctacaagtctctgagggttgttgtgggtgtggacctgagcctgatactacaaatctccctttttga

SEQ ID NO: 59314 - DNA, 2658 bp, Glycine max
  Peptide Sequence Number=SeqID_150999
atgaagatgttgtcagaagctccggcgtgtgaaataactgacattaatttgtctgaagattactcacctccacatgatttgttataccagatagaaatgaaaacaatagtagctagtgataaaaaaggggatgtttatgagcctgaggttggacatctcattgctttgactgataagaggccaacatgcattgatgatttgaacaagcatggaaattcctatcttattgctttaattaggaaggttagaaagaaaaatgacgatgaaaatgtttttgaggttcaaatactagcctcacagcccattaaattggaaattttaacaacaaatatgcgtatatggaatgctctgaactcagatccagatggtccagtcatccatgtcagcaagcaactgctccaacctgattctgctgttggggaaaattgtgctcaatgttactcatttcaaaggtacactgatgatggatcaatgattggtgctgccattcgcttattcgatttaaacaaagctcaagaagagggcgttttaagttgtttagctgcaagggaatgctctcacaaaaatactgtgaaattgatttggggtcctccagggacagggaaaacaaaaacagttgcctcattactatttgccctcctcaaaaagaaatgcagaacacttacttgtgctccaactaatgtggcagtactggaagtgacatctaggtttcttaggctagtgacagagtccattgattatcacacttatggtcttggagacatattattatttggaaacagaaagcggatgagtattgacgatcgtgatgatcttcttgatatatttcttgattaccgtgcaaatattcttgccaagtgctttgctcccttgtctggttggaaacatcatttagaacaggtgatattgttacttgaaaatcctgaagagcagtatcgtgaatatttaaagtgtgaggaaaagagggattatgagatagatgatgatgatgattgcttgaaagaagagaatgaactacatgcaattgcaagtcaacaaacaaagcaagagaagaagcatatgtccaaggattcaaaaattttccttgcagagatgctatcaaacaattcgattactgatcaacaattgtataaggccaggaaagaatgccttacaaagctgaaatcacttcaaaagattattcttcctgatttttttgatgaatatacaatcaaaaacttttgtatcaaaagatcgcgcatgattttttgtactgcttcaagctccgctagattgcatgcagtagaacattatagactagaaatgttagttatagatgaagctgctcaactcaaagaatgtgagtcaaatatacctttacaacttcctggtcttcgtcatgttgtacttattggagatgagaaacagttgcctgccctagtcaaaagtgagatttctggcaaggcagggtttgggagaagtttgtttgaaaggctggttcttttgggtcatgaaaaacaccttctcaatgttcaatatagaatgcatccatccattagcttgtttccaaatatggaattctatgacaaacagattttggattctcctagtgttaaagaaagaagccatgagaagcattttctacatggagatatgtttaagttctactctttcataaatgttgcttatgggcaagatgaattcgatgaagggaatagccgaaaaaatatggtggaagtagctgtggtatctgagattgttctcaacctctataaagaatcagcttctagaaaacagactgttagtgttggtgttatatcaccatataaagctcaagttcttgccatacaagatgctcttggaaaaaggtttgttggtaatgttgataatgacttttccctgaaggtttccacggttgatggtttccaaggtggtgaagaggatgtgataataatatccactgtaagatataataacatgggatatgtgggattcctttctaattttcaaagaactaatgttgctttaacaagagcaaggtattgcctttggatagtaggtaatagtgaaactttgatgaatagtggctctgtttgggagagattaatccttgatgctagggctcgagggtgttatcataatgctgatgaggatgagaggttatctgatgctattgcaacttccgtgattgagcttggtcaagttagtgatttattgaaattggattctctgctctttaagaaagcaaagtggaaggtttgcctcaatcaaagttttctgatctctatggcaagaattaagagtgctgagatttgcaagaaaatatgttccctgctgatgcaactttcaagtggttggcgtcagcctcaccggaacataaatattagagttttggatgatacttcttcccaacagttagagctgtataaagtcaatgagtcactttatcttgcatggaccatagatgttctagaggagaactcaaattatgttcaagttttaaagatttgggatgttttgccattgtctgaggtatccaatttggtgagggatgttgacatctcatacaagagttcgaatcatctatccaattataatcttccacaagctgatcccatgcaatttctatgtaaccaattttcttcgctcagactgagggacataaattggaatcaatag

SEQ ID NO: 59315 - DNA, 342 bp, Glycine max
  Peptide Sequence Number=SeqID_151000
atggttataatggcagtagcaacaatagtgatagtggtcataatgcatggtgataacaaccacaatgatgatagtaatgataatggtgacggtgatgctggcgactacaagagtgggattggtgttggggtgctgggatggggtgacatttctctctggcccgtcatcaaaataggactcgccggagtgctcattctagctgagacctacaaagattacttcggtgcatttgtagagcgtttccaacttctccccattcctcaacctgaccaaatgcaaacactctctggactaggaagtttggggatgacgcaaaggaagcagttacaccattttgactag

SEQ ID NO: 59316 - DNA, 290 bp, Glycine max
  Peptide Sequence Number=SeqID_151001
atgtctgaattaatagtgctactcaaaagcaagagcttagtggagcatctgcgaccaactatgcctgtgtttgttgaatcaaatatgatgaatcgggaaggcatgtctgctgcatggaaagcagaagcaattcccaaattaacaaagaaacaacccaaagtggcaacacttctatcacgaaagatccctccacaagctgctgaccccgggatgaaacgtgaccttaaaagccttcaagatggagaatttagagatggaagagcgcatatgacaacaactcagattgccaa

SEQ ID NO: 59317 - DNA, 267 bp, Glycine max
  Peptide Sequence Number=SeqID_151002
atgacattaggggagtcaggtttccagaatcctctacatggttggagaatgatgttcttctccttggagacaatctgtgggagcaagtcattcgtcaataatgtttggtatatcaaaatactttcaccacctgaagttattcagaaaatgggagaacaggtggttgaatcccttgctctaagttcaggacaaaggctaaatggccatagtgtcgaatctcaggacattgtttcgggaccaccatcaactggctcacttgagtactga

SEQ ID NO: 59318 - DNA, 438 bp, Glycine max
  Peptide Sequence Number=SeqID_151003
atgaaggagaagaaaattcaagcaagaatcaaggaagcgtatagcaacgatgaaaagtgcagggagtttatggaaaaaggagtcactcaattgaaatctcgattgaaccaaatccacccgctagttcaaaagtttgatggttgctacaaacaagtagttaatcatagaagaagtgggagttcaaagaaagatcttatgactaatgcacatatgatttactcgcaggataccgataaaaaaatagaagttgaacatgcctggttgttgttgaaagaggaatgcaaattcgatgcggaatttatgggaaagtcttcaaagagaaccaatgtttttgcttcaggtggttactcattgtcttttaacctaaatgcacctaatgaagttgaagagtatgacacaacatcaccaatgtctcgcttaataggagaaagagcataa

SEQ ID NO: 59319 - DNA, 405 bp, Glycine max
  Peptide Sequence Number=SeqID_151004
atgacattaggaattagtgccagcactgtatttgctgaagatgcaacaactgaagcatatcctgataatgacccagggggtgacttaattggattaagaaaaattgaggatggctctgtaggaaaactagatgaagctgaaaaactcttcctttctgctatagaagaagctaaagaaggtttcggcgagaaagatccgcatgttgcttctgcatgcaacaatctggcagaattgtacagggtcaaaaaggcatttgacaaagcagaaccattgtatttggaagctatcaacatattagaggaatcttttggtcctgatgatgtacgggttggggtcgctgttcacaaccttgggcagttttaccttggacagcggaagttggaagaagctcgtgttagctatgag

SEQ ID NO: 59320 - DNA, 723 bp, Glycine max
  Peptide Sequence Number=SeqID_151005
atgaaattagaaaatgttgcaagaacagttatgtctcaaatctgttgtcatcgtcaaaaacatgatgcatttggtgtaatacagggatggaattccttggacactgttattgcagctgaatctttggctctgaccctgcaagcatctggcaatacaaaagattcaaaagagtttcttgaaagatgtcttaatgtccggaaggacttacttcctggtgaccatattcagataggtgcaaacttacttcatctagcaagagtggcaatgcttgattgcagtcaacataaaaagttggatgtttctagagctaaagctgagcttgatatggcaaagaatcatttgcataattccataaggatttcatgtcaatgtttagagaaggtattgaaacaaaaggataagttaaagaaattcagtaagcctggagattctagaaaggaaggccaagtagcactggccatattgttgcaatcactcaatacattgtcatcagtggagttagataagcaagaattgcaggagattcaggaaaaagatattaaccttgaggctcgggaggcacttcttcaatgcatttctgcttacaaggagtttgtacataagaggtcaattgctgatacccctgaaataaagaaagaatatctttcatgtttaaagcgcgctcaaaatttgtttggtcataaagttgatgaagagctaagcaatcaaaatgatttccgatag

SEQ ID NO: 59321 - DNA, 465 bp, Glycine max
  Peptide Sequence Number=SeqID_151006
atgggtgaagtagaggagatacaagagaagatgaaggccgacatggaggccattaaagagaaaatgaccacaatgatggaggccatgatgagcgtgaagaagataatggaagccaatgcggttgcaattgccgctaccagcgttgttgctaaggtgaacctgatgtccccatccggcatcaagcaaatgaatcatccaacctcagatatggtaggcaaagatttaggaagtacgggcggcccccatgatgtgcagattcaaaatgagcacgccttcccgtcatatggcttgcctctcaactatacgccacccaatgtggcgtacactcccaataagaatacccatgaaattccccatcacaatctagccgacttcgagccttggctcggatatgccacggaagggcaagcagttggtggctcagggccattgaaggaggtgaagattatgcctttgctaacctag

SEQ ID NO: 59322 - DNA, 483 bp, Glycine max
  Peptide Sequence Number=SeqID_151007
atgaaaagatggtgggctgcgcaccctcaaagctttgcagatttggtcttcgccagtgaaaggatcaatgtgggtccgaaaagaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccgaggttcatcaacctccatttctccgagaatacgactcgaacgcaacatgtgcttgtcatggagaagccccggggcgttccattgagcatggtagggctctgaaagcgtaa

SEQ ID NO: 59323 - DNA, 102 bp, Glycine max
  Peptide Sequence Number=SeqID_151008
atgaatcgaggtgctaggggacgggtacgagtagacgctaggcccgtgatcagcagatcatcgtctcgcgtccaactcaagacgttaaagaagcactactag

SEQ ID NO: 59324 - DNA, 393 bp, Glycine max
  Peptide Sequence Number=SeqID_151009
atgaggggagcaccggcggaagaaagcctctctccgttcgttgtgatagatttcggcgcgcaaagttccaagattatacaaagagtccacaaggcatgggaaatctcattaaggagaaataaagaacttaggggcatccgtagtggcatcatcggtgtttggctctccaaattaaaagttatcaacgaggagaacttcgaagctccggaagaggatgaagaagtccgagctctaaaaacagaactaggaaaagcaaaacttgccaaagaaaaattcaagttagtcgttacagacgtccaaaaagagtgcacccggttacgagaagaaaatgcagctaccgcaagagcccttgaacgagaaaccaagagggctcgcaaggaagagtatggctga

SEQ ID NO: 59325 - DNA, 870 bp, Glycine max
  Peptide Sequence Number=SeqID_151010
atgctggcgcttacctccgccacgcgcacgccgggtgaactgtatgacctcgccgaaagcaaaattgaacaggcgatggggcaggtcaggggcgtgggcgaggtgtcgctgatgggcagcgcgctaccggcggtccgcatcgatctgcagccgcaacagctgacgcactatggcattgcgctggatacggtgcgcagcgccgtcgccagcagcaccaccaatctgccgaaaggcatgctgcagggcagcagccagtcctggatggtggacggcaacggccagctggacaaagcagcacagtaccgcgacctgatagtcagctaccacgcgggtaaggcggtgcgactgcatgacgtcgccacggtgtatgactcggtggaggatcagtatcaggccggctttctcaattcacagccgtcggtgatgatcgccatcaagcgtcaggccggcgctaacatgctcgacaccattgacgccatcaaagcgcagctgccacagctggagaaagatctgcctgccgatacccagctcaaagtggtggtggaccgttcgccaacggtgcgcgcctccctgtatgacaccgaagagacgctgctggtggcgatgctgctggtgattgccgtggtatttgtttttctgcgcaatctgcaggcggtggtgattccggcgctggcgctgccggtgtcgctgatcggcacctgcgcggtgatgtatctgctcggctacagtctcgataacctgtcgctgatggcgctgatcatcgccacgggctttgtcgttgatgacgccatcgtggtgctggaaaatatcacccggcacatcgaagccggtctgagtccgctgcgtgccgccctgcgcggtgcccatgag

SEQ ID NO: 59326 - DNA, 399 bp, Glycine max
  Peptide Sequence Number=SeqID_151011
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccaagtcccataccttgcaattggatcccaacagcttactacagaatcctcaaaagtcaaaacaatgtttag

SEQ ID NO: 59327 - DNA, 421 bp, Glycine max
  Peptide Sequence Number=SeqID_151012
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccccagcattctaatgggtggacttctgtctgttcgagaaccttga

SEQ ID NO: 59328 - DNA, 330 bp, Glycine max
  Peptide Sequence Number=SeqID_151013
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatat

SEQ ID NO: 59329 - DNA, 939 bp, Glycine max
  Peptide Sequence Number=SeqID_151014
tatgaagaggtgacagcgggcaatctgggggtgtctattcccgagtttggcaacaactgcgcgggtcgactcattcccggcattaatagcctttcgggcaacatcgctacgctggtgcgcgagatcagggcgtcatcgcaaaccgccatgaccttatcggatcaactctcgtcgcgtagcgcgcagctttcggtgaaaaccgagcagcagtcggcgtctctggtgcaaaccgcagccagcatggagcaaatggcggcaagtaccaaaaacaatgccgataacacccgcctggcgagcgagcaggccaacatggcgacgcgacaggcgcgcaagggcggggagctgatggggcaggtcgccaccaacatggagtccatcaccgaatgcgctcagcagatgacagagattatctcgctgatcgacggcattgccttccagacgaatattctggcactcaacgcggccgttgaggcggcgagggcgggagatcatggaaagggattttctgtcgttgcagaagaggtcagaaacctggcgcaccgcagtgcagaggccgcgaagaatatcaaagcgctgattgaagtcaccagcagtaacgtcagccagggtgccaccgttgtatcggaggcggagaagaatatgcaggagatcgtggcggggtcagggaatgtcagccggctaatggacgaaatttccgcctcgacctcagagcaggagaaagggatatctcagattacgctggcgttgtcagagctggagcgggtcacgcaaagtaacgtggcaatggcggaggaacttaacggctcctctgatgtgctgcgtaaccaggtgattgaactgcaggcccgtacgcgtaatttccggcttgaccagggcacaccttcctccttatcgtccggctcaccctccttccttcagcggccagagcactctctctga

SEQ ID NO: 59330 - DNA, 951 bp, Glycine max
  Peptide Sequence Number=SeqID_151015
atggggaaaaatcaaaacggcaaaagggtttatcaagtcaaggttaaaggtctagatgtcactagcctcaaggaattgggacgattgatgggacccctccaaaggcaagccttccgcaaagtttacgggaagattctagatttgaccatagcggaggtatttacggaagccgtcgtatccctcgcccaatactacgaccagccgttgaggtatttcacgtttggggacttccaaatggtgccaactattgaggagtttgaagagatattaggatgccctctcggggggagaaaaccgtatcttttctccggctttcttccttccttgagcaaagttgcggctgtgattggagattcagcaaaagagttggatcgcataaagcaaattcggaacggcgtagtgggcctgcctcggaaatacttggaagacaaggcaagggatatggcgagccaagagaagtggggcccgtttgcggatgttttagctttgctgatttttggggttgtcctctttccgaacgttgacggcttggtagacttagccgccattgatgctttcctcgcatatcaccatagcaaggaaagtccagtggtggctatcttggcagatttgttcgacacttttgaccggaggggttgtattaattataatcccgcactcgccataagacagctagggtatcccatgaggggagcgccaaccgcagaaagtctctcgcctttccttgcgagggatctaggcgcgcaaggtctcaaggttatacaaagaatccaagaggcgtggaggaggccgttgaggaaagacaaggagcttaggggcatccgtaatggcgtcatcggaggttatcatggatggctaagaattcacacgcgagggttagattggctctccaagttgaaagttatcgatgaggagaactttgaagctacgaaggaagatgaagaagtctga

SEQ ID NO: 59331 - DNA, 624 bp, Glycine max
  Peptide Sequence Number=SeqID_151016
atggataatgaagagggcgtgcaggaacagatgaaggtcgatttatcggccttaaaagatcaaatggcttccatctcggaggtcatgttaaaactccagaaaaccatagaggataaagccacgacaaccgcctccagtacggttagggaagcggagtcggtactgcaacccactttaactccgggccgagacagaaacacggccgtgtttggtcgaaggtatagtccgcaagcttatccttatggcttgcctccagatttcactccccgtgccgccccggaagatttaagccaagcccctacttttgaggggcaactcccgccttatgacgactatcccgggcaagacgatgaggaaggagatacccatcttggccccctgctccacctcaaagatccatccccacatgaactaccccagccgaacatagtccgccatatcccggcctcacccacacccgtaaaagaatctgttcccttcacggaagataaggaaaagattgaggcgcttgaagagaggttaagagcagtcgagggccttggcaattacccattctcagacttagcggatttatgtctcgtgcccaatatcgtcattcctcaagttcaaagtactggactttga

SEQ ID NO: 59332 - DNA, 243 bp, Glycine max
  Peptide Sequence Number=SeqID_151017
atggcctcttcaaattctctatttcttgaaggaaattccatccataggccacctatctttaatgataagtggactgaagaggatagaagaagaatccagtatgatcttaaagccaaaaacattatcacttcagccctaggaatagatgagtattttagagtgtcaaactgcacaaatgccaaggagatgtgggatactctccaacttacacatgaaggcaccactgatgtgaaaagatcttga

SEQ ID NO: 59333 - DNA, 693 bp, Glycine max
  Peptide Sequence Number=SeqID_151018
atgttacggctgatattctctctcgttttgcaggaatacaacaaaatgaaaccttgtaaggtttcctaccaaaatataaagcagaagatgaacttcggtaatcaagaattgccggtacttacaaatgagtttcactaccctggtagagaagctgtgaatgataaattcaattgtctcattgacaatatttggaatattcccaaaaatacaaataataatgagcaatttgtttgttcggtaaaaaagggtatcatctatgctctatacaatttctgcattgcagataaccaaagagttcctcttcttacaaaagcctctccttctggaaaaggctatacagcttttgtcctgttatcgggaccacataaaggtgtttataccaatttcaaagacctttgccttgcaaaggagggtattcaaagcccaatctacaaaggtttctattcaagggaagaagcagaaaaagcccttgaattaaataccacagacattaacaaaataaaaaggtctcttgaaccagaaaacccaaccataatcataaacgctggccaaaccaagaccagccaaaagacctacaaagacacggtcagcccaaataccccaggctcaacaaatgacctaaacttagacaattttaagaaaatacaaagtttattgtttaaggaaagccaggctagacatggaccagtttaa

SEQ ID NO: 59334 - DNA, 393 bp, Glycine max
  Peptide Sequence Number=SeqID_151019
atgggaacgctgcacgactttggctccatagagtactccttctataatagaatacttaccactcggacacagtttctgtgggagccttacacagcaactgttatgtcgatgttgcctcccatttgtttggttggtagtatgtcgtggtgcgcagtggtgccactcatttgtttccatgttgtagagtggcaccaaccggatagagtgttgcgacaatttggaatgcaacaacctattccggagtctccttcgcaaccatggaatgtccacgggctaacactgaaaggcaaaatggatgaaaattggttccagctgttgccccatttatcagtcagtggaataatcgagctgagtttagggtcgacgtttatgctcgacaagagggcctgttga

SEQ ID NO: 59335 - DNA, 312 bp, Glycine max
  Peptide Sequence Number=SeqID_151020
atggtgaaatcagtgggagtacagttccacgaagaagtggaaattaaggaagttagagtgcaagtccttttagcttgtgcctctagtagtaagttcatttcggaaacagaagatactttatcaccattattgatgattattcatattacggttatgtctactaatgatcccgagtttcattttaggcaatggctatatcttttggatgctcatgcgaaaagattctttcaggattatcatggcattccaagtagccctttgaactgtggagcatcaaataggacacctgtgaaagcaccagcatgttcttaa

SEQ ID NO: 59336 - DNA, 861 bp, Glycine max
  Peptide Sequence Number=SeqID_151021
atggctacctcaccaaaagaaacttccgcttctggttcacccgctgtaccatcatctccgcaccaggaacaaccggaattcaagattcaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagtcctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaagccgaaagggaaaaacccccatcaagaggtctggacggatcaagactatggcccagaagaagagcactccagtcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctgaaaatgttcctgatgcaccattggacaacatctctttccactccattggcaatgttgaaaagtggaaatatgtgtatcaacgcagacttgcgggttga

SEQ ID NO: 59337 - DNA, 330 bp, Glycine max
  Peptide Sequence Number=SeqID_151022
atgagggacgacaagaggtttttgtatgtcattgggatcagggtgaattctggagttggccttgggggaaagttcctcgtcgcgttggaaccggcgccaaagtgggcgttgccgcccgggcgagtcgtggttggagctggagcttggagggcctccctctggatgggtgcgggcgctctaggctatacgggtgctgaattggaagagtccccggcgcgagctgagaagctcggttgctccgatcctcctagcattggaacttatgaaggagacctaatcgaacttccctctcttcaaacctacttcgattctctccccggcaaataccaa

SEQ ID NO: 59338 - DNA, 656 bp, Glycine max
  Peptide Sequence Number=SeqID_151023
atggaagaatttaaggagattttaggatgccctctcgggggaagaaaaccatatcttttctctgggtttcttccctccttgagcaagattgcagttgtggtcggagattcagcgagagagttggatcgtatgaaacaaactcgaaacggcatagtgggcctaccgcagaaatacttggaaggcaaggcaagggatatggcgagtcaagaagagtgggtcccatttgtggatatactagctttgctgatctttggggttgtcctctttccaaacgtggacggtttagtggacctaaccgcaattgatgctttccttgcatatcaccatagcaaggagagcctggtggtagctatcttggcggacttatttgatacatttgaccgaaggtgcgagaagaacagcacatggattgtctgctgcttacccgccctttgtgtgtggttggtttcatgcctattccaacaagacataagacgcccgtgtccgcttcaaagttatcgctcgtgtgtcgaaaagagaagagtcgattgggatcaatacttggctgggataagaggcagtgcaatcaactggtttcctcgatggaaggaaggaaatgagggagttcttttctcatatggggactacccaaacgtcccgttgatagggacgagggg

SEQ ID NO: 59339 - DNA, 390 bp, Glycine max
  Peptide Sequence Number=SeqID_151024
ttgattgtgctttacgtggttttcaagcttgacgagagttacacgccgagcaaagtttccatccgtgccggtgatggttttcacaacttgaaggagattaagaccgtggaactcgtgaagccaactgggtgggtttatctatccttgtctggagctgatcctaggacctgggctcttgtcattgccacattcccaaacaacattctgaatttcaatctcctgaaaaggggccacaagcatggaattctactgttggtctatggttttgaaattgataccatcaatcttaggtctctgaaaatctgcttcttggaatctgttggagaagaaggttttgatttcttccttcaccttattaggttcatttgtccattcaccttcaatgagtag

SEQ ID NO: 59340 - DNA, 396 bp, Glycine max
  Peptide Sequence Number=SeqID_151025
atggcaacgcagttgatccatgatcacgttgtgatggagtgcctagagggtgtttgggagaccctcgaaggcaatgggaggtgccgattccgaggcacaattcgactcactgctacttcgctacctgtggggtggatactacctacacctactccatatcgactagttgagccggttcaagtgatagaggtgtcatcctctgaagaggatcttgaagaggacccagaggagttacctcctgaacctgctatggacgcccctgacttaccagaggatgatgaggacccactccctgatgttgattctctagaggatattatgtcagcatctgaggcagactctacagaggagagtagccctggagggacaacaatttgtgacgactcttcatcgtag

SEQ ID NO: 59341 - DNA, 231 bp, Glycine max
  Peptide Sequence Number=SeqID_151026
atgacgggtggaaaacctctgacacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 59342 - DNA, 259 bp, Glycine max
  Peptide Sequence Number=SeqID_151027
atgttgagcttagctcatcagtgggctaagcgcgcatccaccgctaagcgcaacttcagcacacttagcgcgatagaagaatctggcagggcatcaatatcaaggtcgcgtgctaagcgcaagatcaatgcgctaagtgcagcagttgtcttcagccagctcagcgcacgactggtgctaagctcaaatccacttactcgcactaagcgcaagggtggcgctagcgcaacgtcgcagattcagagcctatttaaagctt

SEQ ID NO: 59343 - DNA, 375 bp, Glycine max
  Peptide Sequence Number=SeqID_151028
atgaacagtcaagaaattgatgtggccaagagctactcaatagaaaagtctcaaaggacacctgtgttagaactctacactcaagaaattttggttggtaagctggcagaagaagtgactcaatgtgtggccagaatagaagaagaccttgtagagattgaagctcaagaggaaatcccttccaaagagcatggattaagaggaaaagatgaaatgaaaggtgaggaaaaagcacaacaatgggaagagtacttacaacaagatattcaacaagaaattaaaatttttgcaattgtctatccgctaagtgcaaaccttgcgctaagcgctcagtcttcacacgctaaaccgagcttgctcgcgctaagcacatag

SEQ ID NO: 59344 - DNA, 174 bp, Glycine max
  Peptide Sequence Number=SeqID_151029
atgcgcggagtcgccaccaacgtttattcgaggaaaacgtcggaaaaaccggaaaggtgtggtctacgaactttaagtgtgaaaggtttgggagttatatctatgcacggggaagggtgtttcccttgctcctacatattcctcaattgtgatgaggaaatcagacctatgtag

SEQ ID NO: 59345 - DNA, 656 bp, Glycine max
  Peptide Sequence Number=SeqID_151030
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgatcagccgctacatgctgctatccgtgattgacaacattgatcaagagcaagcaatgaaatataaaagcacaattgatgcacaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 59346 - DNA, 396 bp, Glycine max
  Peptide Sequence Number=SeqID_151031
atgaaaagagaaaaacatgtctcctatagtagtcataactcttgcaagagcctaagtgcagaacttcgtgactattacgaaggaaggcgtatgtcacatcttagacctcactcacataggagagaaaaggaaagaatgcctcaaggggctaacattaacctcccatacttctataggaaggacaatgtagaggctaacttagattggaaaataagggtagagcaacaacataaaaagaagtctacgtcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagtctataa

SEQ ID NO: 59347 - DNA, 759 bp, Glycine max
  Peptide Sequence Number=SeqID_151032
atggctgaggtcaccaacattcccaatcccggccacacatcgtcatggtatgcggcctccgccaatgtcaaaaccgtgcgcccgacgcttgagggcgcgctggaagccgatgtctgcgtgatcggcggcggtttcaccggcatttccgccgcccttgaactcagtgaacgtggctacgcggtcattgtgctggaaggcgtgcgggtgggcttcggcgcatcggggcgcaacggcgggcagattgtcaacggttacagccgggatctcgagaccatcgccggccgctacgggcatgacaaggcagtgaagcttggggagatgtcgcttgaaggcggcacgatcatccgcaaccgcgtcaccaaatatgccatcgactgcgatctggtcgacggcggtttcttcgccgccttcacgtcaaagcagattcgcgaaatggaggcacacaaggcccattgggaaaaacatggtcatggcggcctggaaatggtctccggagcggatgtcggccgctacgtgaagaccgatcgttacgccgggcgaggcggcggctgccgaaagcctgggcgctcggatattcgaaaattcgcgggtcattgcggtagagcagggggaaaaccccgtcgtgcggacggcaacgggcagcgtgagggcgaaatatgttctcgtttgcggcaatgcttatctcggcaagttgctgccggaaattggcgaacggatgatgccggtctcgagccaggtcatggcaacggagccgcttaa

SEQ ID NO: 59348 - DNA, 318 bp, Glycine max
  Peptide Sequence Number=SeqID_151033
atgtctcccgaacaatttcagtacatatggcgcaagacgattccacatatcgaggtcggaatgggatcgggtgttttcacgtctcaccgtagtgcccgcccgcattccagcaagctagccccgttgggggaagagggcttttccatcgcgaaggattccatccagccacaggttcccctacggctaccttgttacgacttcaccccagtcgaagaccccaccgtgggcccgggtacatattcaccgcggcatgctgatccgcgattactagcgattccaacttcatgttcccgagttgcagagaacaatccgaactga

SEQ ID NO: 59349 - DNA, 222 bp, Glycine max
  Peptide Sequence Number=SeqID_151034
atggcttattccctagtggttggcgcctcctctcacctcttctcctttgtcttccactgcatctccttgggagacctggtgctgaaaaagatgtcccatgctgtcaaggacaatcgttgtgaaaagggcttttactggaggagcctggtacttaccaacatggatggcgaggaacaacctttacctgtgaactctgatgctgtcaagcgatactatgcttag

SEQ ID NO: 59350 - DNA, 573 bp, Glycine max
  Peptide Sequence Number=SeqID_151035
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgttatcgccccctccaatggattaacgagattcccactgtccctgtctactatcccagcgaaacccacagcctaagggatcggggcttggcggaatcagcggggaaagaagaccctgttgagcttgactctagtccgactttgtga

SEQ ID NO: 59351 - DNA, 408 bp, Glycine max
  Peptide Sequence Number=SeqID_151036
ggtatcgcacccaagagacacccagtggacccggaaaagtccaacagggccttggggtttccagctctggttacgggcctctatcagtcctacagggtgctcgtacccccccgacaaggtcacatcatcatagggatcgcgcctgcaagacacctagtggacccgaagaagtccaacaggttctacggagtacctgtcacctccagcaagggcatcaggccccctactaatcgagctttcatcaagaagtactgtgtctctaggcaggcgcaggacgaaacaccacagcagcctggggatgacgcaccgccaccacctttagagttcacctctgctcatccacaaaaaggtttgagtattgcctacgacacatggccgaccaataggcaaccaagtccaaagccaaag

SEQ ID NO: 59352 - DNA, 817 bp, Glycine max
  Peptide Sequence Number=SeqID_151037
atggggacgaggggttgcatcagctacaatcccgttcttgctataagacaacttggctaccctatgagaggggcaccactagaggatgagctcgcacctgtcatttcacgaggcttcaataagaccaacgtggagacacttcagaaggttcgcaaggcatgggaggtgttgcaaaagaaggacaaggaactcaggggcagtaacaatgggctcatcggtggctatcgtaagtgtttgagaaccgctaaaagggaggaagttgaggcaccggaggaagacgaagaggtgcaggcccttaggatggaactcaagcaagctcaaacagtcaaagaaaggttcaaatcagcagctcttaaaatccaaaaggagaatgccgaactgagagatataaatatagctaccaccaaggctttggaacaagagaccaagagggcttgtagggaagagcacggccggaacaagttccgaggggctctgtggggtagcaacagcgaccttaaactccgaagagaggaaagggaccaatcacgagtagacaagaccaacatgttagctattatcaccaagtaccaagaagaactaaatctagccgcggcccacgagcatagagtggcggacgagtatgcccaagtgtacgcagaaaaggaggctagaggaagggtgatcgactcattacatcaagaggcaacaatatggatggaccgattcgctcttaccttgaacgggagtcaagaacttccccgattgctagctaaggccaaagcaatggcggacacctatttcgccctcgaggagatccacgaacttctcggctatt

SEQ ID NO: 59353 - DNA, 386 bp, Glycine max
  Peptide Sequence Number=SeqID_151038
catggggaacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccatagcagaggtatccatagaggccattgcatcactcacccaatactacgaccagcctttgagatgcttcacgttcggagacttccaattggggaagaaaaccatacctttcctccgggtgactcccctctttgagcagaattgcaactgtggtcaaggattcagcaagaggtttggatcgcataaaacagactcgaaacggcatagcgggcctaccacgaaagtacctagaagataa

SEQ ID NO: 59354 - DNA, 301 bp, Glycine max
  Peptide Sequence Number=SeqID_151039
gctatctgttgagaagctagcttccactgtgctttggaaactctccactccatgcagctatactgaaacggaatcctggggctggtacatgtttccaatgcttcctcattccatgtttggatactttgttttgaatggtgttcattcaattatttctttgattcttgctttcattttggaccgtgctgctcatcatcacagattcccgtttgagattggatgcaatgattcttgcggacagtttgcattaatcattgtattcaatcttgaattgtccgtttggacagtttggggagactga

SEQ ID NO: 59355 - DNA, 447 bp, Glycine max
  Peptide Sequence Number=SeqID_151040
atgggtaaagcagaggaggtgcaagagaaggtgaaggccaacatggaggccatgaaagagaaaatggccacaatgatggaggccatgatgagcatgaagaagataatggaagtcaatgcggttacaattgtcgctaccagcactgttgctaaggtgaacctgatgcccccatctggcctcaaccaaatgaatcatccaaccttagatatggtaggcaaagatttgggaagtagggacgacctccatgatgtgcaaaatcaaaataagcacgccttcccgccatatggcctgcctcccaactatacaccacccaatgtggcgtacactctcaatggggatgtcaataactccactcctatatccattgagagccaacaaccccgaactatcatgcacatgtctcttaaaccttgggggagacacatgaaattcctcaccacaatctag

SEQ ID NO: 59356 - DNA, 637 bp, Glycine max
  Peptide Sequence Number=SeqID_151041
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccccttactttcgctctgacgagtgcaagaaattcgccaaggtgcacaaggtgttcggggcaagcaatgtgagcaagatcctcgttgaggttcctgaggaacagagggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtgggctaactacg

SEQ ID NO: 59357 - DNA, 387 bp, Glycine max
  Peptide Sequence Number=SeqID_151042
gtcgactctagaggatcccctgcacctgtcgccagactctgtggtttatgctcctctgctgaccaccacacagacctttgcccttctgtgcaacaatctgaagcaattgagcagtctgaagcttatgctgcaaacatctacaacagacctcctcaacctcagcagcaaaatcagccacaacagaacaattatgacctctccagcaacaggtacaatcccgggtggaggaatcatcccaaccttagatggtcaaatccttcacaacagcagcaacaacaacaacaaccttattttcagaatgttgctggcccaagcagaccatatgttcctccaccaatccagcagcaacaacaacaacaacagccccagaaacagcaaacagtttag

SEQ ID NO: 59358 - DNA, 453 bp, Glycine max
  Peptide Sequence Number=SeqID_151043
atgaccaccttgacccagacgtggatgacattgctgcttagcaatgtcttgcctagcgatcataactccgatctccctctgccgaagtatcagttggtgtatgccatcctgacacggatgagcgtccacgtggcccaggtgatcgttgacgccatctatttgtttgcaggtatgccacccaccaggcaccctctagacccggataagtctaacagggccctggggtttctagcattgatcacgggcctctgccagtcattcggggttcccgtcacccccagtaaggtgatccgaccgccgatcacccgggccttcatcgagaagtattacacgcctaggcaggcgcagggtgatgcacctcaggccgcagacgcaccgccaccacctcatcaggccgatcccgctggatcactaggcatggagtgttatctacaacacttggttcgccagtag

SEQ ID NO: 59359 - DNA, 1702 bp, Glycine max
  Peptide Sequence Number=SeqID_151044
cccgtatctgcagctgccgattggtgaccgccgccgctccggcttcctgatccccaacgcgaaatacggcagcaacaacggcttcgaattcatgctgccgtactactggaatatcgcgcctcaggtcgatgccaccattacgccgcactacatgagcaagcgcggtctgcagttgcagaacgagttccgctacctgacgcagtttgttgccggcctgttagagctggactatctgccgtctgacaatcagtacaacaaagacaaagccgcgcgaccgtcggtgcagaacgacagcaacgacgaccgctggctgttctactggcgtcactccggcgtctacgatcagcactggcgcttcaacgccgactacaccaaagtcagcgatccttattacttcaacgatcttgattcgaagtactacagctcgactgacggctacgccacgcagaaattcagcgtaggctacgctgacaccaactgggatgcgacgctgtccagcaaagacttccaggtgtttggtaataccagcagccagaacgtgtatcgggcgatgccgcagctggatgtcaatctgtaccagaacgatatcgggccgtttgacggtcgcatctatgcgcaggcggtgaagttcactaacgtcagtaaccgaatgccggaagcgacacgtttgcacatcgagccaacgctcaacctgccgctgtccaacggctgggccagcctggataccgaggcaaagctgctggcgacgcattaccagcaggataacgttaactactacaacgaaaatatcgataccacccgcaccaatcagctgaaagagtcggtcaaccgcaccctgccagcagttcaaggctacacccagacgctggaaccgcgcgtgcagtacctgtatatcccgtaccgcaaccagagcaacatctatccgtacgactccacgctgctgcagaccgattacaccggcctgttccgcgatcgcacctacagcggcctcgatcgtatcgcctcgtctaacgaagtggcgaccggcgtgaccacgcgtatttatgataacgatctggttgaacgttttaacgtttccgtgggtcaaatctactcgtttaccccgtctcgtaccggcgtaaaccagacgaataaagaagatgataccggtagcctggtgtgggcgggtgatacttactggaaagtcagcgatcgctggggcgtgcgcggtggcttgcaatacgatacgcggctggacaacgtttcccagggcaatgccattgtggaataccgtcgtgatgccgaccgtatggtgcagctgagctaccgctacagcagcccggagtatgtggcgcaggctttaagtggttcaggtttgattgacaaccctagctaccagaagatctacaaaaacggtatctcgcaggtgggcgccacggccagctggccgattgccgatgcctggtcgctggtggggggttactactatgacacccgtaacagccgtccggccgagcagctagtcggtctgcagtacagctcctgctgctacgccattcgtctgggttacgaacgcaagatcaacggttgggaaaacaacgacagcaagtatgacaaccaaatctcattcaacattgagctgcgtggtctgagttctaactatggcttaggcaccaatgaaatgctgcgtcagggcatcatcccttatcagcgcgctttctga

SEQ ID NO: 59360 - DNA, 3147 bp, Glycine max
  Peptide Sequence Number=SeqID_151045
atgccaaaacgtactgacataaaatctatcctgatccttggcgctggcccgattgtgattggccaggcatgtgaattcgactattcaggtgcgcaggcgtgtaaagcgctgcgtgaagagggataccgcgtcattctggtgaactctaacccggccaccatcatgactgacccggaaatggcggatgcgacctacatcgagcctatccactgggaagtggtgcgtaaaatcattgaaaaagagcgcccggatgcggtgctgccgaccatgggtggccagaccgcgctgaactgtgcgctggagctggagcgccagggtgtgctggccgagtttggcgtgaccatgattggtgccaccgccgatgcgattgataaagccgaagaccgtcgccgcttcgacgtggcgatgaagagcatcggcctggataccgcacgttccggtatcgcgcacaccatggaagaagcgctggcagtagcggaagaggtcggtttcccgtgcatcattcgtccgtcatttaccatgggcggcaccggtggcggtatcgcttacaaccgcgaagagtttgaagagatttgcgagcgcggcctcgatctgtcgccaaccaatgagctgctgattgatgagtcgctgattggctggaaagagtacgagatggaagtggtgcgtgataaaaacgacaactgcatcatcgtctgctcgatcgaaaactttgatgccatggggattcacaccggtgactccatcaccgtggcgcctgcccaaacgctgacggataaagagtatcaaatcatgcgtaacgcctcgctggcggtactgcgtgaaatcggtgtcgaaaccggcggttcaaacgtccagttctcggtgaacccgaaagatggccgcctaatcgtcattgagatgaacccgcgcgtgtcgcgctcctcagcgctggcctcgaaagcgaccggcttcccgattgccaaagtcgcggccaagctggcggtgggctttaccctcgatgaactgatgaacgacatcaccggtggccgtacgccggcctcgttcgagccgtccatcgactacgtcgtcaccaagattccccgcttcaacttcgagaagtttgccggtgccaatgaccgcctgaccacgcagatgaaatcagtcggtgaagtgatggcgattggccgcacgttccaggagtcgatgcagaaagcgctgcgcggtctggaagtgggcgccagcggcttcgacccgaaagtggatctggatgatggcgaagccctgacccgtatccgccgcgagctgaaagatgccggttctgaccgcatctggtatatcgctgatgcgttccgtgccggcatgtcggtcgacggcgtgttcaacctgaccaacgttgaccgctggttcctggtgcagattgaagagctggtgcgcctggaagagcaggtggcgcgcgaaggtgtcaactcgctgagcgcggatttcctgcgtgcgctgaagcgtaaaggctttgccgatgtgcgtctggcaacgctggccggtgtggcggaaagtgaaatccgcaagctgcgtcatcagttcaacctgcatccggtttacaagcgcgtggatacctgtgcggcagagttcgccacggacaccgcctacatgtactccacctatgaagaagagtgcgaagccaatcctaatcaggatcgcgacaaaatcatgattctgggcggcgggccaaaccgtatcggtcagggcattgagttcgattactgctgcgtgcatgcggcgctggcgctgcgtgaagacggttacgaaaccatcatggtcaactgtaacccggaaaccgtgtcaactgattacgacacctcagaccgtctctacttcgagccggtaacgctggaagacgtgctggagatcgtgcgcatcgagcagccaaaaggcgttatcgtgcagtacggtggccagacaccgctgaagctggcgcgcgcgctggaagcggctggcgtgccggtgattggtaccagcccggatgccattgaccgcgcggaagaccgtgagcgtttccagcaggcggtggatcgcctgaaactgaaacagccggctaacgccacggtggcgacgctggaacaggcggtagagaaagccgcagggattggctatccgctggtgactgcggtgtccgtgtccaacgatgcgccagtgctgctggatcgcttcctcgatgacgcggtggaagtggacgtcgatgcgatttgcgacggcgaacgcgtgctgattggcggcatcatggaacacatcgagcaggcgggcgtgcactccggtgactcagcctgttcgctgccagcgtacaccctgagcactgagattcagaacgtgatgcgccagcaggtggaaaagctggcctttgaactcaacgtacgtggcctgatgaacgtgcagtttgcggtcaaggacaacgaagtttacctgattgaggtgaacccacgtgccgcgcgtaccgtgccgtttgtctccaaagccaccggcgtgccgctggcgaaagtggctgcgcgcgtgatggctggtaaaaccctggctgaacagggcgtgaccgaagaggtgattccgccgtactactcggtgaaagaagtggtgctgccgttcaacaaattcccgggcgtggacccgattcttggtccggaaatgcgttcgaccggtgaagtgatgggcgtgggccgcaccttcgcggaagcattcagcaaagctatgctcggcgcgcagagcaatatgaagaagcaggggcgtgcgctgttgtcggtgcgtgaaggcgacaagaaacgtattgttgacctggccgcgaagctgcagaagtttggcttcgagctggatgcgacgcacggtaccgccgtggtgctgggtgaagccggcatcaatccgcgcctggtgaacaaggtgcacgaagggcgtccgcacattcaggatcgcctgaagaacggtgagtacacttacatcgtcaacaccaccgcaggacgtcaggcgattgaggattcgaaactgattcgccgcagcgcgctgcagtacaaagtgcattacgacaccacgctgaacggtggttttgctaccgcgatggcgctgaatgcggatccgaccgaaaaagtgatttcggtgcaggaaatgcacgcgcagatcaaaggctaa

SEQ ID NO: 59361 - DNA, 1146 bp, Glycine max
  Peptide Sequence Number=SeqID_151046
atgtatctgaaaggctcggatcagcatcgcggctggttcatgtcgtcgctgatgatctccacggcgatgaaaggcaaagcgccttaccgtcaggtactgacccacggcttcaccgtcgacggtcagggccgcaaaatgtcgaaatccatcggcaataccgtggcaccgcaggatgtaatggacaagctgggcgcggatattctgcgtctgtgggtggcttcaactgactactccggtgagatggcagtatccgacgaaatcctgaagcgggccgccgacagctatcgccgtatccgtaacaccgcgcgcttcctgctggccaaccttgcaggcttcaacccggcgaccgactgcgtcagcccggaagagatggtagtggtggatcgctgggccgtaggccgtgcgctggcggcacagcaggacattgtgcagtcgtacgagaactacgatttccacgaagtggtgcagcgtctgatgcatttctgctccatcgagatgggctcgttctacctcgacgtgatcaaagatcgccagtacaccgcgaagggcgacagcctggcgcgtcgcagctgccagaccgcgctgtggcatatcgctgaagcgctggtgcgctggatggcgccgatcatgtcgttcaccgcggatgagatctggggctatctgcctggcgagcgtccacagtacgtgttcaccgaagagtggtatcagggcctgtttggtctggcgcaggatgaagcgctgaatgatgcttactgggcagaactgctgaaagtgcgcggtgaagtgaataaggtgatcgagcaggcgcgcagcgacaagcgcatcggcggtgcactcgaagccaccgtcacgctgtacgccgatccggaactggcggcgaagctgcaggcgctgggcgatgagctgcgtttcgtgctgctgacttcgggcgcgaccgtggcggattacgtgacggccagcgacgaagcgcagcagagcgaactgttaaaaggtctgaaaatcgcgctgcataaagcagaaggcgagaaatgcccgcgctgctggcattacactactgacgtcggccagaatccggagcatgctgcggtgtgtggacgttgctacaccaacgtagccggaaacggtgaagtgcggaaatttgcctga

SEQ ID NO: 59362 - DNA, 306 bp, Glycine max
  Peptide Sequence Number=SeqID_151047
atggccaacaaaacaagttgtccaatgaaacaaaaaccccccacacttattcccaaaacaattccaaagctccaaaattccttaaggatatgtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 59363 - DNA, 201 bp, Glycine max
  Peptide Sequence Number=SeqID_151048
atggtaggttacacaccttcaagctttgcggatttagttttcgccggcgaaaggatcgaagttggtctgaaaagaggcaaatttgattatcctgctttgatgaatgagaaagctggggcaaatgaagagaatgagaaggagggaggaacccatgttgtgactgtcattcctacatggccaaatctcccaccaactccataa

SEQ ID NO: 59364 - DNA, 313 bp, Glycine max
  Peptide Sequence Number=SeqID_151049
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggttttcccagtcacgacgttgtaaaaacggacggccagtgccaagcttgcatgcctgcag

SEQ ID NO: 59365 - DNA, 574 bp, Glycine max
  Peptide Sequence Number=SeqID_151050
gttacagattgtaccatttgtggtgaggctcatgaaacaggccaatgtatttccactgaagaaaacactcaagaatttcattatatgggaaatcaatagcgacaagggtatactcaaggaggattttcaggcttccagcagggtccctataatcaacaaggacaatggaggacacaccctggtaacaatgtcaaatcataaaagcactgagtcagcactgaagaaccttgaggtccaggtgggacaattggccaagcagatggctgacaagtcatccaacagttttgtggaaaatatagaacaaaatcctaaggaagaatgcaaagctgtgatgacaaggagtaaaaggtttgtggaggctaaggatgtggatagtgttgtgcataagaagaaaactgctgacaagaaaggtactgatggtaagaaaaatgagagaaaaaataataagaatgcaaagaagagtagaagtgaaaaagctgtggatgaaggtgtggaagtaccatatcctgtggtaccttccaagaaagaaaaagatcgtcatctagcgagatttttagatattttcaggaaatag

SEQ ID NO: 59366 - DNA, 162 bp, Glycine max
  Peptide Sequence Number=SeqID_151051
atgacgaggccccggccccactgtaaggtgtctccgcgggttaccaactcttgggtcatgacagcaaaaggtggtgtggtcgacaaaagcaaggctcttgctcctacgtatcctccaatgaggaactcagactgcggggcgaaaaagtcgctagcgcactga

SEQ ID NO: 59367 - DNA, 1177 bp, Glycine max
  Peptide Sequence Number=SeqID_151052
gatcctttacatgtaagacctatagctcatgcaatttgggatcctcattttggtcaaccggctgtagaagcttttactcgaggaggtgctctaggcccagttaatatagcctattctgcgggttggttacacttgcaaccaaaatggaaaccaagcgtttcgtggtttaaaaatgccgaatcccgcctcaatcatcatttgtcaggattattcggagtcagttccttggcttggacagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagggtctttatgacacaatcaataattcaattcattttcaattaggtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaata

SEQ ID NO: 59368 - DNA, 354 bp, Glycine max
  Peptide Sequence Number=SeqID_151053
atgcacgaacagcgcttggcaatcaattcgtggggctacggactcgatggtggaggttgcatgaatgttcatggggctgcgacgctaggcaatctattcgtggggatccagactcaatggtggaggatgcatgaacgacaatcaattcatgggactccgaataagattagattgtggaggatgcatgaacaacgcttgacaatcaattcgtggcactccggactcgatggtggaggatacatgaacgacaatcaattcatggggttccgaataagatttgatgatggaggatgtacgaacagtgctaggcattcaattcgtggggctccggactcgatggaggaggatgcatga

SEQ ID NO: 59369 - DNA, 570 bp, Glycine max
  Peptide Sequence Number=SeqID_151054
atgcgagcacatccagagagggaggctatcacgcatctactatgcataccggggcaagatttcacccgtgccgctgcaaaaagacgagcgcggatcatgcgcaccaacatgaccactcttacatggatatggatgacgttgctatttagcaacattctgcccaacgaccataatgccaatctccccctgcagatgtatcaattgggatcgcgcccacaagacgcctcagtagacccgaagaagtccaacagggccttggggtttccaactctgattacgggtctcgtcagtcctacagggtgcctgttccccccggcaagggattgcgcctgcaagacacccagtggacccgaagaagtccaacagggtcttggagttttctacggagtgcttgtcacctccggcaagggcatcaggccccctactaatcgagctttcatcaagaagtactgcgtccccaggcaggcacagggcgaaacaccacagcagcctggggatggccggcagcgagcaacagacgcaccgccatcacctctagagttcacctcagctcatccacaaaaattttag

SEQ ID NO: 59370 - DNA, 195 bp, Glycine max
  Peptide Sequence Number=SeqID_151055
atgtctcaagcttcatcctcctcagtttttattttaccggggaacactcaagatttagagggctatgaattcttcacggatgggtgcggtcatacctgtgcctatctttacttccttttttcccactgccggttcctaagtccacaagttccgtctcttcttgatgaggtcccatctcttggtcctcatgggtga

SEQ ID NO: 59371 - DNA, 423 bp, Glycine max
  Peptide Sequence Number=SeqID_151056
atggtggcgcgcgttatgctcagaaacggatttgagcccggaatgggtctaggcaaggactgcctcgtgaatgccgacgtggtcgatatcaagggaaatccatacaagtatggattagggtatgaacccgggatgtcgcggaggaagaacgtgccgtcaagatttcgggcggatagggtatggcccgaccgtattagccagtgtttcaccagcgctggaatggtgtccgaggaggaggtggccgcaatagaagaggagttccctcaagacccaccaaatatgaggggtcgattctttgaggatcctgacaacgagggtttgacaatcgatttcgatcgagatataagccaaacgataaataaggagggaagaggacgtcctgtcgccagagttggagaggttggtcgctcaggaagaacgtga

SEQ ID NO: 59372 - DNA, 897 bp, Glycine max
  Peptide Sequence Number=SeqID_151057
atgggatcaagtcaaaagccttcgcttaaaatgaggttctatcaagtcaagatcaagagcttagaggtcaccagtttacgaaagttggggcaattaatgggtcaacttcaacagcaagccttccgcaaagcctacggtaagatttgggacctagctagggtagaagtctccatggaaccgattgcatccctttcccagtattatggccagcccctaaggtgcttcacattcgaggacttccagctagtgccgactgtgaaagagtttaaagaaatcttgggatgcccactgggcggaaggaagccatatcttttctctgggttctatccctccacgacaagagttgccaaggtagtgaaaatctcagcacaagagttgaaccaggtaaagcaaaacagaaatggagtagtcggagtaccgagaaaatatttggaggtaaaagcaagaatcttggcagataaaggcgagtggaccccagtcatagatattttcacactgttgattttcgagggagtcctctttccaaatgtggatgggttggtggacctggcagcaatcgacgtttttctcgcctatcataaccacaaggaaagtccggttgtcgctatgccagccgacctatatgacacctttgaccgaagatgtgaagaaagcaatgcaaggattgtttgttgtactccagctctctatgtggggctggtttcacacctttttctccaagaaggtaggcccgtctatccgctacaaggttaccgctcttgcgtcgaaaaaggaaaggcgaattgggaccaactcttggctagcatggaggggcgtctgttaattggttccctcgctagaaggaaggaagaatcaggattctatcttcatgcgaaggatgtccaaatgttcccttga

SEQ ID NO: 59373 - DNA, 231 bp, Glycine max
  Peptide Sequence Number=SeqID_151058
atggatattcatgctttgtgggaaaaaagggaaatggctccgaagaaactctccacgacgaggtctagaagagacgccacaggagaagggtccagtgccgctcccgagtttgatagtcatcgtttccagagtgccgagcaccagcagcgcttcgaggccatcaaaggatggtcgttctatagggagaggcgtgttcagctcagagaggatgagtatatggactttcagtag

SEQ ID NO: 59374 - DNA, 441 bp, Glycine max
  Peptide Sequence Number=SeqID_151059
atggagggaggcataggtctcatactagacctcactcccaaagaaaagaaagggatagaaggtctcaagagagagaaagttccattggctacctttagcatccaagggaagaggcacattccctcctacaatgaaagagagcttatggacaagctccaaaggcttagacaagggaagcttagggaggaggaaagaacaagcatagctaggttccttagtgggcttaatatggaaatgaaggacaaggaagataagggtaagaccatagagaaatccacccatatactagttcccaagcaaggactagcaacattaaatgcttcaaatgtcttgggagaggagactacttcttccctttcctctaatggaagtgaagatgaaacaaggggtgaagagtatagtgaggaagtctacccccatgaagaaggtgacctcctaatg

SEQ ID NO: 59375 - DNA, 352 bp, Glycine max
  Peptide Sequence Number=SeqID_151060
atgcaagcgttatccggaatgattgggcgtaaagcgtctgtaggtggctttttaagttcgccgtcaaatcccagggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaag

SEQ ID NO: 59376 - DNA, 213 bp, Glycine max
  Peptide Sequence Number=SeqID_151061
atggtgaaagttggaacctcttacgtgccgatcaaacgtctcattttcgccaaaagttggcccagggctttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 59377 - DNA, 378 bp, Glycine max
  Peptide Sequence Number=SeqID_151062
atggctccgagaaagctttccacaaagagatctaggaaggacgccgcggccgaagggactagtgccgctcccgagttcgacaaccatcgtttcaggagcgcggagcaccagcagcgtttcgaagccattaagggatggtccttccaccgagagagacgtgttcagctcagggacgacgagtacacagatttccaggaggagatagctcgccggcgttggacgtcgctggtcactcccatggccaagtttgatccggatatagttctcgagttttatgccaatgctggcctacagaggagggcgtgcgggacatgcggtcatggacgccctcagccagttcctgggatacccgctagtgttggaggagggcccaggagt

SEQ ID NO: 59378 - DNA, 279 bp, Glycine max
  Peptide Sequence Number=SeqID_151063
atggcaagttcaacatgctttcaacaaatttcttcacaaataactatcatgaagcagaaacctagcaaaattacccatcatatctcccaaaacccaatacccacgaaaatcaaagatgcgcttcatgactccgaaaatgcgttcctttcgcgatttggagcagaaaaggtgtgcaaaggttggagctttgatggagcttcaatggtggaggaagaagagagaaagctacgtgagagagggagagaaaaggcttctgaatttttttttggggctgagtga

SEQ ID NO: 59379 - DNA, 246 bp, Glycine max
  Peptide Sequence Number=SeqID_151064
atgaacttaatcattgttatcaaaaggaaagaacacgctttacggtgcccttaccgaacccgtgctagagtaatgggtgaagtggaggaggtgcaagagcaggtgaaggccgacacggaggccttaaaagagcaaatggccacaataatggaggccatgatgagcataaaggagataatggaggtcaatgcggttgcaatagccgctaccaacaccattgttgaggtggacctgacccccccatag

SEQ ID NO: 59380 - DNA, 546 bp, Glycine max
  Peptide Sequence Number=SeqID_151065
atgactaccctgacccagatatggatgacgttgctgctcagcaacatccagcccagcgatcataattccaacctccccctgccgaagtatcagctagtgtatgccactctgacatggatgagcattcatgtggctcagttgatcactgatgccatttgtctatttgcaggtatgccacctaccaggcaccctttagacccagataagtctaacagggccttgggttttctggcattgatcacgggtctctgccagtctttcggggttcctgttgcgcccagtaagcagacggccaaccaccgggtgcacgtgcagacccatgactctctatatcagcttagcctcagcctgcagagccagggttttgcttcttttccatgccctactccggatcagttcagggcagaggtcgcatggccaggagattggcttgaggcccaggcaggggaggcatccgcagaggctcccgacgaggcagatgaggcccacgaggacgaggagatgaccgatttgcttgatttcttgggagggagcggagccacatga

SEQ ID NO: 59381 - DNA, 183 bp, Glycine max
  Peptide Sequence Number=SeqID_151066
atggaagttggtataggcaaagaatttaggggcatcaaatcacatgtgaagcaagaacaaattggcagaactctagtgatagacagagacaccagggttggcatcaatttaggaggaaagggaatgtgtttgggctacagtttctgttcttttaaggagataggctccattgtttttaggtaa

SEQ ID NO: 59382 - DNA, 165 bp, Glycine max
  Peptide Sequence Number=SeqID_151067
atggagtttatgtcagaaacacagattctggtttatggagaaaccaaagacacctcacttcttggcagcaaagaggattctgagatgataggaaaaacactgctgggtatgttttcaaatttggaacatcaccaatctcttggtgctcaaagaagcagagtgtag

SEQ ID NO: 59383 - DNA, 690 bp, Glycine max
  Peptide Sequence Number=SeqID_151068
atggggacaaggggttgcatcaattacaatcccgttcttgcgataaggcaacttggctacccgatgaaaggggcaccactagaggaagagctcgcacctgtcatttcacgaggcttcaataagaccaacatggagacacttcagaaggtctgcaaggcatgggaggtggtacaaaagaaggacaacgagctcagaggcagtgggcccattggtggctaccgtgagtggttgaaagcccacgtgcaaggtttggattggctcccaagtttgagaaccgctaaaagggaggaagttgaggcagcggaggaagacgaagaggagaatgccgaactgagggatgtaaatgtagctaccaccaaggccttggaacaagagaccaagagggctcgtagggaagagcacgagcttaaactccggagggaggaaagggaccaatcgcgggtacacagtttgatcttgaaggatgagttgaaggcttgctcgaggtccaagagaagtttgtctcagcatttatgcgagacagagaccaacatgttagccatcatcagcaagtaccaagaggaactaagtctagccacggcccacgagcatagggtggcggacgagtatgcccaagtgtacgcggaaaaggaggctagaggaagggtgatcgactcgttacatcaagaggcaacaatgtggatggactga

SEQ ID NO: 59384 - DNA, 129 bp, Glycine max
  Peptide Sequence Number=SeqID_151069
atggagatcgaggattccaagacttccacatggaccatgaaccatatggtttttatactaatgaatacagttctggatcatcttgctgtgaaggatgtaaatcaaaagcaacaaatggacatgaggtag

SEQ ID NO: 59385 - DNA, 930 bp, Glycine max
  Peptide Sequence Number=SeqID_151070
atggcctcgaggaagcttgcctcgaagagatctaggaaggacgccgccgccgtagggactagtaccgctctcgagttcgatagccattatttcaggagcgctgagcaccagcagcgttgcgaggccatcaagggatggtcctttcaccgagagagacgcgtccagcttagggacgatgagtacacggatttccaagaggagatagctcgccggcattggacgtcgctggtcactcccatggccaagttcgatctagatatagtcctcgagttttacgccaatgcttggcctacagaggagggcgtacgggacctccgacgccctcagtcagttcctgggatatccgctagtatcggaggagggccagaagaggccattgctcagctgctatccataccaggtcaggattttgcccggaccgctgccgggagacgggtgcgaatcatgcgcaccaacatgactactttgacccagacctggatgacgttgctgctcaacaacattctgcccagagatcataattccaacctccctctgccaaagtgtcagctggtgtatgtcatcctgacacggatgagcgttcatgtggctcaattgatcgctgatgccatttatctatttgcaggtatgccacctaccaggcaccctctagacctagataagtctaacagggccctgggttttccggcattgatcacgggtctctgccagtcgttcggggttcctgtcacacctagtaagatgattcgaccgtcgatcaccctggctttcatagagaagtactgcacaactagacaggtgcagggtggcaacccgcaggccccagacgcatcgccgccaccagcacaggctggtccagctgggtcatttgacatagagtggtatttgcggcatttggttcgccagcaggcggccaaccacagggcacac

SEQ ID NO: 59386 - DNA, 237 bp, Glycine max
  Peptide Sequence Number=SeqID_151071
atgtgtacagttaagaaggtgatatggaccttccagcctcccgtgacaaaagacgagaccaacttacaacgtatgcgtgacgacatgatgcagatgcgcaaaagcgcaacaagggggataggtatcatccccttcgaaagacatattgcggcaatagggactaccaacaacaatatgttatcaaagagaaaaactctagatgagggttcactgttatcaagcaagtcggagacctag

SEQ ID NO: 59387 - DNA, 565 bp, Glycine max
  Peptide Sequence Number=SeqID_151072
ggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagagaattggcttagcgagtggctcaaaatcagcacttccacaaacttgcttattgaacctgaaattgaaacggaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59388 - DNA, 240 bp, Glycine max
  Peptide Sequence Number=SeqID_151073
gttgcaggatgtacaatttgtggtggagctcataaatctggatgttgtatccttaatgaagagcaaattgcacatgaggtcaattatatggggaatcagcctagaggcaatttcaatgcaagtggatttccaggatttcagaacaaccagcagtatcaacagcagagacagtggcaaaatcactctggtaaccaattcaatagagaccagggtggttcatctacaaggccacaacaatag

SEQ ID NO: 59389 - DNA, 236 bp, Glycine max
  Peptide Sequence Number=SeqID_151074
aaggctgttgcttctggaggaagcaacctggctcgcctgggcgaactgggcggcaaccacctcccctattttgctataaataggggaggaagtgaagaagaaaagggttcagcccctttggcacttctctctctttcgaatttgcttggaggggatgcgtttccgaatctcgcaaaggtttcaaccgttcttcgacgttcttcattcgttcttcatcgttcttcgatcttcaacgg

SEQ ID NO: 59390 - DNA, 363 bp, Glycine max
  Peptide Sequence Number=SeqID_151075
atgaccataattgaggagatggaaaccatatcgaaacaatttaagcagctcgatgtttgtggaaaagattctattgaaaacattattgatgtcaaagcagatggtaactgtggttatcgtgcaatagctgccttattgggtatggatgaagaattatggtcattggtgcgctatcatctgcataaagaactcacaagctggtcggaagagtatatcaacctgcttggtggcatagagagatttgaggaattaaagtgttccctacttgttgatggattatctatggtgcgttaccatagacaagtggatgaatattacggatatgggatatgggatatgtcattgattcatgatacaacgtga

SEQ ID NO: 59391 - DNA, 297 bp, Glycine max
  Peptide Sequence Number=SeqID_151076
atggtttctccacctgcctcgcctccttcttcttcttctccttctcctcctcttcctcctcccgacgcatcagcttccctgtctgctgtgaagcggacacgaaaagcctcacgtctacaatccttgtctactagaccacctagtgttgagagaccaatggtccacgttgatcctgctaccggcaaggccaacagtccccacaggaagaaattaagaacatatttggggtttgtggcgcgtgataaggtggacgtgacgcggaatttgaaatcccagaggcttttgacagtaggatga

SEQ ID NO: 59392 - DNA, 357 bp, Glycine max
  Peptide Sequence Number=SeqID_151077
atggaaactttccccgcggtggaagagttacttcaacggctcatggactgggggcagctcgaagtgtccaagcccccggcagtgcccaagcccacgccgttttcctatcaaagcaataaggttgttccatgcaaatatacccctcacacttttggagaaagaattgcaactgaggttgactccttgtctgatgtaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccattggaggccatga

SEQ ID NO: 59393 - DNA, 367 bp, Glycine max
  Peptide Sequence Number=SeqID_151078
ggctcagaaatcaagattacctcagagaagctttgaaatgaaggattgggggaattttctccacagaatccttgaggaggattctgaggattccgctccggttaagatgttcctcttggtgtgggggttcagtagcaagcaacgacggctcgtggcggccaccagtggtagtgggtggtggagaaggaggagtccacttttcttgctcaatgcacaaattctcactcagtgcaacttcttctccactatggctcgctcagcaggccaattctcgcttttaacgcaattccctctcgggaagctccagacaaaatttgaagatgatctaacggttaacaaatccacgatcgtgattttactggaatag

SEQ ID NO: 59394 - DNA, 498 bp, Glycine max
  Peptide Sequence Number=SeqID_151079
atgacgttgctacttagcaacattctgcccagcgaccgcaatgccgatctccccttgcgaaagtatcagttgggatcgcgcccactagacaccaagtggacccggagaagtccaacaaggccctggggtttccaactctggttacgggcctctatcagtcctacagggtgcccgtaccccccggcaaggtcatgccatcgcgacataggggtcacgcctgtaggacacccagtggacctaaagaagtccaacagggtcctggggtttccaactctgattatgggcctctgtcagttctacggagtgcctgtttcccccaacaaggtcatcaggtcccctactaatcgagttttcatcaagaagtactgcacccccaggcaggcacagggcgagacaccacaacagcctggggatgcccagcaacaggcaacaaatgcaccgtcgccacctccaaagcccctcagctcatccacaaaaaggttagagtattgcttatga

SEQ ID NO: 59395 - DNA, 495 bp, Glycine max
  Peptide Sequence Number=SeqID_151080
atgacgttgttacttagcaacattctgcccaacgaccgtagtgccgatctccccctgcggaagtatcagttgggatcgcgcccacaagacacccagtggacctggaaaagtccaacagggccctggggtttccagctctggttacgggcctctatcagtcctacagggtgcccgtaccccccccccccggcaaggtcatgccatcccgacataggtaaggatcgcgcccacaagacacccagtggacccggaaaagtccaacagggccctggggtttccagctctgattacggccctctgtcagttctacggagtgcctgtcgccccaacaaggtcattaggccccgcattaaccgggctttcatcaagaagtactgcgcccccagacgggcgcagggcgaaacaccacaacagcctagggatggctggcagcgggcaacaaacgcaccgccaccacctctagagttcatctcaactcatccacaaaaaggttag

SEQ ID NO: 59396 - DNA, 699 bp, Glycine max
  Peptide Sequence Number=SeqID_151081
attatcaacgaagagaacttcgaagctccggaagaggatgaaaaagtccaagctctaaaaaccgaactaggaaaagcgagacttgccaaagaaaaattcaagttggtcgctacagacgttcgaaaagagtgtgccgggttacgagaagaaaatgcagttaccgcaagaacccttgaacaagaaaccaagagggctcgcaaggaagagcatggccgtgacaaatttcgtggagctttgtggggcagcaacaatgagctcaagcttcgaagggaagagagagaccaatcacgagcacatagcatggtcttgaaagaggagttagctgcttgctcaaggtccaaaagaaacttgtctcagcgtttatgcgagacagagaccaacatgttagccatcgtcagcaagtaccaagaagaactaaatctagccacgacccacgagcataaagtggcggacgagtatgcccaagtgtacgcggaaaaggtggctagaggaagggtgatcgactcgttacatcaagaggcaacaatgtggatggaccgatttgctcttaccttgaacgggagtcaagaacttcctcgattgctagccaaggccaaagcgatggtggacacctgctccgaccctgaggagatccacaaacttctttactattgtcagcatatgatagatttaatggcccatataattagaaaccgctag

SEQ ID NO: 59397 - DNA, 498 bp, Glycine max
  Peptide Sequence Number=SeqID_151082
atgggacgcagagacaaaatttggtcattctgcacccttttttcatccagaggcggcgggcccgatgacatgcgaagacaaaatttggtcattccgcaccccttttccattcaggcacagtttgtgtccgatggcacgcagagacaaaatttggtcattctgcaccctttgtcatccagaggcggcgggcccgatgacatgcggagacaaaatttggtcattcgcaccctttgtcatccagaggcgacgggcccgatgacatgcggagacaaaaatttggtcattccgcacccctttgccattcagacacagtcgtgtccgatggcacgcagagacaaaatttcgtcattctgcaccctttgtcatccagaggcggcgggcccgatgacatgcggagacaaaatttggtcattccgcacccctttgccattcagacacagtagtgtccgatggcacgcagagacaaaatttgtcattctgcaccctttgtcatcctga

SEQ ID NO: 59398 - DNA, 392 bp, Glycine max
  Peptide Sequence Number=SeqID_151083
atggggacaaatcaaaacggcaaaaggttttatcaagtcaaggttaaaggtctagatgtcactagcctcaaggaattgggacgattgatgggacccctccaaaggcaagccttccgcaaagtgtacgtgaagattctagatttggccgcagcggaggtatttacggaagctgtcgtatccctcgcccaatactatgaccagtcgttgaggtgtttcacgttgggggacttccaaatggtgccaactattgaagacaagattgcagctgtggttggagattcagcaaaagagttggatcgcatgaagcaaactcggaacggcgtagtgggcctgcctcggaaatacttggaaggcaaggcaaggggtatggcgagccaagagaagtggggccc

SEQ ID NO: 59399 - DNA, 318 bp, Glycine max
  Peptide Sequence Number=SeqID_151084
atgggggtttttccctttctgctttgtaatctttctgcaatgccaggtgccaactttttggcaatgggttcctcatcagattctacttcttctaggtcaatgaggtcacctggagcagggaccagtttctcaggaacagggcctggaccaggaatcatttgtatgggttggatattgaattcaggttgttcctggtttgatggagttttggtggatgatggagatgatggtacagagggtgaaacaggggatgaggtctcttttggtgaggtagccatggagaagcagagcttttggagtggtttcgtgaatatctga

SEQ ID NO: 59400 - DNA, 229 bp, Glycine max
  Peptide Sequence Number=SeqID_151085
atgatggtccgagtgatgttggggaatggttacgagcctggaatgggtttaggcaagcacaacggcggcataaccagcctgataagcgctaaaggaaaccatgggaagtttgggttaggctataaacccacacaagcggacataaagaaaggcattacaggaaagaagagcggaggtcaaggctcgcaactgggacaagaagtcaaaggaggcccgccctgccacatca

SEQ ID NO: 59401 - DNA, 207 bp, Glycine max
  Peptide Sequence Number=SeqID_151086
atggttagtggtgcctacaacactcgcccaagtgaggctcgcctaggcgagctgatccaactccaatttttctacttcgatagaaaaactcatatctcacattcaagatgttatgttgtaaatcccaacggtcagaatgtggataattgtcatagccacctccgacaaaatttgaagatgatccaatggttaacgaatcagggatga

SEQ ID NO: 59402 - DNA, 291 bp, Glycine max
  Peptide Sequence Number=SeqID_151087
atggcatcgcgggaaagagatcccgttagggagaggatggctacttccagacgcttcatctaccaatcgctgaagcggcgtgtatggatctcccgtggtggaggcaaaagggacgagtgtttgtttcacctcagggagtcgcacgacatggaaacttgtcccgcggtagaagaactgcttcagcggctcatggactgggggcagcttgaagtgtccaaagaagggagggaggaaccccagatttgtatgcagtcggaggaaaagaaggtcctctatcctcctaggccttag

SEQ ID NO: 59403 - DNA, 441 bp, Glycine max
  Peptide Sequence Number=SeqID_151088
atggcatccttcagccagcttcagtcgcagatgcaatctcagggacttgcagtgcctcctaagcctcaggttagtccctccggtcctcgagtgagcacaaaggggagttatgttgatccctcgggaaacgatcctgagacgggtgactctgacaggtgcggcttgtacatagaagcagatcttgcccgcctggttgccatggggagagtttataagggatccactgttgttcataacactcctttgtcgcctggccaagtaaaggtgagtgtggaggagattacagatgcagatgcttcagttcctgtacccactgatgaggtttccttagtggggcaggcacttcacaccttcctttcttggccgacacatctggtcaagtctttatcacagcaggtagctgtgtcttcggcaaaaccacctccgaagccctatccgaag

SEQ ID NO: 59404 - DNA, 144 bp, Glycine max
  Peptide Sequence Number=SeqID_151089
atgggtagcttcttggttgtaatagtgaacacaagggaggagcctgcatcagggccagctcctgatcatgtagagttcgcaggatgtggtctagtagcggccaattatgagcatggaggcgtttcttcagaacgtggctgttaa

SEQ ID NO: 59405 - DNA, 486 bp, Glycine max
  Peptide Sequence Number=SeqID_151090
tccaacagggattcgaacaattcaacaagctctataatagcaaggaatcacgtattccggcagacttaaagtacttttccagttttgccttgtcatggatcttttcatggcaatacagatacggaaaaactgaaaacaacaagcaatatccaccgttacagagacacgcctttgtaaaatggtggtcacaattcgatacttcaaaggctgctccagatcaagtcaagaactggttccagagcaatcctgagttccttaaacctgctgatccggagacatctttgtttctaaatcaaaagtcgcaactagcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgattcattctaccagaatgaagatgactgttttg

SEQ ID NO: 59406 - DNA, 756 bp, Glycine max
  Peptide Sequence Number=SeqID_151091
atggatgggttggtggatctagcagtgatcgacgcttttctcacctatcatgaccacaaggaaagcccggttgtcgctatgctagccgacctatatgacaccttcaaccaaagatgtcagaagagcagtacgaggattgcttgttgtactccagctctttatgtatggttggtttcacacctttttcgccaagaggtgagacatgcttgcccgctagaaagccaccgttcatgcacagagaaaggaggggcaaattgggaccaactcttagcaaacaaagaaggagtgtctgtcaactggttccctcgatggaaagaaggaagaatcggggttcttatttcgtgcagaggatttccaaatattcccttgatagggacaaggggttgcatcagttacaatctcgttcttgctataaggcaacttggctaccctacagaggggcacgctagaggaagagctcgcgcctgtcatttcacgaggtggttgaaagcccacgtgcaaggtttggattggctcccgagtttgagaaccgctaaaagagaggaagttgaggcactagaggaagacaaagaggtgcaggcccttagggcagaactcgagcaagcccaaacagtcaaagaaaggttcaaatcaacagctcttaaaatccgaaaggagaatgccgaactaagagatacaaatatagctatcaccaaggccttggaacaagagaccaagagggttcatagggaagagcacggccggaacaagttctga

SEQ ID NO: 59407 - DNA, 267 bp, Glycine max
  Peptide Sequence Number=SeqID_151092
atggtctcctggccatgccacttgtgcgtcaaactcctccatgctcataatggagggcaagcccaagccctaaaggctctacatgatgatggatttccctttatggatgctctagagcatggagtgaagcatctgaggagaggaatcattgggatctctgtggaggaagagggaggaagtgtagaagaagcaggtattggtgcctctgatgctgaagtggaaagggcctcaaatctcttacctctggccttcctgggtcctctgaaa

SEQ ID NO: 59408 - DNA, 54 bp, Glycine max
  Peptide Sequence Number=SeqID_151093
atggccgaccagcaggctaccaagtccaaagccaaaggtaaaaagatgccttag

SEQ ID NO: 59409 - DNA, 614 bp, Glycine max
  misc_feature (127)..(127): n is a, c, g, or t
  Peptide Sequence Number=SeqID_151094
cggcagggtcggaacaggagagcgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtaccctcttagtatctcttgcttacttgtcatttgcgcctaatatggggactgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59410 - DNA, 219 bp, Glycine max
  Peptide Sequence Number=SeqID_151095
atgggtagttctactagaaaactggtagagaggatgaggagagttaacttagagttaaatgtgagaatggtagtgttggaagtggaaaagtgtgagattttgagggttagaaaagccaaatttggggttagtggaaattggagtctaaagaaagcatgggcagagcaaatgagaaaaatgagtgacaaatgtgaaagaaaagagccatttctagggtaa

SEQ ID NO: 59411 - DNA, 474 bp, Glycine max
  Peptide Sequence Number=SeqID_151096
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttggaatggcctttgtggataactgggtggtgggtaaggagaaagtttgttattggctgagtaaagatattgttgggtttggtgggaaatttggccgtacaggaatggcagtcacagcaggggtttctccctcatctcacccctcttcatttgccccagttttctcagtcgtcctagtaggatga

SEQ ID NO: 59412 - DNA, 979 bp, Glycine max
  Peptide Sequence Number=SeqID_151097
cagaattgcaactgtggtcaaggattcagccagagggttggaccgcataaaacagactcggaacggtatagcgggcctgccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggggagcacccacggaagaaagcatgtctcctttccttgtgagggatctcggcgcacaaaattccaagactatacaaagaatccataaagcatgggaaaccccgttaaggaaggatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcaagcacatagcatggttctgaaagaggagttgattgcttgttcaaggtccaaaagaagcttgtctcagcgtttatgcgagacagagaccaacatgttagctatcatcgccaagtaccaagaagagttgggtctagccacggcccacgagcatagaatcgcggatgagtatgcccaa

SEQ ID NO: 59413 - DNA, 315 bp, Glycine max
  Peptide Sequence Number=SeqID_151098
atggttagaacacgaggtctacgtcgtgtggtaggcacaggtagaggcagagaccttagtcaggatgtggctgaggatgttcctcggcgtcgtaggcccactgcctcagcacgtaggcaacggttgcctgaggatgtgcctcatgcgtctgatggtagcccagagaggacaggagctaccgatgttgctgagtctgatcgagtggctagtgatgggacagctactgatgatgaagggttccccgatgggccacacgatccatttgttttgataggatttgttgatcatgtggcacacagcatatggagtggacag

SEQ ID NO: 59414 - DNA, 422 bp, Glycine max
  Peptide Sequence Number=SeqID_151099
tttgggaatggaagcttgaatggagaagacacctttttgacaatgaggtgcaagcggctgccaatttcttggatgatatctcgcggggtcatattgattgttggacatcagactgctgggtttggaaaccagaacctaatggccagttttctacaaggagcacatactgtatgctactagaaggagcagcagatcagactgtggatgaggctttagaggacctatggcagctcaaaatccctttaaaaccaacaatatttgcttggcgattgatcaaagatagaatccctactaaagggaattttcgaagaagacagctggagaaaggctttgcccagccctacaactattggtctaattggcacctgattcgtaggacctatggttctgctagtctgctggtttctaccttgtatatttag

SEQ ID NO: 59415 - DNA, 521 bp, Glycine max
  Peptide Sequence Number=SeqID_151100
atgaggacttcctcatgtccatttattaaatatccatctctagacgatattgatcatattatatcagcagaaataccttcacaggaagatgatccagaactctataaattagtacaaaatcatatggttcatggtccatgtggaattttgaggcatgcatctccatgcatgaaggaaggcaaatgtagtcgattttatccaaaaaagtttcagcccacaactcttatagatggagatggttatcttgtgtaccatagaagaaacattggttggacaataaccaagaatgagattataattgataatagatgtattgtaccctacaatccaaaattgctgaaaaaataccaagcacatataaatattgaatggtgtaaccaaagcacttctatcaaatatttattcaagtacatcaataaaggatatgatagagttaccactgtcagggttcatgatgacaatggaacagttcctcatgcaaacaatccgaatgatgaaatcaaggaatatctggattgcag

SEQ ID NO: 59416 - DNA, 90 bp, Glycine max
  Peptide Sequence Number=SeqID_151101
atgcccgctggtcagctcgaccgccgttaccgacgggcaaagcagcatttttcacaggcggtcaccggagccataagcattgccggctga

SEQ ID NO: 59417 - DNA, 357 bp, Glycine max
  Peptide Sequence Number=SeqID_151102
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccttggagaaacgatgatcgtcacttccctccatgctttgttactcattgctagaggttgcaaatga

SEQ ID NO: 59418 - DNA, 288 bp, Glycine max
  Peptide Sequence Number=SeqID_151103
atgattccaccagtaagaattgttcacccaacagaaggtgtacaaggaattcaaaatccattttggaatgatgttttgcattataataatatcaactggagtcatcctggtgaggaggacatttgtggtttggagatgccatccagttttaatgttggccaagaattatatgttgacatggaatttgatagtaaagatgcagtcaagaatgcagtcaaacaatatgttatgaaggtgcatcaaactttcaaaatggttgaaagcaaaggggacaagtatgtggcatga

SEQ ID NO: 59419 - DNA, 963 bp, Glycine max
  Peptide Sequence Number=SeqID_151104
atggcttctaggaaacacaaaagtattggttcaagacccacaacacaatatgatacaaggagattttcctctttagatgcttggaaccggtacacagataatgtcttggggagaaacatcttgcctaagaggaaggtagagctctatcatactgagctagatgattttaagactgaattagagaggcgtaatttccataaacgcctcaccaatttcattgatgcgagcatagacttggcattggagaaagagttctatgcaaacttatacagctctaagggcccttcaccaaagcaatccagagtcagacgccattcagtgaagattgatgctgacagtctcaacatattcctggagacacctgtggtattagcagagggtgagactatacccacatactccagatactacaggttgcccacagattacaaagagattgaggctgccttacgcataacaggccgagggttcatcttgaacactgagggccatcctgggaagattctcaggaaggatttgactactctaggtcaggtgtggagtgttctctcatactccaacctggcccccacatcacatacctctgatctgatagtggacaaagctaggctgatctttggcctagtctctcgcatggacatgaacataggagctcttatttctggccagataacttctacagcccagtctaacacttctagacttgggtttcctactctgatcaccaaactatgtagagccagaggggttgtctctgacagccttacttttgagcacctaagcccgatcattaactttgcctacatcaggaagaactgttggaatcccaaggaattaacagtttctatccgaggggctaggagggcaagggtgaggccaactgagcttccttccacttctgcagctcctactccagcatccacttcagcaactccttttgtcccagctcaaacagattcttag

SEQ ID NO: 59420 - DNA, 66 bp, Glycine max
  Peptide Sequence Number=SeqID_151105
atgtgggggccgcttcatatgaaattttgggcaaaaatttctagagcattcactatatcgggatag

SEQ ID NO: 59421 - DNA, 730 bp, Glycine max
  Peptide Sequence Number=SeqID_151106
atgagtgcccatcatcacgatgccgccccgagcgagaacgaacttgaacgcctgctgaagctggcggtgacggagccggcccaccgcccggcgttcttccgtgaattgctcgacgccacggtgctgatcctcggcgacagcgagcaggtgcagcaggacggcgacatcgcgctgaacgcggatacgccggtcaatatccagcattgggagaagcaggacggcggcagcatcattccgttcttcacctcgctggaggcattgcagaaggccgttgaggacgaacagccgtttatcgctatgccggcgcgggtgctgttcgaaatcacccagggcgctgatctgttcctcaacccgaaggcggaatacggcaaggagttctatccggaagaggtggcgatgctgctggcgaccggcggcattgtcaaaccggtggagcattacgtcgacaaagagacccaaatcctgctggggcagcccgaagagtatccgtcggcgatggtggatgcgttgaccacgctgttcagccagcgcaagccggtgcgccgcgcgtttctggcgctgatgcacgaccaggcggcggacgagaagccgaatttgctgatcgggctggaagtggacgccgagtcggcggagatcgaggcgttgatcaacgaggccggcagcgtcgccagcgaaacggcgccgaacgacgaaccggtggatttctgcctggtgtcggagaaagagcgcg

SEQ ID NO: 59422 - DNA, 237 bp, Glycine max
  Peptide Sequence Number=SeqID_151107
cctaccaatcgagctttcatcaagaagtactgcgcccccaggcaggcacagggcgaaacaccacatcagcattgggatggccggcagcgggcaacagaagcaccgccatcacctctagagttcacctctgctcatccacaaaaaggtttgagtattgcctacaccacatggccgaccaataggcgaccaagtccaaagccaaaggtagcaagataccttggatatgcatgtatatag

SEQ ID NO: 59423 - DNA, 177 bp, Glycine max
  misc_feature (134)..(134): n is a, c, g, or t
  Peptide Sequence Number=SeqID_151108
atgcagcacaggaacattgttagtgaggctggagaactttattcaaagaagcttgccaagtttgttggaaagcgtctcaaatcagaatgggctgcttctgtaagcattatctattgtatagattcaaactctgncttttcccttgaaattcaatgctcaaacaaagttaacgcttga

SEQ ID NO: 59424 - DNA, 403 bp, Glycine max
  Peptide Sequence Number=SeqID_151109
atgaagaatgcgttcaacaagaaggtgcgctcacgcaagttccatgagggcgaccttgtgctgaaaaagatgtcccacactgttaaagataatcgagggaagggccctggtgcttaccaacatggatggcgaggagctaccttcacccgtgaactccgatgttgtcaagcgatactatgcttaggatctggggcaattgaggaagtcgctgcattcctcactttgtgctttaaaccatgtgtagtttgtgataacctgagccttttcgctcagtccatgggttgccccaaaatcatcttaggcagtggtcaaatgtcgggatggggacggatgcaagtagaggctagggtcacgatcgatagatcgtcatctcatgcccagcactggaccaacaggaagcaca

SEQ ID NO: 59425 - DNA, 156 bp, Glycine max
  Peptide Sequence Number=SeqID_151110
atggcaaaaggtaaccccgcatatcacctgacatcacgggtcaggacgacagaaggtggaggagacgatattagtctctgcgtgtcaacgggctcgtttgccccctggttgacgaaaggtgcgggtaaccataaggtaaccccgcatgtcacctga

SEQ ID NO: 59426 - DNA, 488 bp, Glycine max
  Peptide Sequence Number=SeqID_151111
atgggatcaagtcaaaagccttcgcttaaaaagaggttctatcaagtcaaaatcaagagcttagaggtcactagtttaggagagttggggcaattaatgggtcaacttcaacgggtagaagtctccatggaaccgattgcatccctttcccagtattatgaccagcccctaaggtgcttcacatttgaggacttccagctagtgccgactgtgaaagagttggaagaaatccttggatgccaactgggaggaaggaagccatatcttttctttgggttctatccctccacgacaagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccat

SEQ ID NO: 59427 - DNA, 306 bp, Glycine max
  Peptide Sequence Number=SeqID_151112
atgcgggggtaccgtatggttatccgcacctttcgtcaaccaagggcaaacaagcccgttgacgcgcagggactaacgtcgtcctctgcacctgtcgtcaatcaggggggaagggtactgtatggttatccgcacctttggtcatctagagacaacaagtccgatgacatgcgggggtaccgtatggttatccgcaccttttgtcatcccgaggcagcgagccgtatgacatgcgggggtaccgtatggttatccgcacctttcgtcaaccaggggcgaacaagcccattgatgcgcagagactaa

SEQ ID NO: 59428 - DNA, 864 bp, Glycine max
  Peptide Sequence Number=SeqID_151113
accgccgccacgctgccggtgttcctgctggcgatcccggccggggtactgtcggacatcctcgatcggcggcgctttctgatcttcgtgcaaattttgctggcctgcgtcagcggcagcctgctggtgctgtcgcagaccggtgcgttgacggtggaatacctgctggcgctgacctttgtcggcggcatcggcgcggcgctgatggggccgacctggcaggcgatcgtgccggagctggtgccgcgcaccgagctgaaaaacgccgtggcgctgaattcgctgggcatcaacatcgcccgctccatcggcccggcggccggcggcctgctgctggccagcttcggcgccggcgcggcctacggtgcggacgtgatgagctatgtactggtgatcgcggcgctgctgtggtggaagcggccgaaggccgaggacagcggcctgtcggaacacttcttcggcgccttccgcgccggcctgcgctatgcccgttccagccgcgagctgcacgtggtactgctgcgggcagcggtgttcttcgccttctccagctcggtctgggcgctgctgccgctggtggcgcgccgcatgctgggcggcagcgccggtttttacggcgttctgctgggggcggtaggcgccggggcgatcctcggggcgatcgcgctgccgcgcctgcgccagcggctgaatgccgacgggctggtgctgctggcggcggtgctcaccgccgtggtgatggcggccctgtcgctggcgccgccgcagtggctggcggtggtgctgctgttggtgctgggcgccggctggatcattgcgctgaccacgctcaacggcgcggcgcagggcgtgctgcccaactgg

SEQ ID NO: 59429 - DNA, 348 bp, Glycine max
  Peptide Sequence Number=SeqID_151114
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggagcatgatttggatagaagcactgccagaaaagttctgattcagcattttcaagaaatagctgataaggtacttaatcttttggcttatccttga

SEQ ID NO: 59430 - DNA, 228 bp, Glycine max
  Peptide Sequence Number=SeqID_151115
atgaagcataattccaaactcattgggtggaggatgcatgaacgaaaacgcaattcatggggctccgataaaaaggcaaggatggaggattgcactagagggtcctcacttgtcaatgatgaagcatggctccaaactctttgggtggaggaatgcatgaaagagaacgcaattcattgggctccaaaatggcgagaatggaggattgctctagagggtcctcactag

SEQ ID NO: 59431 - DNA, 921 bp, Glycine max
  Peptide Sequence Number=SeqID_151116
atggctacctcaccaaaagaaacttccgctcctggttcacccgctgtaccatcatctccatcatccatcaaagcaccatcaatccaggaacaacctgaattccatatccaacccatacagatgattcctggtcaagcccctgttcctgaaaaactggttcccaaacgacaacagggagtgaagatttctgaaaaccctagccttgcaacaagtcctagggaagtagacacagagatggataagaagatccgcagtattgtgagtaacattctgaaaaatgcctctgttcctgatgctgatgaagatgttccaacatcttccaccccaaatgcttctgtgcctgatgttgagaaagatgttccaacatcttccgccccaaatgccgaagtcctctcttcctccagcaaagagagatcaacagaggaagatgatcaagctgcagaggagactcctgcaccacgggcaccagaacctgctccaggtgacctcattgacctagaagaggtagaatctgatgaggaacccattgccaacaaattggcacctggcattgcagaacgattacaaagccgaaaaggaaaaacccccattaagagcactccgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgccaggagatcatggacctcatcacggctgctggactgctgaagact

SEQ ID NO: 59432 - DNA, 186 bp, Glycine max
  Peptide Sequence Number=SeqID_151117
atgacaatggtggtggtggttggttgcgacggcaacaatgtggtaatggtggttgttgcagtagtgacaatggtaacaacaatggttgtggtggtggtggttgcaatggcaataatggcagtgaaaggtggcaacgatggtggtggtggtggtggtcgcaacaacaataatgaaaatgagcgatga

SEQ ID NO: 59433 - DNA, 171 bp, Glycine max
  Peptide Sequence Number=SeqID_151118
atgggtttctgcgggaaaggaaaatggtacaatgcgaggggtatttctcttagctcagacataatatcgaaattcccaacggttaggtggcctgcgggaaaaagagagggttttggaagaagagagaagaagcaacattgtgagacagaggaagctgaggagtccgtctga

SEQ ID NO: 59434 - DNA, 114 bp, Glycine max
  Peptide Sequence Number=SeqID_151119
atggtgattttcatccatggagttgctgtggaaggtagaggagaagagataaatgcactattcaacaacattttctttgaaaccaagagagcaaacaatgtcaacaaattccag

SEQ ID NO: 59435 - DNA, 207 bp, Glycine max
  Peptide Sequence Number=SeqID_151120
atgatattgcacgagattagaagacctaactctcaaaaaacagtccccagtggactcgccaactgtcgcaacctacccttcagcgagagggcgacacagggctcgcaggtgcgtcttccatgggaggaaaatgcgcggagtcgccaccaacatttattcgaggaaaacgtcggaaaaactggaaaaggcgtggtctacgaactttaa

SEQ ID NO: 59436 - DNA, 833 bp, Glycine max
  Peptide Sequence Number=SeqID_151121
cgaaaccctgcgcaccaccgagatcttcacgctcatgctgctgctgtacttcgcggtggcgctgctcatcaccgccggcgtgcgcctgcttgaacggagggtccgcgtccgatgaaaccgatattcgactggtccttcgcgctggaaatcctgcccacgctgggctcggcgctgctcatcaccatccaggccacggtgctgggcatgctggtggccgtgacgctcggcctggcgctggcgctgctgcggcgctcgcgcctggcggtgctgtccttgcccacggccttcgtgatcgagttcgtgcgcagcacgccgctgctggtgcagatgtatttcctgttctacgtgctgcccctgaccggggtgcagatgtcgccccttgcgaccggcatcgtggcgctcgggctgcactacgccacctattgcgccgaagtctaccgcgccggcatcgaggcggtgccgcgcggccagctggaagcggcgcgggcgctgaacatgtcgccgtggcgcaccgccgtcggcgtggtgctgccgcaggcgatcccgccggtggtgccggcgctgggcaactacctggtggccatgttcaaggacacgccgctgctgtcggcgatcacggtggtcgagctgctgcaacagagcaagatgatcggctccaccaccttccgctacaccgagcccctgacgctggtcggcgtgctgttcctggcgctgagcctgatcgcggcctggggcgtgcgcggcctggaggcccgcctgcaacgatatggaggaaagcgatgagttccagcatcaccatcaagaacctgcacaagcgctatggcgagctggag

SEQ ID NO: 59437 - DNA, 183 bp, Glycine max
  Peptide Sequence Number=SeqID_151122
atggcacgccgcgtgcttgctccgtgcccctattttagggacctatacgagagggagctaaaagggcttttaatgataattcccaaggtggtcatatctctcttgatggtgtctagagcagtaggaactactagcaacaatatgttgtcaaagagaaaaactctagatgagggttcactataa

SEQ ID NO: 59438 - DNA, 674 bp, Glycine max
  Peptide Sequence Number=SeqID_151123
gtatagattgctgagatggttctggaactcacggaaagaggcttttaaggggtgcgcccttaacccgattccggggttcattggagctgtcggagttagcgtcgggactaccctgtcatgccgaatgaagtatcgtacaaaagccctatactcaagggttttcttcaactcgcattctttcataccaaacaaggttctctccttcggtagatgggcactttcggtttcatatccgtcgtgtacaacaagcttaatcgcacaagcttgggctgggcctacctccatccctagaggagccggattagtgcgtgagaccgcgatccacaaaagcatgggactcaccctttacttgggaatgaagaggggaaagatagcatgtcacaagagcgaggcgaggtttgtaaccctactgcgagagggacgcctcgcgatccgggcttctagagatgaggccttttggcgaagccaagtcaatttcgggccaccaaaccctgcaactgatgagaaggcctatggagtaacgggaagcgtggggacaggagacggccatctcgaggcacatcacgacctacaggcaagaccggcgaagacctgggaaggctacccgattgggagtcagaggatccatagtacctgcagccccgtggacttcatcttcatcatttttgacaccg

SEQ ID NO: 59439 - DNA, 264 bp, Glycine max
  Peptide Sequence Number=SeqID_151124
atgaggctcggagcttatgagcagttcgagcaaggagatccttcctggagttttattcaattgcttaactactttaaactcactttgttggatgagacgaaggaactcatgagcctcttccaaggtcatcgcctttccttggagaccttccttcttttcagcttcctttactacccgggggatccacttcttttgagggggtggtcgcgcctgcggactcttgggtcatgggcgctttcttcttggaggcaatccaccgagtga

SEQ ID NO: 59440 - DNA, 351 bp, Glycine max
  misc_feature (67)..(67): n is a, c, g, or t
  Peptide Sequence Number=SeqID_151125
atgaagggaggagagcataaatataggtttaacaataataaacgtgagaagccagagaaggtaaggntgttggatgatgaaactggcgacaaacatgagctgtttgaagtcctaaggatgccatctagatgtgtatttttcaaggtcttcatgtcattccttcatcattcaacgtcttcatgtcattccttccccgagagtttgaagatcatggcttctccacctgcctcccctcctcctccccctcctccttctcttcctcctcctcctcctcctccttctcctgctccttcgaacgcatcggcttcaccgtctgccgttaagcgaatacgcaaagcctcacgtctatga

SEQ ID NO: 59441 - DNA, 441 bp, Glycine max
  misc_feature (4)..(4): n is a, c, g, or t
  Peptide Sequence Number=SeqID_151126
gggnttgcatcaagctacaatcacgttcttgctataggacaacttggctaccctatgagaggggcgccactagaggatgagctcacgcctgtcatttcacgaggtttcaataagaccaacgtggaggcacttcataaggtccgcaaggcatgggaggtgtttcaaaagaaggacaaggaactcaggggcagtaacaatgggcccatcggtggctatcgtaagtggttaaaagcccacgtgcaaggtttagattggcttccaagtttgagaaccgctaaaagagaggaagttgaggcaccggaggaagacgaagaagtgcaagcccttagggcagaactcgaggcttgtagggaagaacatggccggaacaaattccgaggggctctgtggggtagcaacagcgagcttaaattccaaagagaggaaagggaccaatcatga

SEQ ID NO: 59442 - DNA, 441 bp, Glycine max
  Peptide Sequence Number=SeqID_151127
atgtggctaccaccagagccttggaacgagaaaccaagagggcttgtagggaagaacacggccggaacaaattccgaggggctctgtggggtagcaatacggttatgcgagacagagaccaacatgttagctattatcaccaagtaccaagaagaactaaatctagccgcagcccacgagcatagagtggcggacgagtatgcccaagtgtacacggaaaaggaggctagaggaagggtgatcgactcgctacatcaagaggaaacgatatggatggaccgatttgcccttaccttgaacgggagtcaagagcttcctcgactactagccaagtccaaggcaatggcgaacacctactccgcccccgaggagatccatggacttctcagctattgtcagcatatgataaatctaatggcccatataattagaaaccgctag

SEQ ID NO: 59443 - DNA, 777 bp, Glycine max
  Peptide Sequence Number=SeqID_151128
atggcaagtcaagagaagtgggtcccatttgcggatatactagctttgctgatctttggggttgtcctctttccgaacgtggacggtttggtggacctagccgcaattgatgctttgcttgcatatcaccatagcaaggaaagcccagtggtggctatcttggtggacttattcgatacatttgaccgaaggtgcgagaagaacagcgcacggatcatctgctgcttgcccgctctttgtgtgtggttggtttcgcacctattccaacaagacataagacacccatgtccgcttcaaagttatcgctcgtgcgtcgaaaaaagaagactcgattgggaccaacacttaactgtgataggaggcagcacaattaattggtttcctcgatggaaggaaggaaaggagggagttctcttctcatgtggggactaccctaatgttccgttgatagggacgaggggttgtattaactataatcccgcacttgccataagacagctagggtaccccatgaggggagcgccaatggaagagaacctctcgcctttccttctaagagttcatacgcgagggttagattggctctccaagttgaaatttatcgatgaggagaacttcgaagctccgaaggaagatgaagaagtccaagctctaaaattagagctagggaaggcaagactcgccaaagaaaaattcaagacagccgctacaaacatccggaaagagtgcaccgagttacgagaggaaaacgcggccactgcaagagcccttgaataa

SEQ ID NO: 59444 - DNA, 548 bp, Glycine max
  Peptide Sequence Number=SeqID_151129
atgccaatcgttgaggtgtttcacgtttggggacttccaaatgggggcagcgcgatcaattggtttcctcgttggaaggaaggcaaggaaggagttcttttctcgtgtggggactaccctaatgttccattgatagggactagggggtgtattaattataatcctgcactcgccataagacagctagggtaccccatgaggggagcgccaacggaagggagtctctcacctttccttgtgaaagatttaggcgcgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgacagttatcgatgaggagaacttcgaagctccggaggaagatgaagaagtccgagctctaaaattggagctagggaaggaaagactcgccaaggagaagttcaaatcagctgctacacacatccggaaagagtgcaccga

SEQ ID NO: 59445 - DNA, 240 bp, Glycine max
  Peptide Sequence Number=SeqID_151130
atgctagctatcattgccaagtaccaagaagagttaggtctagccacgacccacgagcataggatcgcggacgagtatgcccaagtatacgcagaaaaagaggctagaggaaggttatgggaattttacggaagcattacgggtgtcccggaagccccggaatcccattttccaacaaaatggggggtgtggtggccacctagctcgcccaggcgagctcagctcgcccaggcgagctag

SEQ ID NO: 59446 - DNA, 774 bp, Glycine max
  Peptide Sequence Number=SeqID_151131
atgaatggtcagattagggaagaattgaggactcagattaaggaagaattgagggctcagctagaagaggaaaataaaaggagcttggaaagaatgactatggcattgaaagaggctattaaaatagagttgtcatataaaggatccccagagtcactcctaattcagtcggacatacaacaattaggtgcgtgtgtcagcactaagggaagtaatgctcaaatcaatgtccagccttcatgggaagatgatgctgatgtcataccaatgatgggactgtatgtgcagcgtgaggatggtacactagggttggtctccatggggaaaataatggatggggattcaatcatacacaccgtggcttatgcagatgatgttgtaagggtaagtgtggaaacaattattgatcctgatgttgagatcccctatggcacctcagaaattcagtatgtcaagcaggccctcgatacatttgtagcttggcccacacaccttgttaaagttgtattagatgaggatgcagaaattattccgcacaaagtggatgcacatgtggcaaagccggctaatgtggacgcagatgatctgatgcgtggcctgataaagtacagttttgatatttacgacaagccagttgaattcgaatttgatgggagtaactttggaattgtagatgcacctacatcgatattcctaacatattatgatgttagtgaaataatagcaggagacaaaagtttgaacatatctgtacaacaattatggttgatgtaa

SEQ ID NO: 59447 - DNA, 158 bp, Glycine max
  Peptide Sequence Number=SeqID_151132
atgggctcagaaatctaccctaaggttcatgagaaccctagggccttctttagtagctctagcccaatcctcttggagtcttctatccaatacctttggggggtaggattgcatcagtatgtaccctccaatgtgttaggacaaagaattcttaggcg

SEQ ID NO: 59448 - DNA, 237 bp, Glycine max
  Peptide Sequence Number=SeqID_151133
atgtgggcatgggaacgatgcacaagtttggctccaaagaggactcctcccgtaatagaaaataaaccactcggacacaggtggttgcgacgtggaaatcaacatatcggtaatgatgatttgatagtttttcgtcgcaaattggatattatgaaacaacatgagtttctgtgggagccttacacaacaaatattatatgtcagtgttgcctccaatttgtttggttgcaagcgtag

SEQ ID NO: 59449 - DNA, 138 bp, Glycine max
  Peptide Sequence Number=SeqID_151134
atgatgctccacagcctaaatcaaaggcttctactaggtggattgtcgtcaagtgtaatagacaaaaaggaatattttaacgatcctagaccattggagccagagagattaaaagcattgcggatccagtgggcataa

SEQ ID NO: 59450 - DNA, 670 bp, Glycine max
  Peptide Sequence Number=SeqID_151135
ggccccaacgttaagaccaatccgctagccagtcatggaggagctagcgtaaacgctatcgaaaaggataggccgtcagggtcaaagagattagaagatgtggccacatccagaagattcatctaccagtcgctgcaagcagcatgcatggtctctcgtggcggagacaaaagcgacgaattgttcgagaaaggtagggaagatccgcagatttgcacgcagtcggcagaaaggagggctcccccaacccccaaagccctagtgatatgtttcactagaaatatgaccagcctcaggtccgagtaccccccggtggtgcccaagccgatgctcttttcctataagagcgataaggtcgtcccatggaagtatacccctccttcttttggaaaaggggctgcaaccgaggttgactccttgtcagccaaggtgaccaacattactggccttagtggcgtaacccacagtggttgggtgtttgctccccttcacccgacggaattgccctccaaggggaaagcacccatgacccaagagtccgtaagcgtggccaccccttcaaaagaggtggatcccccggtagtaaggggagttgaaaagaaggaagatctccaagggagggcggtgaccttggaggaggctcatgagttccttcgtctcatccaacaaa

SEQ ID NO: 59451 - DNA, 387 bp, Glycine max
  Peptide Sequence Number=SeqID_151136
atgaatactttagggtttcaaaattgtaaaagtgctaaggatatgtgggatacactacaagagcatgaaatggaattactaagattaaatcagcatgaagaaactgataagaagaagaagggaatcgctcttaaagcctcatctgcaatccaagaagacagtgataaagaagattcaattgacttggataatgatgaagatattagtctgtttgtaaaaagattcaacaagttcctgagagtcagaggaaatcaaaagcgacccaattttaaacctaaaagaaggacaaaaacttcatcctctacactaaaatgctttgattgcaatcaacctagacatctgagggttgactgtcccatcttcaagaaaaaagatggagaagtctga

SEQ ID NO: 59452 - DNA, 282 bp, Glycine max
  Peptide Sequence Number=SeqID_151137
atggcgaattcgtcagattccattgtgtcttccacaatggaatctgataaatcgctaaatgttcaggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggg

SEQ ID NO: 59453 - DNA, 153 bp, Glycine max
  Peptide Sequence Number=SeqID_151138
ggacctatgatgagaagtaagaccaaacagttagtggatgccttccaacaaatggtagcagacatacttaataaggcccaagtggagaaggatgaaggcccagaagcagaggcactactaagcatattaatcgttgctgaagcccaagattaa

SEQ ID NO: 59454 - DNA, 507 bp, Glycine max
  Peptide Sequence Number=SeqID_151139
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaaagacatgcaaaagcaccactggcagcagccactgccagttacctcggttcaaagagttggtagctcagagaaccttcgaaaaaccgccctgcaaggcg

SEQ ID NO: 59455 - DNA, 408 bp, Glycine max
  Peptide Sequence Number=SeqID_151140
gtttcgggggtgggttcattgattagtacacctccggtgctgataaggtcgggaccgtggtcgtccgtctccggtttgccggccgataagatctctgagattgaccagccagctgggttggtttggctattcctttctattgaaaagaaggagtcagctgtctgcgcgagtcaccttcttctaggctccgctggacgacacggcattctcggattgacctttttaacgcatattcagtcgtaccggcatggccccactgatttgttttcgatcggagcatcaagcagcgcaacccggttctacttgactaagccccgtgctcgtccaaggagggagtttgctttacccaactccctttttgataacaaggcagaaacccccgacccgacattcattagtttcgaatga

SEQ ID NO: 59456 - DNA, 69 bp, Glycine max
  Peptide Sequence Number=SeqID_151141
atgaataacagaaaccaatcaaggtacttaggaacggctgcaagtggggatggggtcacgaccgactga

SEQ ID NO: 59457 - DNA, 357 bp, Glycine max
  Peptide Sequence Number=SeqID_151142
atgaaggtcgacatggaggccatgaaagagaaaatggctacgatgatggaggccatgatgatcatgaagaagataatggaagccagtgcggttgtagttgccactaccagcactgttgctaaggcaaagatttgggaagtacgggcggcccccatgatgtgcaaattcaaaacgagcacgccttcccgccatatggcttgcctctcaactatacgccacccaatgtggcgtacactcccaataagaatgtcaataactccactcctatacccattgagagccaacaaccccaaactgatcatgcacatgtctcttaaaccatgggggagacacatgaaattccccaccacaatctag

SEQ ID NO: 59458 - DNA, 282 bp, Glycine max
  Peptide Sequence Number=SeqID_151143
atgaaaactctacacggttccggaattgcaacaaatattatcgacaataacgaaataagcactaacgcaagaatccaaacaaattgtatgcacgaaacaaatgacaaccgaaacaacaaaaacaaacaatacgaacctggggatcccacggtcatgtggctccgcatgccaccggactcttgggtcacggtaacaaaaggtggggtggtcgacaaaagcagggcttttgctcctatgtatcctcaatttgtgatgaggaactcagacctacgtagttcttga

SEQ ID NO: 59459 - DNA, 474 bp, Glycine max
  Peptide Sequence Number=SeqID_151144
atgccaatctccccctgcagatgtatcagttgggatcgcgcccacaagacgcccagtggacccgaagaagtccaacagggccctggggtttctagctctggttacgggcctctgaatcgcacccacaaagacacccagtggacccggagaagtccgacagggccctggggtttccagctctggttacaggcctctgtagtcctacagggtgcccgtttcccccggcaaggtcatggattgcgcttgcaagacacccagtggacccgaagaagtccaacagggtcttggagttgtcaagctctaattgcaggtctctgtgagttctacggagtgcctgtcgcccccagcaaggtcatcaggccccctactaatcgagctttcatcaagaagtactgcgtccccaggcaggcgcagggcgaaacaccacagcagcctggggatggccgacagcgagcaacagacgcaccgccataa

SEQ ID NO: 59460 - DNA, 696 bp, Glycine max
  Peptide Sequence Number=SeqID_151145
atggaaccaattgcctccctcgcccagtattatgatcagccgttgaggtgcttcatctttggggacttccagctatcaccaatggtggaagaatttgaggagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagggagtcctctttccaaatgtggatgggttggtggacctagcagcgatcgacgtttttctcgcctatcataaccacaaggaaagtccggttgtcgctatgctagccgacctatatggcaccttcgaccgaagatgtgaagaaagcaatgcaaggattgtttgctgtactccagctctctatgtggggctggtttcacacctttttctccaagaaggtaggcccatctatccgctacaaggttaccgctcgtgcgtcgaaaaaggaaaggcgaattgggaccaactcttggctagcatggaggggcgtctgttaattggttccctcactaaaaggaaggaagaatcaggattgtatcttcatgcgaaggatgtccaaatgttccctggatgggaacatggggttgtattaattataatcccgtcctcgccataa

SEQ ID NO: 59461 - DNA, 345 bp, Glycine max
  Peptide Sequence Number=SeqID_151146
tctcggtcggaagatgctgacatcttcgggaaaggtgcagatgatgattctcggccggaagacgctgacatctccggggaaggtgtagatgacgactctcggccggaagacgctgacatctctagagaaggtgcagatgacgattctcggccggaagatgctgacatcttcgaggaaggtgcagatgacgatgttagtcactgcatgctatcgggctttgagtcttacgaattgcaaaatgatactttttcgcagtctcggccgaaagatgctgacatctccagggaaggtgcagatgaagatgttagtcactgcatgctatcgggctttgagtcttacggatag

SEQ ID NO: 59462 - DNA, 394 bp, Glycine max
  Peptide Sequence Number=SeqID_151147
cgccacgcttcccgaagggagaaagccggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccggttgggttctctcttag

SEQ ID NO: 59463 - DNA, 305 bp, Glycine max
  Peptide Sequence Number=SeqID_151148
cttatgttccaatcaagagatccttcttaattggtgccgctgtgattgcatcttttggttaccgtaaagagcatgatggctcttgggtgaaaaaaggtgcacaacccattgataaagaaggacacttaccagttggagaagattcctctcttcttcaaaggattttggacaggtttgatgctctggagttacaaatggacatgcaattcaatgagatggattcaaggatcaccaaggtcaaaggagatgtctctcacatccgcacatgctttgatctaccaccaccaccacgaccatcatcttag

SEQ ID NO: 59464 - DNA, 297 bp, Glycine max
  Peptide Sequence Number=SeqID_151149
atggggcagatggttactcagttgaaccaagctcagtcccaaaattctgacaaattgccttcacaaactgtgcagaatccgaaaaatgtgagtgccatcaccttgaggtctggcaaccaaattcaagtgcctccaccagtagcagcacctgcacctaaacctgtcaagcttcattctatacctgaaaaagaggatgagatagttgcacaaaagctaaaatgtggtgattcatttggcaaatacaagtgttgcttaccccgcaggtttcgtagaggatgtgctagttcgggttggtga

SEQ ID NO: 59465 - DNA, 173 bp, Glycine max
  Peptide Sequence Number=SeqID_151150
cttcttctcgactcattttctccttgaagtggcatctccaatcatctttcttccatcttcattctactgccattaatcttcaagaagcaaaggactccattgatgaagaagatccaaggcctagaagctccaatggaggtacatcatgtggtatcaagagcatcttcatctag

SEQ ID NO: 59466 - DNA, 468 bp, Glycine max
  Peptide Sequence Number=SeqID_151151
atggccccgaggaaacttgcctcaaagagatccaggaaggataaggcggccgaaggaactagttccgctcccgagtatgatagtcactgttttaggagcgctgaacaccagcagcgcttcgaggccatcaagggatggtcatttctctgggagcgacgtgtccagctcagggacgatgagtatactgatttccaggaggagatagttcaccagcggtgggcatcacaggtcacccccatggccaagttcgatccagacatagtcctcgaattttatgccaatgcttggccaacagaggagggcgtgcgagatatgaggtcttgggtaaggggtcagtggatcccgtttgatgcggatgctatcggccagctcctgggatatcctttagtgctggaagagggccaggagtgcaagtatggccagaggaggaaccggtccgatgggttcgatgaggaggccatcgcctag

SEQ ID NO: 59467 - DNA, 273 bp, Glycine max
  Peptide Sequence Number=SeqID_151152
atgaagaacgtcgaagaacggtcaaaaaccttcgcgaaatccctcacggaaacgtttcggaaacgttacggaagcgcctcggcttggattttcttcacggaaacaattttcctaagcaaattcgaaagagagagagaaaattgggggagaagcttgccacccagctcgcccaggcgagcagggttgcttcctccagaagcaacaaccttttggaggaatcttctggagggcccaagtgggcttggttgctatttgcacccccatttttactaa

SEQ ID NO: 59468 - DNA, 144 bp, Glycine max
  Peptide Sequence Number=SeqID_151153
atgggtgccaagtacctcgaagtggtcaaacgagggtcgcatcccaacaacggatggtccccgaacaaaattagggcaccaacaaagcacaaggatttaagctcttgcaaaccacaccctccctcgaacaactcctttacttga

SEQ ID NO: 59469 - DNA, 480 bp, Glycine max
  Peptide Sequence Number=SeqID_151154
atgatgctattgtttcttagaggagtccatgaggtggccacagattcatcttcatctactgaaaataaaaagcttgaaggaatacttgatgccttggtcaacctggtaactcagcttgccataaatcagaaatctacacctgttgcaagagtctgtcatctatgttcttctgcagatcaccatacagatctttgtccttctttgcaaaaatttggagtcaatgagcaacctgaagcttatgctgcaaacatttataatagacctcctcagcagcaaaaccaacaacagcagagtaattatgacctttcgagcaatagatacaatccaggttggaggaatcatccaaatctgagatggacaagtcctccacaacaacaacagcctatccctcatttccagaatgttgttggtccaagcaagccatatgttcgtccttcaatacagcagaaacaacaacaaccgtcacaaaaaagacaataa

SEQ ID NO: 59470 - DNA, 798 bp, Glycine max
  Peptide Sequence Number=SeqID_151155
atggggacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccatagcagagcctttgagatgcttcacgttcagagacttccaattagtaccgaccattgaagaatttgaggagattctaggatgtcctctcgggggaagaaaaccatatcttttctctggttgtctcccctctttgagcagaattgcaactgtggtcaaggattcagcaagcgctttggaccgcataaaacagactcgaaacggcatagcgggcctaccacggaagtacctagaagacaaggcaaggggtatggccaatcaaggagattgggtcccgtttatggatgtgttagctttgctaatttttggggtcgtcctctttccaaacgtggatggtttggtagacctagcagcaatcgacgctttccttgcatactaccatggcaaggaaagtccggtggtagctgttctggcagatttatttgacacatttgaccgaaggtgcgaaaagagtagcgcacggatcatctgttgcttgaccgccctctgtgtttggttgggttcgcacttgttccagcaagatacaaggcatccatgtccgctcctgagccatcgctcgtgtactgaaaagaggagaatagattgcgaccatcttttggccggtataggaggtagaacaatcagttggttcccccgatggaaggaaagataa

SEQ ID NO: 59471 - DNA, 513 bp, Glycine max
  Peptide Sequence Number=SeqID_151156
atgggactcaccctttacttgggaatgaagaggggaaagatagcatgtcacaagagcgaggcgaggtttgtaaccctactgcgagagggacgcctcgcgagccgggcttctagagatgaggccttttggcgaagccaagtcaatttcgggccaccaaaccctgcaactgatgagaaggcctatggagtaaagggaagcgtgtacgttgtcacactccctgccttcaaaagggggacaggagacggccatctcgaggcacatcacgacctacaggcaagaccggcgagacctgggaaggctacccgattgggagtcagaggatccatagtacctgcagccccgcggacttcatcttcatcatttttgaaagcggggggaagggatctcctttctgcaacggaaaaaaacggagcttatttgactcggcacaacctaacgatgcatccaataccaatgagattaccccatggcccatgtgaaagtgcaccaacacttccaagggagctattttaa

SEQ ID NO: 59472 - DNA, 330 bp, Glycine max
  Peptide Sequence Number=SeqID_151157
atggaggccatgaaagagcaaatggccacaatgatggaggccatgaagagcatgaagaagataatggaagccaatgcggttacagttgccgctactagcgctattgctaagacacatgaaattccccaccacaatctagctgacttcgagccttgcctcggatatgccactaaagggcaagcagttggtggtatacccatgccaaacactttgaagggccctcagtttcgcccacaaccaaaacccttgcattttgcggtgggaagagccccatgctatggcagaaatgggaaagttggatcatctagaggaaaggctcaaggacattga

SEQ ID NO: 59473 - DNA, 315 bp, Glycine max
  Peptide Sequence Number=SeqID_151158
atggataaagttgatatctttgtccctcatcctctcacaaacgcatgtttgcttattcaactttcaccggaatgtgggtgcaagccattggtctgtttgctcaagcgacctgcgctcctgagtgttgacttccaagactgttcaatcagagattactcgtcttgcacgttggtggggagaagcgagttgtcaagaataggatattggacaaatggcctcagttatcttaagaaagggggggttgaattaagatgcaaagactattccccaattgaactatcactctttctttttggattaacaatgcacccttaa

SEQ ID NO: 59474 - DNA, 168 bp, Glycine max
  Peptide Sequence Number=SeqID_151159
atgtcattgcccagcgctgttcatgtgtcctccattatcaagcgcgaagcctctgatgactgggaaacacaagaaaaaagaaggagtagagacgagagtcgtcatcacggaaagggcaggacggacgaaatcagtgtcctatctttgctttgctcttatctccgatga

SEQ ID NO: 59475 - DNA, 240 bp, Glycine max
  Peptide Sequence Number=SeqID_151160
atgctttacggtgccctcatcgaacttgatggagctagagtaatgggcaaagatttgggaagtatgggcggcccccatgatgtgcaaattcaaaacgagcacgccttcccgccatatggcttgcctctcaactatacgccacccaatgtggtgtacactcccaataagaatgtcaataactccactcctatacccattaagagccagcaaccccaaactgattatgcacatgtctcttaa

SEQ ID NO: 59476 - DNA, 438 bp, Glycine max
  Peptide Sequence Number=SeqID_151161
gcagaacaatcaactggtttcctcgatggaaggaaggaaatgagggagttctcttctcatgtggggactacccaaacatcccgttgatagggacgaggggttgtattaactacaatcccacacttgctataagacagttagggtaccccatgagaggagcattggcggaagagagcctctctcctttccttgtgagagatttcagcgtgcaaagttccaagattatacaaagagtccacaaggcgtgggaaagcccgttaaggagagataaagaacttaggggcatccgtaatggcattatcggtgaaagtgcagctaccgtaagagcccttgaacgagaaaccaagagggctcgcaaggaagagcatggtcgagacaaattctgtggagctttgtggggcagcaacaatgagcttaagcttcgaagggaagagagag

SEQ ID NO: 59477 - DNA, 586 bp, Glycine max
  Peptide Sequence Number=SeqID_151162
atggaaatgatcgcgcgcgttacgttgaatcagccgcacgacgcaggcgcgaccacggttccggcacgtaaattctttgatatctgccgtgggctgccggaaggcgctgagatcgcggtgcagctggaaggcgaccgtatgctggtgcgctctggccgcagtcgtttctcgctctccacgctgcccgctgcggacttcccgaacctggacgactggcaaagtgaagtcgaattcaccctgccgcaggcgacgatgaagcgtctgattgaaagccacgcagttctctatggcgcatcaggacgtgaagagctgcgtaccgtggccaccgacggccaccgtctggcggtctgttctatgccgattggtgacgcgctgcccaaccattcggtgatcgtgccgcgtaaaggggtgattgagctgatgcgtatgctcgacggcggcgatacgccgctgcgcgtgcagatcggcagcaacaacatccgcgcgcatgtgggtgattttgtcttcacatcgaagctggttgacggtcgtttcccggattatcgccgcgtattgccgaagaacccggacaaaacgctggaagcag

SEQ ID NO: 59478 - DNA, 309 bp, Glycine max
  Peptide Sequence Number=SeqID_151163
atggctacagccaggtgggcactcaagcatcccatttatggcactgtgatactacagtttggaatttacacagacaggcccaatgtttccaagacgacattcccaaatgaaaaactctacacggttccggaatttcaacaaacactattgacaacaacgaaaacacgaatctggggatcccacggtcatgtggctccgcatgccaccggactcttgggacacggtaacaaaaagtggggtggtcaacaaaagcagggcttttgctcctacgtatcctcaatttgtgatgaggaactcagacctacgtag

SEQ ID NO: 59479 - DNA, 372 bp, Glycine max
  Peptide Sequence Number=SeqID_151164
aataagagagggtacatctcttgtggatcagttctagtggaaggcacatccactaggttgttcaaagagaacaagggagggtacatcccttatggatctttgcttttaaaggactttacaaggttgaaaagaaatctcaaggaccgcaggaataggttatttcaagatcatgatgaagaccaagtcaacttgtgtctcatgacaaaatctcatgacaacaacaaagaagaatctataaggaagaagtggtacattgacagtggttgttcaaagcatatagcgggagatgtatccaaatttacaaccgtttcccccagaaaagtggacatgttacatacgatgacaacaatatcagtaaaatctcaaaaaaag

SEQ ID NO: 59480 - DNA, 183 bp, Glycine max
  Peptide Sequence Number=SeqID_151165
atggagcttattgaaaacatggctgctagtgatcacgccatcttgtgtgatagagtgcatgttgtgctatttgtggcggagctcacgaatcgggccgttgtatttccactgaagaacacaatcatgaagttaactatatgggaaatcaacaaaggcagggttacaatcaaggtggatacttag

SEQ ID NO: 59481 - DNA, 513 bp, Glycine max
  Peptide Sequence Number=SeqID_151166
atggttaaggaggagtgtaaggaggtaagtgtctcctccaagaggttagctaagaaggaaagtcattttgaaataaagacaaatattaaagaaacttccccacttagacaacctctacatcttctcctttgtaaaaagacacttgttagcactgccatgcctcttgggcttgaggttattcctcaagtaaaggagttgttggatgagggtttgattcataagagcttaaatacttgtgctttgttggtgcctaaaataggtgttttgacgataacaatgatgacaataaaagatgatgacaaaggtgatgaacaaaaagctcaaagatcaaagaacaactcaagtgaatcaagaacaagtcaagagttcaagaatcaagaagaattcaagactcaagtagaaagcctagaatcaagaatcaagattcaagattcaagatctcaagaatcaagatcaaggttcaagactcaagattcaagaatgaagaaaagactcaatcaagataagtattaa

SEQ ID NO: 59482 - DNA, 411 bp, Glycine max
  Peptide Sequence Number=SeqID_151167
atggtgaggacgtgtagtcctctaaaggtgacggcgtgcgaccctcttatggcgaggacgtgttgtcctctaaaggtgtgggcgtgcagccctctgatggagaggacgctgccgccccttgggacgggcgtgggggtgctaatccttcccacgtgcagtaaatacaactcccgacctttcactaaaaagttcgtagatcgcgtcttttccggtttttccgacagttttcctcgaataaacgttggtggcgactccgcgcgtattcctttcgtggaacacgcatcccgcgagtctcgcgtcgccctcccgccgaagggtgagggcgtgcagcccttgatggtgaggacgtgttgtcctcttaaaggtgagggcgtgcagccctctgatggcgaggatgtagtggtcctctaa

SEQ ID NO: 59483 - DNA, 303 bp, Glycine max
  Peptide Sequence Number=SeqID_151168
gaactttgtaggagaaataaagagattcgaagcaagcaagttattccacacactggtggatccaaagctaatcctagaagaagaaatgagttgttgttagaaactgggaagctaccaagtcgtggacaattatatattgaaactcataaaaggaaagatggatcatttgtaaatgaagcagcaaagactatagcggaacaaattgaagtaggattgactcaaagcatagttgatgaatctgaagtttctcctcttgatgttgttggtagagtgttagggttagagcactctgggagagtgtga

SEQ ID NO: 59484 - DNA, 390 bp, Glycine max
  Peptide Sequence Number=SeqID_151169
atggaatacggtgcaaagaaggataaggagcttaggggaagcataaatgggatcgtcggcggctatcacaagtggctgaaggctagaacgcaagagataacttggctcccgaagctaaagatctcaagtgaggaagagactgaaacccctgaggagagcgaggaggtacaagccatgaaggtggaacttgaaagagtgcaagcggtcaaggaaaagttcaagaagatggccatcaaggtccgaaaagagtgcgatgagctgagggaccaacagcgagctcaagctttgaagagccgagagagaccagttaagagtcgaaggtatgatattagaggacaagttgaaggcttatcaaaggtcaaagaggagcttgtccgaatagttgagtag

SEQ ID NO: 59485 - DNA, 294 bp, Glycine max
  Peptide Sequence Number=SeqID_151170
atggagcgttatctacagcatttggttcgccagcaagcggccaaccatcgggggcaggtgcaggtacatgagtgtctctatcggttcagcctcagtcagcaggggcagggcttcgctccttttgcttgccctactccagagcagtttggggctcaggttgcatggcccggagactggcctgaggcccaggcaggggaggagcctgcaggatcccccggtgaggcagaggaggcccgtatggatgaagaaatgacagacttgcttggtttcttgggaggaagcggagccacgtga

SEQ ID NO: 59486 - DNA, 162 bp, Glycine max
  Peptide Sequence Number=SeqID_151171
atgacgccactcccggtgaaggaagataaaaatagatatgggccttctcatgagaatcatgaaactggccaaatacaggctaaaggcctaagtggagaaggacgaagacccaagtggagaaggatgaaggcccagaggcaaagacactatcaagactattaa

SEQ ID NO: 59487 - DNA, 312 bp, Glycine max
  Peptide Sequence Number=SeqID_151172
atgtaccctcccttgttctctttgaaccaagtggatgtaccctccactagaactgatccacaagagatgtaccctctcttgttctcagtcaacaacccaagtagatgtaccctctacttgtaccacaaaggatataccctccaatgtgttaagacaaagatctctggcgggagaagagagacacaagaattcaggcgcttagtcctttgttcttttggaaaaggtagaagagagacacaaaaagaattcaggcggttagtccttggcgaattctttttggcaaaggtagaagagatgaaaaagaatgaatag

SEQ ID NO: 59488 - DNA, 171 bp, Glycine max
  Peptide Sequence Number=SeqID_151173
atgtccccagtggagtcgccaactgtcgcaacgtgcccttcgcgggcgagcgagggcgaggctcacgggtcgacaaaagcggggctcttgctcctacgtacctccatcaaagagaaatcagacctacgtagtccttcgttatgcgtgaatcaagcgattctttatacttga

SEQ ID NO: 59489 - DNA, 559 bp, Glycine max
  Peptide Sequence Number=SeqID_151174
atgagtcatcattcatctagtgttaatggcgagggaaggcataggtcacatcttagacctcactcccataggagagaaaaggaaagaaatcctcaagaggctaacattaacctctcatacttccatgggaaggacaatgtagaggctaacttagattgggaaataagggtagagcaaaaacttaaaagaaagtctactttaaaatcttattgctctcactcttatccaaagaaagaccaaggtctaggcatcttagaggctgcaccttctaagcccaaaggtgataaggggaatacaatagaaaagcaactccctaaggctagtatgcaagagaagactagctctataacgtgctttaaatgtcttggaagaggacacattacttctcaatgccccaccaagaaaaccatgattatgaggggccaagacatttatagttgccaagatgaggctactacttcaccttcctctagtgaatgtgaagaagcaaaaggggaagaatctagcgaagaaatctacccccaagaagaaggacaaccattaatggttaaggaggagt

SEQ ID NO: 59490 - DNA, 384 bp, Glycine max
  Peptide Sequence Number=SeqID_151175
atgacaagtatcgttacgaaattcgtaaaactttgtaacgttatagaaaaagaatcaccagaaaaagcaaagggattcttcctccagaaggcggttgcttctggaggaagcaacctggctcgcctgggcgagctgggtggcaagcttgatgcaagctccattggagcttgtaggcctaggatcttcttcatcaatggattcctttgcttcttggaagataaatggcagcggaatggagaaggactatatggtaatgatgctgatgttgcacctgaattttctcctttgaaaattgttgaatttggaaatccttctcatgacactcttgacccaagagatagaggctttggaggaagactatggagatggaaatgggaaaaatga

SEQ ID NO: 59491 - DNA, 321 bp, Glycine max
  Peptide Sequence Number=SeqID_151176
atgtcccatgctgtcaaggacaatcgagggaaatgggccccgaattacgaagggccttttgttgtgaagagggctttctccggaggagccctggggcaggatcatcttgagctaccttctggggtagggaaaaaacataaacagcagaaaccaatcaaggtacacaggaacggatgcaagtggggatggggtcacgaccgactgatcgtcgcccctttctccatgctaaacaagcagagaacgtcgctgcaaggcagccccgttagctcgcctgggcgagctgagctcgcctgggcaagcaacccctgcaccaaaatataa

SEQ ID NO: 59492 - DNA, 159 bp, Glycine max
  Peptide Sequence Number=SeqID_151177
atggagtcaggaaggatccaagttagtgtaccaagtaacagctaccccagggtgtggttgtgggtgatactgagggccttccaaagtgttttggaggggtataccaccaactgcttgcccttcagtggcatatccgaggcaaggctcaaagtccgctag

SEQ ID NO: 59493 - DNA, 678 bp, Glycine max
  Peptide Sequence Number=SeqID_151178
atggctatacaccctcgccttcaaaggacttcacgtcctcctcttcagagggctgcacgccctcgccttcagaggactacacgtcctcaccttcaaagggctgcatgccctcaccttcagaaggttgtgggccctctccttcagagggcctcacgccctcaccttaagaggactacatgtcctcgccttcagatggttgcacggctgcacgccttcgccttcagagggcttcacgtccttaccattagaggactacgcatcctccccttcagagggctatacgccctcacctttagaggactaaatgtcctccacttcaaagggcttcacgccctcccattcagaggactacacgtcctcctcttcagagggctatgcgccctttccttcagaggagtacacgtcctcgccttcagatggctacacgccctcgccttcaaaggactacacgtcgttgccttcagaggtctgcacgccctcgcattcagaagactccccgtcctcaccttcagagggctacacgccctcctctatagaaggctgcatgacctcaccttcagaggactacacgtcgtcgccttcagaaggctacacgccgtcaccttcagagggatacacgcaatctttagaggactatacatcctctccttcagaggactacatgtcctcgccttttga

SEQ ID NO: 59494 - DNA, 441 bp, Glycine max
  Peptide Sequence Number=SeqID_151179
atggaacttcaacgtctcaacccaaatgaagagaccgacaaaaggaaaagaagcatggcactcaaagcctcctcctccatgcaagaagaagaagaatttgatgatgaagaggacttctcactctttgtgaagaagtttcataaatttgtcaaaaatagaagaatggagagacgccataacttcaacaatgggaagagatctcaagaaggttccccaacacttaaatgctataagtgtaatcgactcggtcacataaaggcacactgccccacaaatcaatcatggccaaagaagaatgagaagaaaagccatgaagaaagaagatccaagaaggcgtatattgcatgggatgacaatgactcatccgatggttcggagaaggagataaaccttcaatccaaggactatgagagcgatgagaacatctctcaagaagattaa

SEQ ID NO: 59495 - DNA, 96 bp, Glycine max
  Peptide Sequence Number=SeqID_151180
atggctatggataacaacaaagatgaagggaatggaggatgcatcactgtatacgtggggaattgttctggtcatatgcgaattcaatactgctag

SEQ ID NO: 59496 - DNA, 75 bp, Glycine max
  Peptide Sequence Number=SeqID_151181
atggagaggataaagtgtgattcaatcgtgaggattgaggagctcaagaagcaacaaggagaggtgacaaagtga

SEQ ID NO: 59497 - DNA, 1671 bp, Glycine max
  Peptide Sequence Number=SeqID_151182
atggagcaagaaatggaaaagagaaatgtagtcagaattgaagaaaatgaagagaaatgggtgcatgatgcatctgtggattataaaggcagagttcctctccgtgcttccactgcaattgaacttagtgaaagagtaagctactttgggatagccactaatcttatctcgtacctgactaaagtgatgcatgaagaccttcaaacagcggccaagagtgtaaactactggtcaggaacaacaaccctgatgcctcttgttgggggatttgttgctgatgcctacactggcagattttatatgatactgttttcttcatttgtatacctcatgccagggattaagcctgctgactatgtctcaattcatcccaagtttaaaaccatgcaacaatggggtatgccatcggccaaggaagctgatcaatttgatgatgatcacttggaagaaaggaagaagaaaatgtctttttttaattggtggaatttcgctatgtgctttgcattgctgcttggtgcaacagtggttgtttatgttcaagactttgttagctggggagttgctactcttattgtcactattcttatgactctcactgtcatagctttctgtatgggaaaacgtttttacaggtacaggaggacagaaggaaaccctttaacaccaattttacaggtcttaattgcggcaatgaggaaaaggaatctatcttgtcgttcaaaccctgctttgttgcatgaggtcccagagtcagagaggtctcaaggaaggcttctgagccacactaacaggctcaggtttcttgacaaggctgcaataattgaagagaaacgtatcgaacagaagtacaatccatggagattagcaacagtgacaagagtggaggaaacaaaacttgttctaaatataattcccatatggctaacttcattaacagttggagtaaccgtgggacaaggacagacactctttgtcaaacaagcagccgctaccaacttaaagataagccacagtttcaaaatcccaccagcttccatggcctctgttacagcagttggtaccttaatagctgtcccaatatatgataggattactgttccaattatgaggaaattcactggcaatgaaagaggcatcagcatccttaggaggatcagcattggcatggcattatctgtcatagtcatggttgttgctgccttagtagaaggaaagagactaagaatggctacacatgaagtcctcactgtaggggaaactaggcatgagactatgagtgtggtgtggttgataccccaatacttgattcttggcgttggagattcattttctctagttggcttgcaagagtatttctatagccaagttcctgactcgatgagaagcttaggaatggctttgtatcttagtgtgcttggagtaggattcttcttaagcagctttctaatcatcattgtggaccgtgtcacggggaaaactggcaatagttggattgggaaggacataaattcaagtcgtttggataggttttattggatgttggctgtgattaatgctttggttttgtgtgtctttctcttggtgataaaaaggtacacttataaggccgttcagagaagagctattgaaactgattgttgcaagagtgatggggtggagatggtagcttga

SEQ ID NO: 59498 - DNA, 1497 bp, Glycine max
  Peptide Sequence Number=SeqID_151183
atggctcaaggagataatgggtcctccaaatcttcgtcagtgactccgtatgaagaagcattggatgccttgtcatctctgatcactaaacgcactcgtgtcggtgatgtcaatatggaggaacgattcaacgtgctttataagtacctaaagatgcttgatttggaggaggcgatttcaaatatgaagattatccatgttgctggcaccaaagggaagccaggctctgtgaatgccgtgactgcagagtatggtggtatgttaggatccaattgtaaggaaaatactgatgacaatgttccaatgcctacattttttcacttccttgctttacttgccttcaagatatttgcagcagagcaggtagatgtttctataatggaggttggattaggtggaaaatatgatgcaacgaatgtggtcccaacacctattgtgtgtggtataacctcccttgggtatgaccacatggagattcttgggaatactcttggagaaattgctggtgagaaagctggtatcttcaagcatcggattccagcatttactgtgcctcaacctgatgaagcaatgcatgtactcagagagaaggcttctcagttaaatgtacctcttcaagtggtaaccccattagatgccaaattgctaaatggttcaagactagcgcttggaggtgaacaccaatatataaatgctggtcttgctattgcattatgctctacgtggctgaaaatgaatgggcatcttgaagactctgactcatctgcctgtatgaagcaacacactttaccagagaagttcataaaagggttaacaactgcaagtttgcaaggaagggctcagattgttcctgatcagttcatcaatgatgaaataccaaatgaacttgtcttctttttagatggggctcatagtcctgaaagcatggaagcatgtgccaggtggttttctcttgctattaaagatcaagaccagattttgtttcatcagaaacttgataattctaacttctcaaaccaagtagtgaagatgcacaatggtgaaactgtacagaagaaatccacacagattttgctgttcaattgtatgtctgagcgaaaccctcagttgcttcttccccacttgatgaaaacatgtgctgatcatggtgtctacttcaagaaggcactctttgtacctggtttatcagtgtatcacaaagttggatcccatgctttaccagcgacagattctgatgttgacctgtcgtggcagcttactctacaaagagtgtgggaaaatctcatgcaagggaacaaagtcacttggctagaaggcaagagtaataattctgctcctgaagaattaaacatggaaatgagtgccagcaattgtgaacacagtgccgtgttttcctcattgccactggttctcaaatggcttagggacacggtgcaacaaaaccagtcaactcgttttcaggtaacattaattcatggttacactggagaattgtga

SEQ ID NO: 59499 - DNA, 2052 bp, Glycine max
  Peptide Sequence Number=SeqID_151184
atggatggagagttcggtgatgatgcatctcaaaataaggattgcatggatttagatgaaaaaggaaaactatgcaacaaagttggtgaaatggatgttgatgagtgctataatgaccataggttctcggaaaactgtaaacttgtgaagaacattggaaaagttgttcttgatcttaggaatcttggatttacttccacggctgaagatgcttatgcttctgctatatttttactactgaaggcaaaagtacatgatgtagctggtgatgattttcggagttctgttttacaatctatcaaaagctggatacaggctgttcctcttcagtttcttcatgcgcttcttgtctatcttggtgatgtcgttagttatgagagtacttcatcaggtctgaaatcacctttggcaccacagccatcttcatgctgtcctggaattgatactccctctgaagggcttgtgagatggaagttgcggctggaatattttgcatatgaaacactacaagatttaagaatagccaaattattcgagataattgttgattatcctgagagctctcctgcaattgaagacttaaaattgtgtcttgaatacactggacaacattcaaagctggtggaatcatttatttcagcactgcgttatcgcttgcttactgcaggcgcctcaaccaatgatatattacaccaatatgtttcaactatcaaagcacttaggacaatagaccctgcaggtgttttccttgaggcagttggtgaacccataagagattatttaagaggaaggagagataccataaagtgcatagtaaccatgatgacagatgggactggtgcacattcaagttcatctggaaatcctggagatagccttctcgaagagttgaacagagatgaagagattcaagagaatgctggtgttgatgatgattttaacactgatgataggcaagcatggatcaatgccatgcgatggcaacctgaccctgtggaagcagatccattaaagggaagcagaaaccaaaggaaggttgacatccttgggatgattgttggcataattggttcaaaagatcaattagttcatgaatatcgaactatgcttgccgagaaacttctaaataaatcaaattatgatattgattcagagatacgtactttagaactcctcaagatacactttggagagagcagcctacagaaatgtgagattatgctcaatgatctaattggctcaaagagaatcaacagtaacattaaagctaccataaatcagccatctcagaccagtgttgaattgggagacagtgcaatatccatggatgtaatttctgctactatcatatcttctaatttctggcctccaatacaggatgagccccttaacctgcctgagcctgttgaccagctcctatctgattatgcaaagagatttaatgaaatcaaaacaccacgtaagctgctgtggaaaaaaagtcttggaaccatcaagctggagttgcagtttcaagatagggaaatgcaattcacagtagcacctgttcatgcatctatcattatgaaatttcaagatcaaccaagttggacctctaaaaagcttgcagctgctattggggtacctgcagatgttttaaatcggagaataaatttctggataagcaagggaatcattgcagagtcacaaggggcagattcctctgaccatgtatacaccattgtggaaaacatggctgagccaagtaagaatggagccagtactggttgtgctcaggaacttctaggaggtgaagaggaggaagagagatctgtggcatctgtggaaaatcaacttcgtaaggaaatgactgtatatgagaaatttatcctggggatgctcacaaactttggtagcatggcattagatcgaattcacaatactctcaagatgttttgcattgccgatcccccatatgacaagtcactccagcaactacaaagctttttatctggtctagtttctgaggagaagttagaacttcgggatggaatgtactttctaaagaagtag

SEQ ID NO: 59500 - DNA, 420 bp, Glycine max
  Peptide Sequence Number=SeqID_151185
atggtgtgctcagaaacaagtacatcgaaccttataatggatatcgttaggagcatgttaagtaattcatctttacctgtatcatggatgtatgctttaaaaattgtcatgtatttgttgaacaaagttcctagtaagacagttcaaaagacaccttttgaactatgtgcagtacaagaattgttgaaactgaaaatactatggttcattgagaatggtgaaaccagtgggagtgaagcttcacaaattgtggagattaaggaagttagagtacaagttcctttaactagtgcttctacttcaagaatttttgttccttatactgttgaaccacactttaacaatcaagaagagcaacaaattaatgatcccgaggttaacaatgaacctatagtagaacaatcacaagaaatagtataa

SEQ ID NO: 59501 - DNA, 156 bp, Glycine max
  Peptide Sequence Number=SeqID_151186
atggctatttatagaaaaagccatttggggcagaggcaactcgccttggcgagctggttgcttcatcttgaaggtattagtacgcccaggcgagctggagctcacccaggtgattcagatactagcctgggcaagctagggtccagaaatttctag

SEQ ID NO: 59502 - DNA, 534 bp, Glycine max
  Peptide Sequence Number=SeqID_151187
atgtcttcaaggaaaagaaagagcgtcagttcaaggcccaccactcaatatgatacaagaagattccactcttttgaggcttggaccagatatactgacaatgtgttgggaagacacatattagctgagaggaaagtggaaatctatcacacagagctggatgaattcaagggcgagctggagaggtgtaactttcacaagcgcctcaccaactttgctgatagtagcattgacctcgcattggtgaaggagttctacgccaagctctacagtcccgaggggccttcacctaaacaagtcagaatccgaggccacttaataacgattgatgcagacagcctcaatgcctttctagaaacacctgtggtgcttgctgagggtgaatctttgcccgcctactcaagatactacaggatgcctactgacattagagaaattaaggttgcactgtgcatacccggccgagggtttattctaaatgttgaaggtcacccggggaagatcctcagaaaagatctaaacacccttgctcag

SEQ ID NO: 59503 - DNA, 438 bp, Glycine max
  Peptide Sequence Number=SeqID_151188
atggttagaacacgaggtttaggtcgtgcgttaggagctggtagaggtagaggcattagtgaggatgcgcatgaggctaatgttcctcggcgtcacaggcctattgcttcagcacgtaggcaacgggttcatctgcatgaggacgtcactgagagacatgaggatgtgcctcagttgcatgaggatgttcctcatgtgtttgatgccacccctgagatgacaggcgccgccgatgctgttcagacaaagggagtggctactgatgggagcttggggtcacttgctacagatgagggattccccggtggaccacgcgacccatcgattttgaccgattttgctgagcatgtcacacacaacatctggagtggacagcccgggggatccactagttctagagcggccgccaccgcggtggagctccaattcgccctatag

SEQ ID NO: 59504 - DNA, 765 bp, Glycine max
  Peptide Sequence Number=SeqID_151189
atgccgatcgacattctgcgcgtgcgtgatgacgatattccaggcctggtcatggatggcgtcgttgatctcgggattatcggtgaaaacgtgctggaagaagaattgctgacccgccgtgcgcagggcgaagacccgcgttacttcaccctgcgtcgtctggattttggcggctgccgcctgtcgctggcaacgccggttgatgaaccctgggacggtccggccgcgctgaatggcaaacgtatcgccacctcctaccctcacctgttaaagcgttatctggatcagaaaggcgtgcagtttaaatcctgcctgctgaacggctcggttgaagtggcaccgcgtgcgggtctggcggacgctatctgtgacctcgtctctaccggcgcgacgctggaagcgaacggcctgcgcgaggtcgaagtgatttaccgctccaaagcgtgtctgatccagcgtgatggcgatatggccgatgccaagcagcagctcatcgacaaactgctgacccgtattcagggcgtgattcaggcacgtgaatccaaatacatcatgatgcatgcgccgaccgagcgtctggatgaagtgattgccctgctgccgggcgcagaacgtccaaccattctgccgctggcgggcgatcagcagcgcgtggcaatgcacatggtcagtagcgaaaccctcttctgggaaaccatggaaaaactgaaggcgctgggcgcaagctccattctggtgctgccaattgagaagatgatggagtaa

SEQ ID NO: 59505 - DNA, 156 bp, Glycine max
  Peptide Sequence Number=SeqID_151190
atgtccccggtggagtcgccaactgtcgcaacgtgccctttgcgggcgagcgagggcgaggctcacggatgcgctttccaaaggaggaaaggtcgacaaaagcggggcttttgctcctacgtaccctcctttggagaggaaatcagacctacgtag

SEQ ID NO: 59506 - DNA, 333 bp, Glycine max
  Peptide Sequence Number=SeqID_151191
atggggatcgcacccacaaagacacccagtgaacctgaagaagtccaacagggccctggggtttccagctctggttacggccctctatcagtcctacagggtgcccgtacccccccggcaaggtcacgtcatcatagggatcgcgactgcaagacacctagtggacccgaagaagtccaacagggtcttggaattttctacggagtacctatcacctccagcaagggcatcaggccccctactaatcgagctttcatcaagaagtactgcgccccagacaggcgcagggcgaaacaccacagcagcattgggatggtcggcagcgggaaatag

SEQ ID NO: 59507 - DNA, 172 bp, Glycine max
  Peptide Sequence Number=SeqID_151192
atggatggtcagtgggtatggaagcaagacctgccacctgtcgttcccgataagcgtacaccgtctccaccaccgcaacgggataactcttcttctctcttgactgaagtcctcactgagctctgtgatcttagagcttttgtcgaacaacgctttgatgcgatggattctc

SEQ ID NO: 59508 - DNA, 249 bp, Glycine max
  Peptide Sequence Number=SeqID_151193
atgaggggcatcgtgcatgagcctcaagtgaacataggggcagatcaaaagttctcacctgtcgatgtttttaaacaagaaaaagaaaaagggggacaaaccctagttaccctcaccgttgagagggctacacgtcctcgccttgagaggactacatgtcctcaccatcagagggctgcatgccctcacctccagaggactacacgtcctcgccttgagagggctacacgccctcaccttgggtactag

SEQ ID NO: 59509 - DNA, 303 bp, Glycine max
  Peptide Sequence Number=SeqID_151194
atgggtgatcaagaggagacacaggaacagatgaaagccgacatgtcagctctgaaagaacaaatggcttccatgatggaggccatgttaggaatgaggcagctcatagagaaaaatgtggccaccgctgccgctgtcagttcggctgccgaagcagacccaactctcttggcaactgcgcaccatcctccctcaaacatagtaggacggggaagggacacactggggcacgatggcaacccttatatgttcttggtagaaataggaatagtgggggcaagatatgcgggctggactaattaa

SEQ ID NO: 59510 - DNA, 632 bp, Glycine max
  Peptide Sequence Number=SeqID_151195
atggggacaaatcaaaacggcaaaaggttttatcaagtcaaggttaaaagtctagatgtcaccagcctcaaggaattgggacgattgatgggacctctccaaaggcaagcctttcgcaaagtgtacggaaagattctagatttgaccgcgacggaggtatttacggaggctgtcatatcccttgcccaatactatgaccagccgttgaggtgcttcacgtttggggacttccaaatggtaccgactattgaagagtttgaggaaatactaggatgccctcttgggggaagaaaaccgtatcttttctccgggtttcttccctccttgagcaagattgcagctgtggttggagattcggcaaaagagatggatcgcatgaagcaaattcgcaacgacgtagtgggcctgcctcggaaatacttggaaggcaaggcaagggatatggcgagccaagagaagtggagcccgtttgcggatatattagctttgttgatttttggggttgtcttttttccaaacgttgacggtttggtggacttagccgccattgatgctttcctcgcatatcaccatagcaaggagagtccagtggtggctatcttggcagatttgtttgacacctttgactggag

SEQ ID NO: 59511 - DNA, 327 bp, Glycine max
  Peptide Sequence Number=SeqID_151196
atgcacacacaaagtttcacaattccacaattccttaaaataggcctaactcacaaaaaacagtccccagtggagtcgccaactgtcacaacatgcccttctgcgggcgagcgaggcgaggctcacgggtgcgctttccaaaggaggaaagatgcgcggagtcgccaccaacgtttatttgtggaaaacgtcgaaaaaactgaaggaaatcggtcaaaaacgaaaattctaagttcgggagttgtatttacgtttgaggaaggtcgacaaaagcggggctcttgctcctacgtaccctccatcgaagaggaaatcagacctacgtag

SEQ ID NO: 59512 - DNA, 228 bp, Glycine max
  Peptide Sequence Number=SeqID_151197
atgagtgaacggattgtcatcatcaaaaaggggggagattgtggaagcaatgacttccaagattattttgatgatgccaaagaatcaagagttaagcaagtttcaaagaatcaggagtcaaaaagcttcaggaatcaagtttcaaagattcaagattcaaagaacaatcaagtttcaaagaatcaagattcaagaatcaagagaagactcaatcaagataagtactaa

SEQ ID NO: 59513 - DNA, 306 bp, Glycine max
  Peptide Sequence Number=SeqID_151198
atgtatgtatgcaacgctccagcctttgtagatgagctgaggggctatggaggtggcagcggtgcgtctattgcccgctgccggccatccctaggctgctgtggtgtctcgccatgcacctacctggggggtgcaatacttctttatgaaagcccgattaatagggggcctgatgaccttgttgggggcgacgggcactccctagaactgacaaaggcccgtaatcagagctggaaatccaaggaccctgttggacttctcagggtccactgggtgtcttgcgggcgtgatccctgtaaacaatag

SEQ ID NO: 59514 - DNA, 603 bp, Glycine max
  Peptide Sequence Number=SeqID_151199
atggattgtagcagctcgtgcttatctcctgcacctgaggcttttcgcgacctgggtcaaagtgggggctatgcttggggagctgtggccctggttcatatgtatgaccagttagatgaagcttcttggaccacgacacgacagattggggggtaccttactttattacagtgctggatctatgagcattttctgagtgtgcatcagtgtgtcaccgatgatgcgtatgaggagacgtcccctcatgcctcccggtggctaacgacgaaggctcatatgaagggaattacaggagctccgtaccgggcacattgtgatgctttcacggtcacagacgtgtgctggtttccttacagtgaccatcgaggggttagggggtttgagttgatttcatcgttccagggtcagctgagatggggtcctacggtggtcgcagttcgaccgaagagggtactatgccagtttgggtacattcagagcatccctccgtcgcctgttagtgtttccttgtcatatgatgatatagatgacaggtggatgcatttcatgcatttttcggaccacgtagtagctgtgggtgacctttgtgtagtgcttgggcag

SEQ ID NO: 59515 - DNA, 531 bp, Glycine max
  Peptide Sequence Number=SeqID_151200
atggctgagaagacaaagaaaaaactggaggaggctgctcaatccgtaagcactgagggcgtgattgaccctccatctcccatcagacgacacgtgaagtggaagatggcccccattaagaaaactaggcaaatgacgtctgaggcagcaaaggaaattgctgagaagattgcgtcacagggttcgtttgtcccacatggacgtcgggatctcttgactgctgccgttgggcgaccagaacaccctggccgtgtacgtgctgttggagccggtgtgaccataaagcaatactttggattggctccacgaacctcccgcagttcttcctccatggcttccaaagaactcgagcagctaactcaacaaatcagggaccaactggaggagtcgatcacaaaaaaacctgaggttggtacctcagctgctcgtgtcagcacaaaggggagttgtgttgatctctcaccgaccgatccagacacgggcgactcagaacaaatgcggttgtacatcgaagaaaatcctttctgcctg

SEQ ID NO: 59516 - DNA, 204 bp, Glycine max
  Peptide Sequence Number=SeqID_151201
atgaaacgtcatgagtttgtgtgggagccttacccatcaaccgttatatcatttttgcctcccatttgtttagtcggaagtctcgcgtggtacgcagtggtgccactaatttgtttccaagttattgagtggcaccaaccggacagagtgttgagacaatttgggatgcagcaaccagcccagagtctccttcacaacccttaa

SEQ ID NO: 59517 - DNA, 528 bp, Glycine max
  Peptide Sequence Number=SeqID_151202
atgcccttgtggggtaagattgcatcagttggcctcctagccaagcaacctgggctaggaatgcctcttgtgtcaacaccagctactggagggagagatggtggaggctcttcatcagtctggccggtaggtggaagggagacatctggaggagggaccgctggtggaggagctggtaaaatgtctggaatggctcaggaatacagaattcaggtgtcccccaaagaggttagctttttgctcaatttcctccaccttaaaacaagtcttgctgtcattgggatgcttacttcccttaaacaagttaaaggtgactttctagtcttccacactcatctccaagttgcccttcctcatgtccacaacacacttggtagtcaccatgaatggtcgacccagaatcaaggggatctcaacatcttcttcaatgtccatgattacaaagtccaccggaaaagtgagttgaaggactttgatcaggacgtcttctaccactttgactggtcttgtgatggagcggtctgctag

SEQ ID NO: 59518 - DNA, 297 bp, Glycine max
  Peptide Sequence Number=SeqID_151203
gtcgactctagaggatcccaccatttggttcgccagcaggcggccaaccaccgggcacatgtacagacccatgattatctttaccagttgagcctcagcctgcagagccagggttttactttttttccgtgccctactccggaccagttcagggcagaggtcgcatggcctggagattggcctgaggcccgggcaggagagacgccagcagaggctcccgacgaggcagaagaggcccgcgaggacgaggagatgactgatttacttgatttcttaggagggagcggggccacatga

SEQ ID NO: 59519 - DNA, 165 bp, Glycine max
  Peptide Sequence Number=SeqID_151204
ataagtgaacccaaccttggcacatgggctcaaaaatctaccccgaggttcatgagaaccctagggccttctttagcagctctaactcaatcctcttggagcctcttgctcatggctctggtaattagtcccttcctagggaggattgcatcaatgatcgattag

SEQ ID NO: 59520 - DNA, 333 bp, Glycine max
  Peptide Sequence Number=SeqID_151205
gtaggctccaagatctctgaatggactgtggctcgaggaatccatacaaatcagaattccccgctcacaaacttgtctcagtcagatggctgtgttgttaagacaaaatatgctgagacattgaccaccgtgtgcaatttcagagagatcttcgtgctttatatacaattggaagttttgattaaacaccctgaatatggtagcatcccacataacctggagaggcttcaaaaacagttgtgggatgatcaatgtccaagtacaggggatctcgacctcaacatccgggcctttggagttttgctggagacatcagctccttgtcaaacatag

SEQ ID NO: 59521 - DNA, 762 bp, Glycine max
  Peptide Sequence Number=SeqID_151206
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagtagaggtgtccatagaagccgttgcatcacttacccaatactacgaccagcctttgaggtgcttcacattcgcagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacagcatagcgggcctaccacagaagtacctagaagacaaggcgagggacctagtagcaatcgacgctttccttgcctaccaccatagcaaggaaagtccggtggtagctgtcttggcagatctatttgacacatttgaccgaagaatagattgggaccagctcttggccgggatgggaggtagaacaatcagttggttcccccgatggaaggaaggaaaagaaggagtccttttctcatgtggaagatacccaaacattccgttggtaggaacgagcggttgtattaactacaatcccgcgctcgctataagacaactagggtaccccatgaggggagcaccgactgaagaaagcatgtctcctttcctt

SEQ ID NO: 59522 - DNA, 653 bp, Glycine max
  Peptide Sequence Number=SeqID_151207
gccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccgccttaatgctttttgctggttggtttcattatcacaaagctgctccaaaattggcttggttccaagatgtagaatctatgttgaatcaccatttgacagggctcctggg

SEQ ID NO: 59523 - DNA, 878 bp, Glycine max
  Peptide Sequence Number=SeqID_151208
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccccacatccagtttcccacatcttacattggtatgtctttgttacaattagtgaacctctactgctacattactgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59524 - DNA, 519 bp, Glycine max
  Peptide Sequence Number=SeqID_151209
atggtggggtacgctccttcaagctttgcagatttggtcttcgccagagaaaggatcgaagtgggtctgaaaagaggcaaatttaatcatcctgcttgggcgaatgagaaaactggggcaaatgaagaaggtgaggatgagggagaaacccatgctgtgactaccattcctatacggccaagtttcccaccaacccaacaatgtcattactcaaccaataacaaaccctctccttacccaccacccagttatccacaaaggccatccctaaatcaaccacaaagcctgtctacctcacttctaatgacgaataccacttttagcacagaccaaaacaccaaccaagaaatgaattttgcagcgaaaaagcctgtagccctaacccctgctaggtttcctcaacctccatttttccgagggtacgactcgaacagaatgtgtgtttatcatggaggagccccggggcattccattgagcattgtatgaccctgaaacgtaaggtgcaaagtctaaattga

SEQ ID NO: 59525 - DNA, 854 bp, Glycine max
  Peptide Sequence Number=SeqID_151210
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaagctatcaacagcaagcaattagacaatgatcatattatttggatacttagcaccaggaatcttttccagctccgggaaacttttgcatgctacaataacctctatgggaatacattggaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59526 - DNA, 264 bp, Glycine max
  Peptide Sequence Number=SeqID_151211
atgcagaacagcagggtcaccctaagggttgaatctcaacactttgcaacaacaccggtgttgcgtaccgatgatataggatttacgctggtagacctaaagaaacttggttaccacaatgactccttcatcatggcagaacaagctagacaaggcaaaacaattggtgttaatgtagaagatgatgattcatacatggacacctatgctagtcctttgaccgctcaaatcactgagacagaggtcaccaaacctagtaagtga

SEQ ID NO: 59527 - DNA, 423 bp, Glycine max
  Peptide Sequence Number=SeqID_151212
atgttattgcctagcgctattcatgcatcctccaccaacgaatctggagccccgcgaagtgattgcatagcgctgttcgccaattctccgttctccacttttttttcggagccccatgaatgttattgcctagcgctgttcatgcatcctccaccaacgagtctaggagccccgcgaagttattacgtagcgctgttcgccaattctccattctccactttttttcggagccccatgaatgtattgcctagcgctgttcatgcatcctccacctacgagtctggagccccgcgaagttattgcgtagcgctgttcgccaattctccattctccactttttttcggagccccatgaatttattcctagcgctgttcatgtgtcctccacctacgagtctggagccccgcgaagttattacgtag

SEQ ID NO: 59528 - DNA, 391 bp, Glycine max
  Peptide Sequence Number=SeqID_151213
atgttggtgcgaatgatccgcactcgtctccttgcagcaacacgagtgaaatcttgccctggtatggacggtagctacgcgatagcctccctctctggttgtgctcgcacagttagccctcctcccggatcaggggggaagaggaccttaaattctcttaaggtgtggatatggagcccactgaaagcgaggacgcgtagcccactaaaggcgagggcgtgcagctctctgaagttgaggacgtgtcgccctttgaaggcgagggcgtgcaaccctctgaaggtgaggatgtgcattcctctaaaggtgaggatgtgcagtcctctaaaggtgaggacaaggacgtgtagtcctctgaaggcgagagcgtgtagccctctgatggacgagg

SEQ ID NO: 59529 - DNA, 471 bp, Glycine max
  Peptide Sequence Number=SeqID_151214
atgattcatagggatcctctagtagagtattggaatgatcttaagagttcccttaggaagaggtacattctctcctactatgaaagggaacttatggacaagctccaaagtcttagacaaggaagtatgagtgttgaagaatatagactacaaatgaaggaccaagcccaaggaattttgggggatgcaccttcacaatccaaggaaattaagggtaagaccatagagaaatccacccctaatactatttcccaagaaaggactagcaacttgctaaacatgattatgaggggtcaaaacatttatattagtcaagaggagactacttcttccccttcctctagtggaagtgaagatgaagtaaggggtgaagagtctagtgaggaagtctacccccatgaaaaaggtgtgaccttcctaatggttagaaggctccttggaggtcaatattgtgatctatctcaatcctaa

SEQ ID NO: 59530 - DNA, 223 bp, Glycine max
  Peptide Sequence Number=SeqID_151215
atgggggccgtgaaggaccagatgacctctatgatggaggccatgttgagtatgagaaggatgatggaggacaatgcggccataatcgccaccaccagtgccgccgttgaggcgaatctgactcacccatcctgcataaaccaaacaagtcgtccagctccaaacatggtagatcagggaagagaagtgttggacagtacgggtggtccctatatggtgcaaa

SEQ ID NO: 59531 - DNA, 447 bp, Glycine max
  Peptide Sequence Number=SeqID_151216
atggccccgaggaagcttgcctcaaagaggtccaggaaggataaggcggccgaaggaactagttccgctcctgaatatgacagtcaccgctttaggagcgctgtacaccagcagcgcttcgaggccatcaagggatggtcgtttctccaggagcgacgcgtccagctcagggacgacgagtatactgatttccaggaggagatagggcgccggcggtggacatcactggttacccccatggccaagttcgatccagaaatagtccttgagttttatgccaatgcttggccaacagaggagggcgtgcgggacatgaggtcctgggtaaggggattttgcccggactgctgcagggaggcgagtgcgaatcatgtgcaccaacatgaccaccctgacccagatatggatgacgttgctcctcagcaacatcctgcccagcgatcataa

SEQ ID NO: 59532 - DNA, 390 bp, Glycine max
  Peptide Sequence Number=SeqID_151217
atgtcaggatttacacgcaattctcctcaaatttcagccagcccgcatcaattagaccttgcaccttatgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttgggatggcctttgtggataactgggtggtgggtaaggaggaggtttgttattggctgagtaatgacattgttgggttggtgggaaacttggccgtatag

SEQ ID NO: 59533 - DNA, 170 bp, Glycine max
  Peptide Sequence Number=SeqID_151218
cattcatctgagtggctgagtggtggagagaacttctggtgtaaagatcctgagggacaacagagattgaagaggaagttatcatgcgaagtattggataagagtttgagtaattgtgagaagcttcccagctatggagagctaaatcctcagttggttcttcctacggg

SEQ ID NO: 59534 - DNA, 91 bp, Glycine max
  Peptide Sequence Number=SeqID_151219
tggcgtcatccaaatcttcgtagcctgtatcaaacgttctgccccataaggtttgcatcatctggtatcagagcttcgactcttgatacag

SEQ ID NO: 59535 - DNA, 216 bp, Glycine max
  Peptide Sequence Number=SeqID_151220
atgacacatggtgaacaagctcaagaggttgctcttgtgtgtataaagaacaagctcaagaggttgctcaagaggttggcattaacagatccacttaaactgttacaagaacacaataagggattacaccaaacatacctacgtgaggtggcgaaggagaagaagcacagacttctgacgatgctcgagtgcgacgaacacgatgctcgaccttag

SEQ ID NO: 59536 - DNA, 489 bp, Glycine max
  Peptide Sequence Number=SeqID_151221
atgaccactcttacatggatatggatgacgttgttatttagcaacattctgcccagcgaccataatgccaatctccccctgcagatgtatcagttgggatcgcgcccacaagacactcagtggacccagagaagtccaacagggccttgggatttccagcttaggttacgggcctctgtagtcctacaaggtgtccgttccccccggcaaggtcacgaatcgcacccacaaagacactcagtggacccggagaagtccaatagggctctggggtttccagctctggttacgggcttctgtagtcctacagggtgcccattccccccggcaaggtcacatcatcatgacatagggatcgcgcctgcaagacacccagtggacccgaagaagtccaacagggtcttggagttgtcaagctctaattacgggtctctgtcagttctacggagttcctgtgacctccagcaagggcatcaggccccctactaa

SEQ ID NO: 59537 - DNA, 504 bp, Glycine max
  Peptide Sequence Number=SeqID_151222
atggcggctaagtccaccaaaccgtccacgttcggaaagaggacaacctcaaaaatcaacaaagctagtatatccgcaaacgggccccacttttcttggctcgccatatcccttgccttgccttccaagtatttccgtggcaggcccactacgccgttgcgagtttgcttcatgcgatccaactctcttgccgaatccccgaccacagctgcaaccttgctcaaggagggaagaaacccggagaaaagatacggttttctccccccaagagggcatcctagtatctcctcaaactcttcaatagtcggtaccatttggaagtccccaaacgtgaagcacctcaaacggctggtcatagtatttgggcgaggggatacgacagcttccgtaaaatacctccccccgcggtcaaaatctagaatcttttccgtacactttgcgaaaggcttgcctttggagaggtcccatcaatcgtcccaattccttgaggctggtgacatctag

SEQ ID NO: 59538 - DNA, 591 bp, Glycine max
  Peptide Sequence Number=SeqID_151223
atggggacaaatcaaaacggaaaaagattctatcaagtcaagattaagagcctagatgtcaccagccttaaggagttgggacggttgataggacccctccaaaggcaagccttccacaaagtatacggaaagattttagatttgaccacagcggaggtgtttacggaagccgttgtatccctcgcccaatactatgaccagccgttgagatgtttcacgattggggacttccaaatagtaccaactgttgaagaatttgaggagattttaggatgccctcttggaggaagaaaaccgtatcttttctctgggtttcttccctccttgagcaagattgcagttgtggtcggagattcgacgagagaattggatcgtgtgaagcaaactcgaaatggcgtagtaggcctaccgtggaaatacttggaaggcaaggcaagggatatggagagtcaagaagagtgggtcccgtttgcggatatactagctttgctgatctttggggttgtcctctttccaaacgtggacggtttggtggacctagctagaattgatgctttccttgcatatcaccatggcaaggggatcctctag

SEQ ID NO: 59539 - DNA, 591 bp, Glycine max
  Peptide Sequence Number=SeqID_151224
atgaatcgcatatgttggttgagaattgctcgggaattcatagttactttgcgggggctactcttcttttttgtcaatcgagccgctttccctcattccactcgtccagcctcttcgcgaacttgtacaatcgatgccacaaagatagtcaactctattatcgaagaaataaggaaacgggcgacgatttggcaccagatatccggaggtgtggaaagagcagctgtgagaagcggaaaaaccatcaaaaaacgacgattgttcgtgaaggtttccacagaaagaccccttggttctggcaaacagatcacaattacagaaagtaccaaacattgggaactacccggggaagagttaggaacaggaacaaggagaagcgagaaccacttaaatagaggaatcgatggtatttcctactttgttacccatagcaactgcggatcaaaaagcaacaaatttgatgacttattaagggaaagacgaagtaagaacatgctattgaagccgtcgcaacatatgtcggggaggcctccgttgattgtgtacaagcaaaaacgagtccaaagacagggtaagaaagggtttagctaa

SEQ ID NO: 59540 - DNA, 309 bp, Glycine max
  Peptide Sequence Number=SeqID_151225
atgagacgtgcctctgtgaaacgtaacgtctattcaagcattatttggtattccatatttgatatgttgtttgcgatccaagtccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagaggtaagggatga

SEQ ID NO: 59541 - DNA, 195 bp, Glycine max
  Peptide Sequence Number=SeqID_151226
atggctgttgtaattcgtttttgggcactgatcgcgatgacagcgcagttgatccatgatcgcgtcatgatggagtgcctagagggtgtttgggaggccctcgaaggcaatgagaggtgccgattccgtggcacagttcgactcactgctacttcgctagtacatccggagcaacccgcacgcacacttcagtag

SEQ ID NO: 59542 - DNA, 443 bp, Glycine max
  Peptide Sequence Number=SeqID_151227
atgcatccgtttattcacccgctgtctgcggcggtcgatccggcctgggaagcgaaaagcgactgggaaatctacaaagccatcgcgaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59543 - DNA, 156 bp, Glycine max
  Peptide Sequence Number=SeqID_151228
atggctgctcagaggatgagcaaggtgggaagctcctttagaaactgcaatttaaccgaagaattgtgggcaagagcgatcgaggaagcgattgagaaacaaaaagtgtttgccagctacatccgcgataagaatagaaaagaaatagatgattga

SEQ ID NO: 59544 - DNA, 186 bp, Glycine max
  Peptide Sequence Number=SeqID_151229
atgattgaacatgtattggcgatcagaattgccattccttggattatagggttgaaccaaactcatgtttttacgaaaaaggttcatgaagtcaagttgaagtatggaagtaaccatcttgcaaaaattggggcaaaagatggatcgagttacatcactgcttcgtctactgccaaacacatttag

SEQ ID NO: 59545 - DNA, 861 bp, Glycine max
  Peptide Sequence Number=SeqID_151230
atgcatgatctagccacatcactcggtggagatttttactttagatcagaagaacttgggaaagaaacaaagatcaacaccaagactcgtcatttgtcatttaccaaattcaattcttcagtcttggacaactctgatgatgttggtagaacaaaatttctgagaactttcttgtccattatcaattttgaagctgctccattcaagaatgaggaggcacaatgtatcatagtgtcgaagcttatgtacttgagagttttatcatttcgtgactttcgaagtttggattctttgcctgattcaataggtaaattgatccatctgcgctatttagatctctctcattcaagtgtagaaacactgccaaagtcattgtgtaatttgtacaatctgcaaactttgaagttgtttgattgcataaagctgactaagttgcctagtgacatgtgcaatcttgttaacttgcgtcatcttgatatttcttggactcctataaaagagatgccgagaagaatgagtaaattaaatcatctacaacatctggatttctttgttgtgggcaagcaccaagagaatggaatcaaagaattgggaggacttccaaatcttcgtggtcaacttgaaattaggaacttggagaatgtttcccaaagtgatgaagcgttggaggcaaggataatggataaaaaacacattagtagtttgcggctgaaatggtctggatgtaacaacaacagtaacaacttccaacttgaaatagatgtgctttgcaagttacagcctcaatataacattgaatcgttggacataaaagtatgcttccttcacttggacaactaccttctctcaaggaccttctaa

SEQ ID NO: 59546 - DNA, 291 bp, Glycine max
  Peptide Sequence Number=SeqID_151231
atggccctgttgacggagctacttgaggtcaccccaaatgaggctatagctgagacacgtcaagcaggtgggcctcatgttcggttgtcctggcttcgggacatgctttcagggacctggtccacttgtacgatcatcttaacgaggcgtcgcaggcccttacacggcagatggccgattacatttcactacttcagtgctggatttacgagcactttccgtcggtccatcgatgtgtcgtcgatgatggttatgttaaggctagcccacgtgcctgtaggtggcttacgg

SEQ ID NO: 59547 - DNA, 225 bp, Glycine max
  Peptide Sequence Number=SeqID_151232
atgacatcttcgtcaagccatagcaggaggggacttcccaccgcaaaatgcaaggttgtggttgatgggcgcaaactgagggcccttcaacaacagtgtttgcatgggtatacctaccaactgctatgcccttcagtggcaaagtatatccgaggcaagatgctcaaagtcctgctaattagcattggtggggacatctcatcatgtgtctcccccacggtttaa

SEQ ID NO: 59548 - DNA, 219 bp, Glycine max
  Peptide Sequence Number=SeqID_151233
atggaagagaattgcataatgagtgtgctagcaagcgacttctcagaggtcgtaaactgttcatcaatggctttcaacagaactttgacctttgtggaagcaatgacttccaagattattttgatgatgccaaagaatcaagagttaagcaagttccaaagaatcaggagtaaaaaagtttcaagaatcatgtttcaaagaatcaggattcaagaataa

SEQ ID NO: 59549 - DNA, 339 bp, Glycine max
  Peptide Sequence Number=SeqID_151234
atggcggccccccgtaagagagaacgccgcgatgccgtggatgggcatccaggacctgtggacgtttctggtcgccgtgctgatgtttctcgccctgcccggtcccggtaccttcaccctgctgaccgccaccggccgtggtggcgtgcgcggcggttacaccgcactggccggcctgctggtcggcgaccagatcctgatgtggctggcgctggccggcgtggccgcgctgctcaaggccaacccgctggtgttccacgccgtgcagtacctgggtgcggcctacctggtgtgggtcggcatcggccagctgcgcacaccgaagcacgagggcggtga

SEQ ID NO: 59550 - DNA, 399 bp, Glycine max
  Peptide Sequence Number=SeqID_151235
atgaaaataaaaggccatattggatcagagatcgtgtttggaacgatctgttatcacattggaatgcacctgagtatcattccaaaggagcttggtcgatctgtatatgtagatgaaatctttcagcaaactcatttacaaaaggatactggtcaatttgtcgatgatagatctagacggacacatgaagaatttgaggctagactatctcaagccaggtctgatgctgcatcaagtgttgctgcaagaccaaagcataagggatgcctttatggtactggagaccttgctcatacttacaaatgcgaaaatgacagcttcatgcagcatacgcaaggatcttccagtcgtgctgaagatgttgcagagattaaccgtctaagggaggagctgcgttaa

SEQ ID NO: 59551 - DNA, 126 bp, Glycine max
  Peptide Sequence Number=SeqID_151236
ggacggatgcaagtggggatggggtcacgaccgaccaatcgttgccccttcccggcgctaaacgagcagagaacgtcgctgcaaggcagcccatcatcctttgaattcgcagtattttactactaa

SEQ ID NO: 59552 - DNA, 489 bp, Glycine max
  Peptide Sequence Number=SeqID_151237
atgggtgatcaagaggagacactggaacagatgaaagccgacatgtcggctctgaaagaacagatggcttccatgatggaggccattttaggaatgaggcatctcatggagaaaaacgtggccaccactgccgctgtcagttcggctgccgaagcagacccaactctcttggcaactgcgcaccatcctccctcaaacatagtaggacggggaagggacacactggggcacaatggcaaccctcatctgggatacaaccgagcggcttacccttatggattgccgcccaactactcaccacccgtcttgcaagacgatgcgggccatattgcttctcccgtccttgaaagagagcctcctcaacagcccgacgaggtccacaaagaccctgaagactatgctcgaagggatgtcgagttctatcccccgatccccgaagggccagcacccagcacgttgcctcaacccaacatcgcgacacaaccaata

SEQ ID NO: 59553 - DNA, 387 bp, Glycine max
  Peptide Sequence Number=SeqID_151238
atggtcattgagaaacgaaatgctaacatccaaaatctcatttatggttatggggggggtttcatcagcagactctccttctccgaaaacaccgagactttttcaagtctcacaagttatcaagaactacgtaggtctgagttcctcattggaggatacgtaggagcaaaagccttgcttttgtcgaccacaccgctttctgttaccatgacccaagagctggtagcccgcggagacaccttacggttatccgcaccttgtcattcagtgaccccaagtgtgattgatgagcagaggccaatgtggtcatctgcaccctttccggagatgtcggcatcttctggtggagactttttcaagtctcacaagttatctaaaactacgtag

SEQ ID NO: 59554 - DNA, 690 bp, Glycine max
  Peptide Sequence Number=SeqID_151239
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctaacccttggctggtctctctcttccaagtcccaggggttacattttatggaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59555 - DNA, 474 bp, Glycine max
  Peptide Sequence Number=SeqID_151240
atgaccatgattacgccaagctcgaaattaaccctcactaaagggaacaaaagctggtaccgggccccccctcgagagagagaccagccaagggttagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 59556 - DNA, 781 bp, Glycine max
  Peptide Sequence Number=SeqID_151241
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaattatgactctctccctagtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59557 - DNA, 306 bp, Glycine max
  Peptide Sequence Number=SeqID_151242
atgatatgggttccaaaaggatctatagtcaaaactaacattcaaggatccaagaaaattcgggactccttcaagcaaagtcggtacattgatagtggttgttccaaacacatgacgagagatgcatcaaagtttactcatatttctcccaagaatagaggacctgtgacctatggagaccacaacaaagaacataatttttctgcacctagaacccctcaacaaaagggagtagttgaaaggaaaaatagatcattagaagaattaacaagaaccatgcttaatgatacaaatattcctaaataa

SEQ ID NO: 59558 - DNA, 611 bp, Glycine max
  Peptide Sequence Number=SeqID_151243
cggcggttcgccggtgctcaacccagcgcaacccgccagctgatcggcactcgcgctacgctgacggagccgatgcacaacggcatggggcgcatcaatatcggcgacagcagctggcgcgcgcaggcggcggaagatctgcccgccggcaccgaagtggaagtggtggcggtggaaggggtcacgctggtgatccgcgccatcggccgttaattagaacgacagcatcccgccaggttgttgatgatggggcactctgccccctcgtcgcccgggcattggtcggccagcgtcaccaggcgctggcgcatttcgcccagttcgctgatgtgcctgtcgatctccgccaccttctgcagcgtgcgcgccttcacgtcggcgctgtggcgggccggatcgttgaacaacgccaccagctcgcggcactcgtccaggttgaagcccacctgccgcgcctggcgcagcagcgtcagctcttcaacgtgcctggcggaataatggcggtaaccgttatcgctgcggatcggggcggggctgtcctgcatgaactgcgcgcagcgggtgaaaaaagccctggaaagccgcagcgatgtcgaacaggcggacgttaa

SEQ ID NO: 59559 - DNA, 503 bp, Glycine max
  Peptide Sequence Number=SeqID_151244
atggtcattaaccaatccctattctatgacttgacccaattatctagtgaaggtgtaccatttgaaggtacactgaatgatgattggaaatttgacttctctgtgcatgatgcccgccggttggtttgcaccaaccaagcggatatgaccggaaggcttcttgccgattcattggcttttgaaagtcgcatccttcattatctcattgtgcgtatcttgcttccaagatcttcaaaccttgcacaggcattgcgattaaatgctccattgccatatccacacttagtcactctcttccttcaacactttaacatccctcttgattttgaagcttatgttccaatcaagagatccttcttaattggtgccgctgtgattgcatcttttggttaccgtaaagagcatgatggctcttgggtgaaaaaaggtgcacaacccattgataaagaaggacacttaccagttggagaagattcctctcttcttcaaaggattttggacag

SEQ ID NO: 59560 - DNA, 300 bp, Glycine max
  Peptide Sequence Number=SeqID_151245
atccgcgatttgggtagcgtgggaggcaataccgacgggatagtgacggataaaaaaggcaacctctacatcaccgatgttacacgcaatggtatcgtcagatacgatcctgagacccattctatgtcgctggttgcggcaaatgaagaggtgcgctggccagacacgccggcaatccgtccgaacggggagctgatctttacctcaagtcgcctcaatgaccattttgcgggagccgttaaaccgggagaggagcgctatgatttgtggcgcttgcgtctcagtgcttcaaaggattag

SEQ ID NO: 59561 - DNA, 137 bp, Glycine max
  Peptide Sequence Number=SeqID_151246
atggtgaaagttggaacctcttacgtgccgatcaacgtctcattttcgccaaaagttggcccagggcttcccggtatcaacagggaacaaccaggaatttatttattctgcggaaaagtgaatcttccgtcaacaag

SEQ ID NO: 59562 - DNA, 905 bp, Glycine max
  Peptide Sequence Number=SeqID_151247
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagatcttggaagggctgaattacttgcatttgcatgatccttgtatcatccacagagacctcaactgcagtaatgtgtttgtgaatgggaatactggccaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59563 - DNA, 195 bp, Glycine max
  Peptide Sequence Number=SeqID_151248
tggctaagcgcgaggaagaatccagaagaagataagctgtcaagttctctaagcgcaccgctccaggtcatcaagcgcacagcttcagctcatctgctaagtgaaacaagcgcactaagccaaaatccacttaggcgcgctaagcagtccatacgtgcgctaagcgcacgagcacgaacaaggcctcctacttaa

SEQ ID NO: 59564 - DNA, 429 bp, Glycine max
  Peptide Sequence Number=SeqID_151249
atgggtgaccaagaggagatacatgaacagatgaaagccgacatgtcggctttgaaagagcaaatggcttccatgatggatgccatgttaggaatgagacaactcatggagaataacagggccaccgctgccgttgttagttcggctatcgaagcagacccaactctcccagctaccgcgcaccattctctcccaaacgtggtaggacgagaaagaagcacactggggcacatcagcaacccccatttgggatacaaccgagtggcttacccttatggattaccacctaattacacgccaccagtcatgcgtgatgacacgggtcatgtcccttcgcccatccttgaaggggagcctcctcgacagctggatgaggttcacgaggatcgtagtgagtatacccaaggagacatcgatttctaccccctg

SEQ ID NO: 59565 - DNA, 489 bp, Glycine max
  Peptide Sequence Number=SeqID_151250
gaagttgaggcaccggtggaagacaaagaggtgcaggcccttagggaagaactcgagcaagcccaaacaattaaagaaaggttcaaatcagcagctcttaagatccaaaaggagaatgccgaactgagagatgtaaatatagctaccaccaaggccttggaacaagagaccgaaagggctcttgaaggtttgcctaaggtccaagagaagcttgtctcagtgtttatgcgagacagagaccaacatgctagaggaagggtgatcgactcgttacatcaagaggcaacaatgtggatggaccgatttgcccttactttgaacgggagtcaagaacttccccgattgctagccaaggccaaagcaatggcggacacctactccgcccccgaggagatccacggacttctcagctattgtcagcatatgatagacttaatggcccatataatagaaaccgctaggaagtttgtatcatcactcagatcttga

SEQ ID NO: 59566 - DNA, 519 bp, Glycine max
  Peptide Sequence Number=SeqID_151251
atggcccgtgttatgttggggaacggttacgaacccgaaatgggtttaggcaaagacaacgacgacataactagcttgataaatgccaaaggaaatcgtgggaagtatggtttaggctataaacccactcaggcggatataaagagaagcatcgcgggaagaaagagcggtggtcaaagctcgcagttgaggcaagaaagtgaaggaagcccgccctgccacataagtagaagctttataagcgcgggtctgggagacgaaggtcaagtggtcgctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgtgatgaggaaatcagacctacgtag

SEQ ID NO: 59567 - DNA, 189 bp, Glycine max
  Peptide Sequence Number=SeqID_151252
atggcttatgacgaagaaggacatagatatggtcacatgacaaccaacctctcagaatgtgtaaataaggtattgaaggattgtcgcaacataccgataatagctttggtgaaatcaacatatagtaggtgtcgaaaatactttgttgatcgtggtcgtcaagcccaaagacaattaaatgaaggacaa

SEQ ID NO: 59568 - DNA, 924 bp, Glycine max
  Peptide Sequence Number=SeqID_151253
atggcctcgaggaagcttgcctcaaagaggtccaggaaggacaaggcagccgaaggaactagttccgctccggagtatgacagtcaccgctttaggagcgctgtacaccagcagcgcttcgaggccatcaagggatggtcatttctccgggagcgacgcgtccagctcagggacgacgagtatactgatttccaggaggaaatagggcgtcggcggtgggcatcactggttactccccatggtcagtggatcccgtttgatgccgacgctatcggccagctcctgggatatccgttggtgttggaagagggccaggaatgcgagtatggccagaggaggaaccagtctgatgggttcgatgaggaggccatcgcccagttactatgtataccggggcaggattttgcccggacttctgcagggaggcgagtgcgaatcatgcgcaccaacatgaccaccctgactcagatatggatgactctactgctcagcaacatcctgcccaccgatcataattccgacctccccatgccgaagtgtcagctggtgtacgccatcctgacgcggatgagcatccatgtggctcagttgatcgctgatgccatctatatttttgcaggtatggcgcctactaggcaccctttcgacccagataagtccaacagggccctgggatttccctcgctgatcacaggactctgccagtcgttcggagtccccgttgcacctaccaaggtaattcggccgcccatcacccgggcttttattgagaagtactgtactcagagacaggctcagggtgatgctccacaggccgcaggcgcgcccccaccacctcatcaggctggccaggctgggtcatttgacatggagcagtatttacggcatttggttcgccagcaggcggccaaccaccgggcacat

SEQ ID NO: 59569 - DNA, 481 bp, Glycine max
  Peptide Sequence Number=SeqID_151254
atgacgaagaccgatatagccacccgtgtccacaatcatacctggaaacttgacccgatcgtccgcagcctgatcgatacggatttctacaagctgttgatgttgcagatgatctggaagctttatccggaagtcgacgcgacgttttcgctgatcaaccgcaccaagacggtgcggctggccgaggagatcgacgagatggagctgcgcgaacagctcgatcatgcgcgtacgctgcgtctttccaaaaaagagaatatctggcttgcgggtaacacgttttacggccgctcgcagattttcgagccggaatttctctcctggctatcaagctatcagctgccggaatatgagcttttcaagcgcgacgggcagtacgagctgaatttccacggccgctggatggacacgacgctctgggaaatcccggcgctcgccatcatcaacgagttgcgttcgcgtagcgccatgcgctcgctcg

SEQ ID NO: 59570 - DNA, 522 bp, Glycine max
  Peptide Sequence Number=SeqID_151255
atgaccacttttacatggatatggatgacgttgctatttagtaacattctgcctgacgaccacaatgccaatctccccctgctgatgtatcgggattgcgcccacaagacgcctagcgggcctgaagaagtccaacagggccctggggtttccagctctggttacgggcctctgtcagtcctacaaggtgctcgtccccccaacgaggaatcgcacccacaaagacacccagtggacccggagaagtccaatagggccctggggtttccagctctggttacgggcctctgtagtcctacagggtgcccgttccccccggcaaggtcacgtcatcatagggtacctatcacctccaacaagggcatcaggccccctactaatcgagctttcatcaagaagtactgcggctccaggcaggcgcagggtgaaacaccacagcagcctggggatggccagcagcgggcaacagacgcaccgccatcacctctagagtttacctcagctcatccacaaaaaggttag

SEQ ID NO: 59571 - DNA, 367 bp, Glycine max
  Peptide Sequence Number=SeqID_151256
atgctggatgaattcaacgtgcatgcaaaaactttcaggatggtgagagatagattgcgggatgttcaagtggataatatcaagttgaaattgattgctaattgtgagaaagatggtcgtacatataatgtacctactgttcctgaagttgcagcactaatactctacaataccttctcttatttccttacggggaagatggatatagacctgatattatacaaagcagtcgatcagatggggtatactatggttgagtcagaaagactttcttacattagaaacaaccctaaaaaacttcgagttgacaagttttgtagcttacaacagtcattggatgatggaagcaggaaaggcctaaataaag

SEQ ID NO: 59572 - DNA, 327 bp, Glycine max
  Peptide Sequence Number=SeqID_151257
atgctgtcaaagaccatcgagggaaatggccccgaactacgaagggcctttgtcgtgaagagggctttttccggaggagctttggtgcttaccaacatggatggcgaagagctaccttcacccgggcaggatcaccttgggctaccttctggagtagagacaaaacatgaacgacagaaaccaatcgaggacgaacgcaagcggggatggggtcacgaccgaccgatcgttgcctttctctgtgcgaaacgagcagagaatgtcgctacaaggcagccccgtatcctttgtattttgcagctttcttttactatttgtttgttttaa

SEQ ID NO: 59573 - DNA, 222 bp, Glycine max
  Peptide Sequence Number=SeqID_151258
atggttgtggttgtgggcgaaactgagggccctagtgtttttaaagggtataccattgcaatgttgcaattcagtggcatatccgagccaggctcaagtcagctagatgacactggtggggaatttcatgtgtctcgcggaatggcagtcacagcatgggtttctccctcatcgtcaccctctttatttgccccagttttctcattcgtccaagcaggatga

SEQ ID NO: 59574 - DNA, 138 bp, Glycine max
  Peptide Sequence Number=SeqID_151259
atgggtttgccaggcttaaaggagcactcaaactcggtgacccccaaggcctacactccgaagagtccgtcagggcctctccctcctgattcaggtccaacccctaaaatcattttagcacacaaacactgcttgtga

SEQ ID NO: 59575 - DNA, 46 bp, Glycine max
  Peptide Sequence Number=SeqID_151260
atggtcaattatttcagcacgaaatacaaaaagatcttcagatggg

SEQ ID NO: 59576 - DNA, 273 bp, Glycine max
  Peptide Sequence Number=SeqID_151261
atggggttgaatcaatttagatttttcaacatggttcatgacatcttggtcaaggtgaaactggaagtaacaaggacatcaacagtcctaaatgtgtttggcagtaaacaaagcagtgataggaaaatgcaaggatcacgcatgaaaacaaaaggtatgcagtttgtagaacaaaaagaacgatatgttcattatgatgccatgaagagatgcttatgcatgctagagataaaatgcgggagtgatttgattcgcattgattttttggagtaa

SEQ ID NO: 59577 - DNA, 450 bp, Glycine max
  Peptide Sequence Number=SeqID_151262
tgacggcacagaccaactgatacttccacaggggaagatcgacattgtggtcgctgggcagaatgttgctaatagctgcgtgatagcctcctcctctgattgtgctcgcacatttggccctcctccaatatcaggcggtggcccaggaactgataaaagcaaactactagcccctcacccaggagtgcaagaccttgagttctctgaaggcgcagatgtggagccatttgaaggagaggaagtgcagccctctgaaggcaaggacgttgtcacaacttacccttcggcgggagggcgacgcgagggctcacaggagcgtcttccaagaaaggaaaatgcgcggagtcgccaccaacgtttattcgaggaaaacgtcggaaaaactggaaagttgtggtctacgaactttaagtgtgaaaggtccgggagttgtatttacgcatggggaag

SEQ ID NO: 59578 - DNA, 459 bp, Glycine max
  Peptide Sequence Number=SeqID_151263
atggggatcgcacccacaaagacacccagtgaacctgaagaagtccaacagggccctggggtttccagctctggttacgggcctctatcagtcctacagggtgcccgtacccccccggcaaggtcacgtcatcatagttctacggagtacctgtcacctccagcaagggcatcaggccccctactaatcgagctttcatcaagaagtactgcgccccagacaggcgcagggcgaaacaccacaacagcattgggatggtcggcagcgggaaacagacgcaccgccatcacctctagagttcacctctgctcatccacaaaaaggttagagcgttgcctacgacacatggccgaccagcaggtccatgaccgacaagtcataaggcgtccagctaaagacgttaaagaagcgctactaggaggcaacctagtaccttttgaatctatgcttgttatttga

SEQ ID NO: 59579 - DNA, 672 bp, Glycine max
  Peptide Sequence Number=SeqID_151264
atggcggctgtcgccaatggtacggggctggattgcccggatgacggtctggctttcctgcccgccggcctgcacgatctcgcccgtgttttccgtcccgccgccgatggcggccgcatggcccgttcaggcctggtggatatcgccgcaagccaggaaccggatggacgcgaggtgttcaacaacatccgttacggcgtcttcgtcacgttcaaggcgcataatgaatatgcccgcgcctgcttcaagcaatatggcctgctgaccgatccgtccggctggtatgcctccatgtggcgtccgttccatatcatcggactcgaaacctcgatcagcgtgctctctgccgtattgcgaaacgaggcaaccggctgctcgaaggagttccgcggcgatgccgtcgccaccgccaagaaggacatgcagcccggcgaaatgctggacggtgagggcggttatgcggtctgggcgaacgccattccagcgacccgcagcctggacatgaaagcgctgccgatcggcctcgcccataacgtcaagctgaagcgcgccatcaggaaagaccagatcgtcagcttcgacgatgtggagctggtcaacgatctcgacgtggtgaagctgcgtcaggacatggaaaaccgcttccgcccgcaaaaggacgctgcggcgtga

SEQ ID NO: 59580 - DNA, 192 bp, Glycine max
  Peptide Sequence Number=SeqID_151265
gtgtctccgcatgctaccggactcttaggtcatgatagcaaagggtgtgtgcgggttaccgtcgggtgtctccgcatgccatcggactcttgggtcacgataacaaaaggtggggtggtcaacaaaagcagggtttttgctcctacgtatcctcaatttgtgatgaggaactcagacctacgtagttcttga

SEQ ID NO: 59581 - DNA, 445 bp, Glycine max
  Peptide Sequence Number=SeqID_151266
atgggtaaagtagaggaggcgcaagagcagatgaaggctgacatggaggccatgaaagagcaaatggccacaatgatggaggccatgatgagcatgaagaagataatggaagccaatgcggttatagttgctgctatcagcgctattgctaaggtgaacccgatgcccccatctggccttaaccaaatgaatcatccaacctcagatatggcacatgaaattccccaccacaatctagccgacttcgagtcttgcctcggatatgccactaaagggcaagcagtgggtggtatacccatgccaaacactttggagggccctcagtgtcgcccacaaccacaacccttgcattttgtggtgggaagagcccctcttgctatggctgaagagggcaagttggatcatatagaggaaaggctcaaggacattgaaggagtcgaagatt

SEQ ID NO: 59582 - DNA, 445 bp, Glycine max
  Peptide Sequence Number=SeqID_151267
gaatggaaccactggagagtcgtccgcagttcacacttgggcaaagacgactgagtttggaagcggaacacgaaccgatttccgctattccggaaagaagagcaagaacatcgcttattctgcagcaaccttcctttatgcctctgtcgtcgccgggctaaggcctgctgagacaatagatagtcaggcagagaaagctatcgatggtcgcattgggacgggaacaagagcaattcttggtcccaccaaaccatgccatgaacagtcgactcaacaagagcaggggatatttaaactaagactcattccgtctattgctctaccttcctccaacagattgaattgcatcgtttattccccggcaaaactagcagctgactcaacctcccctcgggtctacgccctctttgttttagcatcggcgatgaaagaggggatcctctag

SEQ ID NO: 59583 - DNA, 908 bp, Glycine max
  Peptide Sequence Number=SeqID_151268
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttgattggtcaagcaattgcatttgcgatgttcgtcgcattctgcatgaagtttgtttggccaccactaatcaatgcgattagtgagcgtcagcgtaaaatcgctgatggcttaaacgctgctgaaaaagctaaagctgaccttgctgatgcgcaagcacaagttaaggcagagttaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59584 - DNA, 161 bp, Glycine max
  Peptide Sequence Number=SeqID_151269
tgctcttctcttcctctcccttcattcatctccttcttcctccaagctcttatccatggcctcctacggtgaagcaaaggaatcctttgatgaagaagatcctaggcctacaagctccaatggagcttacaccatgtggtatcaagagcatcttcatctag

SEQ ID NO: 59585 - DNA, 599 bp, Glycine max
  Peptide Sequence Number=SeqID_151270
agaacgaccgtagattcgaagcgccacagctagtcatcgcccacgacctcccgccatcggaccgtgagccgcacgggcacccgtccggtggctgccgcggtgtcgatcaggcgggtcacctcgtcgcgcgtctcctatgcggacctggccgggagcccggcgccgcgcacgaccgagacgggcagcgtgtgcacggccgcgatggccgctcccatggactccgccgccccgcgaccggccggcacgagggccgcgtcgatctggaacccggggaggagctcggtcaccagtgccggtgcatctcccagccgtgtctcgccgatgtagccgggggcgtggaagggcagcatcgcccgggcgccggccgtcagcgcgcgcagtgcgatggcctcggcggccagctcccgcgccgactcatcgtcgtcggcgacgcggatggcgagttcgcgaccgtcggccagcgtggcgacagcggagtcgaagcggccgtccccgtcggacgacagggcgcgggcgcccgtgacctcagcgcaccgggaagtgcggccgtcaccgccgcggctagagtgaaaggagagcgtcccatccccccagggtag

SEQ ID NO: 59586 - DNA, 639 bp, Glycine max
  Peptide Sequence Number=SeqID_151271
atggcatccttcagccagcttcagtcgcagatgcaatctcagggacttgcagtgcctcctaagcctcaggttagtccctccggtcctcgagtgagcacaaaggggagttatgttgatccctcgggaaacgatcctgagacgggtgactctgacaggtgcggcttgtacatagaagcagatcttgcccgcctggttgccatggggagagtttataagggatccactgttgttcataacactcctttgtcgcctggccaagtaaaggtgagtgtggaggagattacagatgcagatgcttcagttcctgtacccactgatgaggtttccttagtggggcaggcacttcacaccttcctttcttggccgacacatctggtcaagtctttatcacagcaggtagctgtgtcttcggcaaaaccacctccgaagccctatccgaaggtcgatgatccgctttatctaatgacattgaccatcccagagcttttcttgaggccttatcaggttagatgggatgtcaccgtgttcggggtctttaatctagatttccccctctacataaagcatgaagacctctccgaaatcacacacggtggtcaatgtctcagcatatcagtgttacagttgtggattatgtaa

SEQ ID NO: 59587 - DNA, 279 bp, Glycine max
  Peptide Sequence Number=SeqID_151272
atggcagaggtcaccacagaggccattgcctccctcgcccagtattatgaccagccggaggaagttgaagcaccggaggaagacgaagaggtgcaggcccttagggtagaactcgagaaagcccaaacagtcaaagaaaggttcaaatcagtagctcttaagatccgaaaggagaatgccgtagggaagaacatggccggaacaaattctgaggggctctgtggggcagtaacaacgagtttaagctccggagagaggaaagggaccaatcacgagtag

SEQ ID NO: 59588 - DNA, 477 bp, Glycine max
  Peptide Sequence Number=SeqID_151273
atgaggaagtgtggaagggtgagacttccttcttttattgttgaccacatagtggtacctggagatatgtcgcgggggtcaggagaccttggggacgtcaggcgaactcctggcagtcaacagataaaaggaacaaagaccacaaagcaaggaggcttgcttgaaaacggaggtcaggaagctaggagagcttctggtaatcgattaccaaggggatgtaatcgattaccaggcttaaaaaggaactggaagactgtggaggcctctggtaatcgattaccagcctgtgtaatcgattacacagaggaatgggtccctggtaatcgattaccagatcctgatggcggcgcagagggcgatgaggacccacttcctgaggtggattctcccgaggaagtcatgtcgacatctgaggcagactctacggaggatagtggcccgggggagatggcgatcagcggaggctcttcatcatag

SEQ ID NO: 59589 - DNA, 288 bp, Glycine max
  Peptide Sequence Number=SeqID_151274
gattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcgaagaaatggaggtggtcttcgtcattggaagtgtggttggtgggaaacttggccgtataggaatggcagtcacagcatgggtttctccctctttctcaccctcttcatttgccccagttttctcagtcgtcctagtaggatga

SEQ ID NO: 59590 - DNA, 181 bp, Glycine max
  Peptide Sequence Number=SeqID_151275
atgggatcaagtcaaacgccttcgcttaaaaagaggttctatcaagtcaaagtcaagagcctaggaatcaccagtttaaaagagctagggcagttgatgggtcagctccagcggcaagcttttcgtaaagcttacgccgatgaggtgcttcacctttggggacttccagctatcacctatg

SEQ ID NO: 59591 - DNA, 400 bp, Glycine max
  Peptide Sequence Number=SeqID_151276
ggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttccagtcagacgttgcattggatacttttaacacagcagttgtttctcccatctactatgccttgttcacatcttttacaatattagctagtgcaatcatgtttaaggactattatggtcaaagtataagcagtattgcatcggagctttgtggtttcgttactgttttatctggtacaactgtattacacagtacaagagagccagatcctccagtcaatacag

SEQ ID NO: 59592 - DNA, 258 bp, Glycine max
  Peptide Sequence Number=SeqID_151277
atgagacagcaacaacagacccagtgggaaaagaacagaacatgtgagtataaatgtgcggaacgtcctaatttgaagttggtgtcacatgggaggaaggtgacattgattgggaggccagtgcttgagattgaaggactggttggtgccacaggattaagtccactgatctattgttcagttgttactggcgatcctggacttatatccgcatttgtggagaggtggcacaacgagaccagcaccttccaccttccg

SEQ ID NO: 59593 - DNA, 858 bp, Glycine max
  Peptide Sequence Number=SeqID_151278
atgaagcaagtcgaaaatggggtggttggaataccgagaaaatatttggaggcaaaagcaagaatcttggcaggtaaaggcaaatgggccccattcatagacattctcgcgctgttgatcttcggaggagtcctctttccgaatgtggatgggttgctggacctggcagcaatcgacgcttttctcgcctatcataaccacaatgaaagcccggttgttgctatgctagccgacctatatgacaccttcaaccgaagaagtgaaaagagaaatacaaggattgtttgttgtactccagctctttatgtatggttagtttcacaccttttttgccaagaggtgaggcatgcttggccgctagaaagccaccgttcatgcacagagaaaggaggggcaaattgggaccaactcttagcaagcaaagaacgagcatcagtcaactggttccctcgatggaaggaaggaagaaccggagttcatatttcatgcggaggatttccaaatgttcccttgatgggggcgaggggttgcatcagctacaatcccgttcttgctataagacaacttagctaccctatgagaggggcaccactagaggatgagctcgcgcctgtcatttcacgaggtttcaataagaccgacgtggagacacttcagaaggttcgcaaggcatgggaggtggtgagaaagaaggacaaagaactcaggggcagtaacaatgggcccatcggtggccaccgtaagtggttgagagcccacgtgcaaggtttggattggctcccaagtttgagaaccactaaaaggggagggaagttaaggcaccagaggaagatgaagaggtgcaggcccataggataa

SEQ ID NO: 59594 - DNA, 210 bp, Glycine max
  Peptide Sequence Number=SeqID_151279
atgggtgaccaagaggagacacaggaacagatgaaagccgacatgtcggctttgaaagagcaaatggcttccatgatagaggccatgttagggatgagacaactcatggagaataacgtggccaccgctgccgctgttagttcggctgccgaagtagacccaactctcccagctaccgcacaccatcctctcccaaacgcggtaggatga

SEQ ID NO: 59595 - DNA, 183 bp, Glycine max
  Peptide Sequence Number=SeqID_151280
atggcagaaaagatacccatagaaaaacaactaccaagaagattcgcaccagaaatcatgtccaagattaaggaagagatcgaaaggctgctgaggagtaaattcatcatatctgccagggatttaaataatgctacacctaaagatgaatatgctatgccagtagcagaaaatgtttggtag

SEQ ID NO: 59596 - DNA, 198 bp, Glycine max
  Peptide Sequence Number=SeqID_151281
atgaagcagattagtgcaagtgggattcagccaactttcattatcagagtaatcaagcaccagctggaaattcttcaagttgcaaaaatctacaagtctgatgctccagggcttactgcacatcttctatcttgctcagctagcttcttcttcctcggatgttcagaccatctcaatgcccttttgagagccttttga

SEQ ID NO: 59597 - DNA, 201 bp, Glycine max
  Peptide Sequence Number=SeqID_151282
atgggcgaggaagagaaaaaaccagaggaaaacaaagtggaggagaaaaaagcagaggaagaagaaaagaaagaagaaaaaaaccagaggaatcaaaagatgacaaggaatccaaggaggaatctgtgccaccagaaatcgtgcaaggcacaatctctgcaatgcatgaacactttaagcacaatttctggcatcttttaa

SEQ ID NO: 59598 - DNA, 109 bp, Glycine max
  Peptide Sequence Number=SeqID_151283
atgggtacctcaaagctttacactagggcaatgaaaggcaccatgcataaacctcaagcgaacctaggggcagattacaagttctcacccaatagttccctgctacaag

SEQ ID NO: 59599 - DNA, 166 bp, Glycine max
  Peptide Sequence Number=SeqID_151284
gtcgactctagaggatcccacgttgggctcaggacttgattgtggaggatgcatgaacgacaatcaattcatggggctccgaataagatttgatggtggaggatgcacgaacagcactaggcaatcaattcgtggcactccggactcgatggtggaggatgcatga

SEQ ID NO: 59600 - DNA, 743 bp, Glycine max
  Peptide Sequence Number=SeqID_151285
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaattccacaaaaaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59601 - DNA, 438 bp, Glycine max
  Peptide Sequence Number=SeqID_151286
atggtttgtaatagcaatgacacaactcaaaatgttaacattcaaaatgaagaacttaaagaatatctagattgcagatacatttctccctgtgaagctgcttggagaatatttgcttttccaatccacgggagaaagcctgctattgagagattgtattttcatcttccagatcaacacagtgttctttatgaagatcatgatgatatagatgatgttctatccaagccaactatttcatattcaaaatttctagcttggatgaacaccaataaatctgcaaaggacctacttcatttaaggatatcagaactgttgcaaatatccaatatgcaacatatagagaagcatgttttgccatgggttttttacaagatgacagagaatatgttgaagcaatcaaagaggctaaggactggggcacaactaattatctaa

SEQ ID NO: 59602 - DNA, 497 bp, Glycine max
  Peptide Sequence Number=SeqID_151287
ttggtggtatacccctgcaaaacactttggagggccctcagtatcatccacaaccacaaccctcacgttccacagcggttaaaaccctcatgactatggcaggaatgggaaagttggatcatctagaggaaaggctcagggccattgaaggaggtgaagattatgcctttgctaacctaaaagagttgttcctagaacccaatatcatcacccctcccaagttcaaagtgctggactttgacaagtacaaggggactacttgtcccaagaaccatctaaagatgtattgtcagaagatgggggaatgttgcaaaagatcgaggaatgaggacacgtctttcaaacggaacacgcccaccaaactcggtgctagagctagagtaactggcgtgaagcaacaggagctgcccaatgatgagagaagggacgacgatggaatcggccatgaaagtagaaaaggcacaatcgatggaggctcatggagcatgaaaagataa

SEQ ID NO: 59603 - DNA, 429 bp, Glycine max
  Peptide Sequence Number=SeqID_151288
cattgcctccgtagattccttctctgggcaacctttcctgtccgatacggcagtaatggtggcccaggtgatgttggggaatggttacgagcccggaatgggtttaggcaagaacaacggcggtagaaccagaggaaaccgtgggaagtttgggaactttataagcgcgggtctaggacacgaaggtcaagtcgttgcgatatgcgaggatgactctccgagtgggtcggatttggtacgatcatgccctcctggtttccgattaggaaattggcgagtggaggagcgcccagacatttacgcgacaagcataatatccgacgacgagtcccttgaaggtactaatacctgggaccccactatcgatttcaagcaagaaacacatcaggcggagggtgaagaagacgaagatgtaggacttcccccgga

SEQ ID NO: 59604 - DNA, 681 bp, Glycine max
  Peptide Sequence Number=SeqID_151289
atggaggacgcacccgtgagccctcgcgtcgaaggactcgtttgtcccctacaaggtcatcgcatgtgtgccaagaaagggaaggaaaattgggaagaactcttggtaggtatggtaggggcgtccgttaattggttcccccgatggaaggaaggaggggctggagttttgtgctcatatgaagggttcccaaacgtccccttgatgggaacaatgagttgtattaactataatcccatactggccatcagacaactaggctaccctatgagaggggcaccatcggaagagggtatcgcacctttcatcgcacgaggtttcagtgaaggcaatgcaaaaatgcttcaaagagtccgaaaaacgtggaataccgtggaaagaaaagataaggagcttagaggaatcagcaacgatgttagtggcggctatcataaatggttgaaggctcggacgcaagggataacttggctcccgaagctaaagatttcaagtggtgaagaagtcgaagtccctgaggagaacgaagaagtgcaagccttgaaggtggaacttgaaagaatgcgagtggttaaggaaaagttcaagatgaaagccaccagggtcaggaaagagtgtgacgagctgagggatgtcaacatggccatggccgaaacgttagagcgagaatcaaagaggacctga

SEQ ID NO: 59605 - DNA, 494 bp, Glycine max
  Peptide Sequence Number=SeqID_151290
ctttattcgaggttgcactagaacgatcaccaccaatctgtgcttcttcctcgtctattagtgtagtttacaaaagcaaaggtgaaactaaagatattgagctggtagaggaagaacagacacggattggtgctgatccttctagtgggacctctaataaatatgagaattataaggaggaagcacggaagaaaacactaaagcataaaccaaagagggtggagagtgtcaacgctgatgcagaagcctttgctgaagcagtagaacatacgaagaaaagagatacaggccatcaaagtgtgtccttggagaataagacaggagattcaactatgctgaagatgggagattcagctaaagttatgataaaacaagacatgaagggaagaaggcataaatatgggtttaacaacaatgaacgtgagaagacacagaagaaaagggtggcggatgatgaaactgccgacaatcatcagctggatgaagtcctgtga

SEQ ID NO: 59606 - DNA, 240 bp, Glycine max
  Peptide Sequence Number=SeqID_151291
atgtcattgcctagtgctgttcatgtgtcctccaccttcgagattggagctatgcttcatgattgcctaagtgtggaccctcaagtgcaatcctccattcaccactttttcggagccccacgaatgtcattgcgtagcgctattcatatgtcctccaccttcgagtgtggagccccgcgaagtcattgcctagcgctattcgccaattctccattctccacttttttcggagccccatga

SEQ ID NO: 59607 - DNA, 231 bp, Glycine max
  Peptide Sequence Number=SeqID_151292
atgggtattaggaaacgagcacaatcaattcaaaaacacaacgactgccctcacgactccttagaagagcaggtaacgcagggttcgtttgtaccccatggtcggcaagacatactgaacactgccattggacgacctgaccatgggggtcgcgttcgggcagcaggctcaggtgtcactattactcagtactacggaagggcatcaaaggacatgcagcagctcgtccac

SEQ ID NO: 59608 - DNA, 174 bp, Glycine max
  Peptide Sequence Number=SeqID_151293
atggtttactctagaagacctctactcatggatttattatgcaaattaggggatgcaacatttatggtggagcccatgagtgaggcatgtgcttggctcaagaggatgcatccaaagaagtcaactacatggccaatcccaactgtcaagggttccattaaagaggacctatag

SEQ ID NO: 59609 - DNA, 120 bp, Glycine max
  Peptide Sequence Number=SeqID_151294
atgactggtgagcaggtataccagcgggttcaacacctgaatactgtatttggaaagaccctaaagaaggataaaaggcaagacgaaggatggcttgaatacccatcaagatctagctga

SEQ ID NO: 59610 - DNA, 809 bp, Glycine max
  Peptide Sequence Number=SeqID_151295
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtcatggtgtaggcgtcctggccaaaaaacggcgcccactggccctgcccgctggggggcacctggtcgggcagcaggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59611 - DNA, 181 bp, Glycine max
  Peptide Sequence Number=SeqID_151296
tgcgcaatccgtaaagttccgtaacatcccggaagccaaaaaaggggatgattacgtgatccataaggtttcgggtcgtgcaaatagcaacaggcccatttgggccttccaggatgctctccagaaggcggtgccttctggaggaagcaccctagctcgcctgggtgagctgggtggcaag

SEQ ID NO: 59612 - DNA, 918 bp, Glycine max
  Peptide Sequence Number=SeqID_151297
accggtgcacgggtgcatggcatgatcttaaaagaagagttagctgcttgcgcaaggtccaaaaggagtttggctcaacacttggaagccacagagcaaagcatgctcgctatcatagggcaatacaaggaagaattgaaccagtctgtgacccatgaacaaaagctagcggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagaacagatgaaggccgatctatcggccttaaaagatcaaatggcttccatctcaaaggtcatgctaaaactccagaaaactatagaggataaagccacggcaaccgcctccagtacagttagggaagcggagccggtgctacagcctgccttaaatctgggccgagacagaaacacagcagtgtttggtcggaggtatagcccgcaagcttccccctatggcttgcctccggacttcgctccccgtgccgccccagaagatttaagccaagccccttccttcgagggtcaactcccaccttatgcagtctataccgtgcaagacgatgaggaaggagatccccgcctcggccccctgctccacctcaaagatccgtccccccatgaactaccccaacgaaacatagttcgccatgtcccggcttcacccgcacccgtaaaagaatctgttcccttcgcggaagataaaggaaagattgaggcgatggtagagaggttaagagcagtcgagggcctcggcaattacccgttcttggatttagtggacttatgtctcgtacccaatattgtcattcctcccaagttcaaa

SEQ ID NO: 59613 - DNA, 917 bp, Glycine max
  Peptide Sequence Number=SeqID_151298
tacacgtcctcaccttcagaggactacacatcctcgccttcagaggactacacgtcctcgccttcagaggactacacgtcctcacctttagagggctacactacgtcacttttagaggactacacgtcctcgccttcagagggctgcacgccctaaccttcagagggctacatgccctcaccttcgaagggcaacatgccctcacctttagaggactacacgtcctcgccttcagagggctgcacgccctagccttcagaggactacaggtcctcgccttcagaggactacaggtcctcgccttcagaggacagcaagtcctcacctttagagggctacacgcactcaccttcagaggactacacatcctcaccttcagagggctacacgccctcacctttagaggactacaggtcctcgccttcagaggactacacatcctcgcctttagaggactgcacgtcctcaccttcagaggactacaggtcctcgccttcagaggactacaggtcctcacctttagagggctacatgccctcaccttcagaggactacaggtcctcaccttcaaaggactacacgtcctcaccttcagagggttacatgccctcacctttagaggactacaggtcctcgccttcagaggactacacgtcctcacattcagaggactacaggtcctcgccttcagaggactacaggtcctcaccttcaaaggactacacgccctcaccttcaaagggctacacgccctcacctttagaggactacaggtcttcgccttcagaggactacacatcctcgccttcataggattacaggtcctcgccttcagaggattacacgccctcgcctttagaggactacacgtcctcaccttcagaggactacacgccctcgcctttagagggctgcac

SEQ ID NO: 59614 - DNA, 921 bp, Glycine max
  Peptide Sequence Number=SeqID_151299
atgatgcacgcagtcgccctgctgctgggcgtggctggcgggagcgccgacgatgtgaatcaccggcacatattcggcgtagctgccggcgatgccgttaatcgcactaagttcaccgacgccaaaggtggtcagcagcgcggccgcgccgttgcagcgaccgtaaccatcggccgcataggcggcattgagttcattagcgcagccgacccaggtaataccgggatggtcaatgacgctgtcgagaaattgcaggttgtagtcgccgggagtattagcgatgtggctgaactggcgagattttcaccatcatcgcgctgtcatgcatggcaagcattcgttacgacgacagaaaattctgtaagttgcgatctttgccgcgttacggcgcagtgtaaacgcatacactgctatgctgatgccactttctcccacctgagacaggaacgctgcatgagtacttttccccacgccgaacgttatcaccagatgcagtatcgccgcagcggccgcagcggcctgaagctgccggcgatttcgctgggtctatggcacaactttggcgacagcacgcgcgtcgacaacagccgcgcgctgctgcgtcacgcatttgatcgcggtattacccattttgatctggccaataactacgggccgccgcccggttctgcggagagcaactttggccgcattctgcgcgaagattttcacggcctgcgcgacgagctggtgatctccaccaaagcgggttacaccatgtgggacggtccgtacggcgactggggctcacgcaagtacctgatttccagcctcgatcaaagcctgaagcgcatggggctggagtacgtggatatcttttatcaccatcgtccggatccggaaacgccgctggaagagaccatgcgcgcgctcgatcaggtg

SEQ ID NO: 59615 - DNA, 291 bp, Glycine max
  Peptide Sequence Number=SeqID_151300
atgggcaccaggatttatttattcttcgaattgattttacgtcacagctgtccctcctgttcagctacagacggggtggtgcgtaacggcaaaaagcaccgccggacatcagcgctggcaagtgtagcggtcacgctgcgtgtaaccgccacacccgccgcgcttaatgcgccgtacagggcgcgtcccattcgccattcaggctgcgcaactgttgggaagggcgatcggtgcgggccttttcgctattacgccagctggcgaaagggggatgtgctgcaaggcgattaa

SEQ ID NO: 59616 - DNA, 572 bp, Glycine max
  Peptide Sequence Number=SeqID_151301
aatactcattaaatgacccaacaatagatgatcttgatgattatgatgaacaaacctttctatctgcctcatctgcataccaaaatacaggtggtacttacattgatatcggagatcctatatgggaatgcccacattgtaaggctatgatatggtatgatgagaggataaataaagacaaacaaaccaagattatcattgcaatcaaagacatgcttgatcatcataatcactatgctcaaaggtttcgaatggcaagggacaaattgcattatgctgcagttccagacttgaagatgaaactcattagtcaaagacaaacagacggaaggttgtataacttaccaactaccactgaagttgtttccttgattgttggtgatgaacactcagctgataaaagagatattataatagaaaaaaaatccggacttctgaagagaatacatgaacttcatcctgcatatttgcctttgcaatatccacttttatacccaaaaggagaagatggttacaaactaaatatacctcacaaagatcatgccaatatagatgctgcaaagaggaaacaa

SEQ ID NO: 59617 - DNA, 71 bp, Glycine max
  Peptide Sequence Number=SeqID_151302
aatgacagtggcaaggtgcaaggagtgagattcttggtgaagagccgccgagctgacgtgatgacgttggc

SEQ ID NO: 59618 - DNA, 399 bp, Glycine max
  Peptide Sequence Number=SeqID_151303
atgggacaccttagggttcccatgaaccctaagagaataaaggtcattcctgagtggcccgctccaccaagtgtaagaaaaatttggggcttccatgacttaacaaacttttacaaaagatgctggggaaaaaagcccagagtttcaagaacctcaggatttgaggtcaaatccttttcaagggggagggaacatgatgtaacctccattggagcttcggaatggagcatgaagagagagaggagacgctacttcaaggagaagatgagtctagaagaagctcaccaccataggaggcaatggataagagcttggaggaagaaagagatgaatgaagggagagggagagaagagcacggaattttgtgctctaaaagagctctgaaatgtgaaatttaa

SEQ ID NO: 59619 - DNA, 830 bp, Glycine max
  Peptide Sequence Number=SeqID_151304
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcattggatagaagactccaagtagattgggacagcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59620 - DNA, 154 bp, Glycine max
  Peptide Sequence Number=SeqID_151305
gaccattgaggagatattcatatggcatggtgcttcaattggtttctggcgtgggagaaacttgacggattacctaacgacgggtgttaagtacctcgaggtggtcaagcgaaggttgcatgccaccaaacaatggtccccggatgaaattagg

SEQ ID NO: 59621 - DNA, 746 bp, Glycine max
  Peptide Sequence Number=SeqID_151306
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtggctttgttcatgctcgtgcacttagcgcaattctgaaccgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59622 - DNA, 381 bp, Glycine max
  Peptide Sequence Number=SeqID_151307
cgtcgctgcgttgcgggagtttgcggcggacatgggcgtgcagcggccggcgtggacacggggcgggcgacaactgggaaagggaacagcccgcggcggcaagggcagcggctgcaccttacagcaaaagagaatcatttgcatctatggcatgaggcgcagcatgcatgggccaccgcggcgtcagcgcgggcgatagtcgcagtggatctgcagggcctcggtggggttgtgatgcagctcgaagccgcaatgctgcaggctgcgcttcacccgcgcgaccgcttcggcatgatgggcgacgcgatgatcctgccagcgcggtggggtgaacacgcccagcggcagcagccgcagccgcttgccgtgcagtaccagtga

SEQ ID NO: 59623 - DNA, 812 bp, Glycine max
  Peptide Sequence Number=SeqID_151308
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgcactgagtgcgttgtcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59624 - DNA, 79 bp, Glycine max
  Peptide Sequence Number=SeqID_151309
gcttagtgcagcattggcgccaagcctaaatccacttactcgcgctaagcgtgacgacgcgatttcagagcctatttaa

SEQ ID NO: 59625 - DNA, 471 bp, Glycine max
  Peptide Sequence Number=SeqID_151310
atgaccatgattacgccaagctcgaaattaaccctcactaaagggaacaaaagctgggacatcgcccacacgtgctttaatgaagaagtccaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 59626 - DNA, 221 bp, Glycine max
  Peptide Sequence Number=SeqID_151311
atgacacttcagactctcttcctgattatctcacctatgaattcttacagaaaaattctcatgccacctaaggcatcaggcgcctccctaaggggaggacagagcaccggcaaaggattcaagttggccctaccagagccaactgtcaaaaagagttcttccacaacctctgggtcaccaacccaggctggttcatctacccagaaacccaaaacagaagg

SEQ ID NO: 59627 - DNA, 1181 bp, Glycine max
  Peptide Sequence Number=SeqID_151312
atatccgcgcgtctgaagcgctggtcgacgagctggatctggcccaactctccgctaacaaccgccaggagctgtcgcgcatccgctctgagctggcgcagaaacagagcgaacaactcgatgcctacctgcaggcgctgcgcaatcagcagaacagccagcgccaacgcgaagcggaaaaggcgctggaaagtactgagctgctggcggaaaacagcgaaaacctgccgccggggatcatcgaccagttcaaaatcaaccgcgagctgtcgcaggcgctcaatcagcaggtccagcgcctggatctggtagcctcgcagcagcgacaagccactaatcaaacgctccaggtgcgccaggcgctgaacaccctgcgcgaacagtcgcagtggctgggatcatcgaatctactgggcgaagcgctgcgcgctcaggtcgcccgtctgcccgagcgcccgcgcccacagcagttagatactgaaacggcccagttgcgcgtgcagcgcttgcattacgaagacctgctcagcaagcaggcgcagctacggctgattcgccaggccgacggcgaaccgctcaccgcggaacaaaaccgcatcctgcaggcgcaactgcgcacccagagcgagctgcttaactcgctgctgcgcggcggcgataccttgctgctcgaactgacgaaactgaaagtcgccaacggccagttagaagacgcgctgaaagagattaacgaagcaacccaccgctatctgttctggacctcggacgtcagcccaattggcttctcctggccgctggaagtggtgcaggatctgcgtcgtctgatctcgcttgataccatcaaccagctcggcaaggccagcgtcatgatgctgaccagcaaagagacgctgttcccgctgtttggcgcgctggtgctgcgcgcggattggcaaggtgactcaggatcatttctggctgacgctgcgtaccgtgttctggtcaattctggtggcttcgccgctgccggtattgtggatgacgctcggctacggattgcaggcggcctggcccttcccgctggcggtcgccattggcgacggcgtgaccgccaccgtgccgctgctgtgggtagtgatgatttgcgctaccttcgcccggccaaatggattgttcatcgcccacttcggttggccgcgtaa

SEQ ID NO: 59628 - DNA, 102 bp, Glycine max
  Peptide Sequence Number=SeqID_151313
atgaaggagtgttcatggttggatatgttgggagagacaagcagcaagaataagaggcttatacctcagagcaattttaaggcaagatatcagcttctttga

SEQ ID NO: 59629 - DNA, 827 bp, Glycine max
  Peptide Sequence Number=SeqID_151314
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttgaaccagttctcagtctcaaccttggtaacacggtggggtgcaccaacacgtccacgcttgtgcttcttgttggcgatcttgagtcctggacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59630 - DNA, 270 bp, Glycine max
  Peptide Sequence Number=SeqID_151315
atgaagcacttcactgacaccctcatcagtgccaacataggaacaaaagctggtaccgggccccccctcgaggtcgacggtatcgataagcttgatcgtccaggactcaagatcgccaacaagaagcacaagcgtggacgtgttggtgcaccccaccgtgttaccaaggttgagactgagaactggttcaagatcgaattcctgcagcccgggggatccactagttctagagcggccgccaccgcggtggagctccaattcgccctatag

SEQ ID NO: 59631 - DNA, 420 bp, Glycine max
  misc_feature (213)..(213): n is a, c, g, or t
  Peptide Sequence Number=SeqID_151316
atggccccaaggaagcttgcctcaaagaggtccaggaaggacaaggcagccgaagaaactagttccgctccggagtatgacagtcaccgctttaggagcgctgtacaccagcagcgcttcgaggccatcaagggatggtcgtttctccgggagcgacgcgtccagctcagggacgacgaatatactgatttccaggaggaaatagggcgccgncggtgggcatcactggttactcccatggccaagtttgatccagaaatagtccttgagttttatgccaatgcttggccaacagaggagggcgtgcgtgacatgagatcctggcatgcagagccagggcttcgcttctttttcatgccctactccagaccaagttcagggcagaggttgcatgggcccggagattggcccgaggcctaa

SEQ ID NO: 59632 - DNA, 888 bp, Glycine max
  Peptide Sequence Number=SeqID_151317
atggctccgaaaaagctttccacgaagaggtctaggagagacgccgcggcggaagggtccaatgccacccccgagtttgatagccaccatttccggagcgccgagcaccagcagcgcttcgaggccatcaaaggatggtcgttccacagaaataggcgcgtccagctcagggaggatgagtatacagattttcaggaggagatagctcgcagacattggatgtcgctggtgactcccatggctaagtttgaccttgaggtagtcctggagttttatgctaatgcttggcccacagaggagggagtgcgagacatgcgtacatgggtgagggttcagtggattccctttggtgcagatgccctcagccagttcctgggtgacccgttagtgttggaggaaggccaggagtgcgagttcagcaagaggaggaacagggccgacgagttcgacgaggaggccattgcccaactgttatgcacactggggcaggatgctgcccggactgctgcagggaggcaggtgcggatcatgcgcaccagcatgaccaccttgacccagacgtggatgacattgctgctcagtaatgtcttgcctagcgatcataactccaatctccctctactgaagtgtcagttggtgtatgccatcctggcacggatgagcgtccatgtggcccaggtgattgctgacgccatctatttgtttgcaggtatgccaccgaccaagcaccctctagacctggataagtctaacaggtccctggggtttccggcattgatcacgggcctctaccagtcattcggggttcccgtcacccctagtaaggtgatccgaccgccgatcacccgtgccttcatcgagaagtattgcactcctaggcaggcgtag

SEQ ID NO: 59633 - DNA, 186 bp, Glycine max
  Peptide Sequence Number=SeqID_151318
atggcacatcagaggaacaagagagggtacatctcttgtggatcagttctagtggagggtacatccactaggttgttcaaagagaacaagggagggtacatcccttgtggatcttttcttgtaaaggactttacaaggttgaaaagaaatctcaaggaccgcaagtcgcttggggactggatgtag

SEQ ID NO: 59634 - DNA, 192 bp, Glycine max
  Peptide Sequence Number=SeqID_151319
atggataagagcttgaaggtaggagaagaggagtggagggagagggagagaaggggcacaaaattttgtgcctcaaatgagattatggcagcggaatggagaatgaagaaagatgattggagatgccacttcaaggagaagatgagtcaaaaagaagcttgccactataggaagccatggataagagcttga

SEQ ID NO: 59635 - DNA, 294 bp, Glycine max
  Peptide Sequence Number=SeqID_151320
atgggtatgagcctggaatgggtttgggccggaatggtggtggcacgatccgataatgagtcctgtgaaagcagcgatattgaggacctggatgttgactttgagcagccagtcaatcaaaccggggaggaaaaagatgaggattggggattcctcttggatttgaggagaatagtggaacgggaagaaagagagataaagtcgcatcaagaggagacagaggttgttaacttgggcacttgtgaagaaaaaaatgaggtcaagattggcacttgtgtgtccgctaacatctga

SEQ ID NO: 59636 - DNA, 408 bp, Glycine max
  Peptide Sequence Number=SeqID_151321
atggggcaaaatggtcactttgggaacattttccaacccttgggcccacctgggtccattagaaaacttagagatgaagtaaccagctcgcctgggcgagcaagttacttctggaggaagcaagtagctcgcttgggcgagctgctgcgcaacctcctcccctcattttttataaataggcgtgaagggctgaagggaaggggttcagcatcatttgggtccatccttgttttgcatgtcttcatcttcattcttctaccatcggtgatctttttctttgttttaagatacaaccttcgcttgaccgcttcgaggtacttaacacacatcgttaggcaatctgtgaagttccgtgacatgccagatgtcgaaaggaagcattgttgcacaatccgtaaagttccgtaa

SEQ ID NO: 59637 - DNA, 204 bp, Glycine max
  Peptide Sequence Number=SeqID_151322
atggactcgggaagtttgttttttttccaagttgaagatgtactaggtgagcatgctaccctgaagagggtttttacccgttgtggaatgcaaggggtgtggttgtgggagatactgaaggccctccaaagtgttttgcaggggtatatcgccaactgcttgcccttcagtggcatatccgaggctcgactcgaagtcgcctag

SEQ ID NO: 59638 - DNA, 171 bp, Glycine max
  Peptide Sequence Number=SeqID_151323
atggagcgatctactagctgtaaagtcattcttgtgggcattatttccaactcccccaaccttctacacatggagagtggcatcaagttgatactggctcccaggtcaatgagagctttttccatcgagacttcaccaattgaacaaggagtggtcacattcccaggataa

SEQ ID NO: 59639 - DNA, 195 bp, Glycine max
  Peptide Sequence Number=SeqID_151324
atgaagaaacaacaatggaagagaagcgaaagacaaaggagaagaggtgagaggaggtgccatccactaaggaataagccatggaagaaggagcttcaccaccaagatgagccttggataagaagcttggagaggatgcttcaatggaggaaaagaaagagggagagaaagagagaggggggagcacgaaattga

SEQ ID NO: 59640 - DNA, 390 bp, Glycine max
  Peptide Sequence Number=SeqID_151325
atgaacaacatgattacgctgcaacacactaaaattaaggcatcctttgagacaagtacacatgtggttggacatgtttttaaagttaccttatgcaagaggctacttggcttggtatcaaggtatgctttaaataagatttttgttgagtttgagcgtgtacattatgctggcaaaaccctttctcgttgtggatgtgtcatgagaactactcacgatcttccatgtgcatttactctaaagagtaaactccgggaaattgcctaccctgatctaaactttatgtgtcctcctccagaaaaggtcaacaccaaaggtgctcagaagaaactgatgaccaaatatccaagatccacaaagcgtgatcctgtcttactgggaatatgttga

SEQ ID NO: 59641 - DNA, 148 bp, Glycine max
  Peptide Sequence Number=SeqID_151326
atggctcccgatcggactcagctgcagaacatggttaaaaaggaaagcgagtcctttaaagagtatgcgttagaaggacttggcagcacaagtagcccctcccatggtcgaaagggaaatgattaccatgatggtagacaccttgccg

SEQ ID NO: 59642 - DNA, 267 bp, Glycine max
  Peptide Sequence Number=SeqID_151327
atgtcaggattgacacgcgattctcttaaaatttcagccagcccatatcaatcagaccttgcaccgtacgcttcagagccctgcaatgctcaatggaacgccccggggcttctccgtgacaagcacacgttgcgttcaagtcgtattctcggagaaatggaggttgatgagccttggttggggctttctcgctgcaaaattcatttcttggttggtgttttggtttacgctaaaggtggtgtttgtcattggaagtgcggtaggtag

SEQ ID NO: 59643 - DNA, 246 bp, Glycine max
  Peptide Sequence Number=SeqID_151328
atggagaagggagacacaaaagaattcaggcggttagtccttcgttcttttggaaaagggagaagagagacacaaaaagaattcaggcgattagtccttggtgaattctttttggcaaagggagaagaaatgaaaagaatgaatagcacaagttttcaaggtttagaaaaccagaaaactcttgaagcaatcactggtaatcgattaccaaatcagtgtaatcgattacacaaagcttttatgtga

SEQ ID NO: 59644 - DNA, 99 bp, Glycine max
  Peptide Sequence Number=SeqID_151329
atggctcaaggcacgctctatattgtttccgcccccagcggcgcaggtgtctgtttctcataccacccgcggcgtgcgtcccggcgaagcgcatggtga

SEQ ID NO: 59645 - DNA, 393 bp, Glycine max
  Peptide Sequence Number=SeqID_151330
atgttgatctcccctgcggaagtatcaattggtctgtgctgtcatgacatagggatcgcactcacaagacacctagtggacccggaggagcccaacagggccctggggtttccagctctggtttcgggcctctgtcagtcctacagggtgcccatccccccagcaagcgatcccgcccgcaagacacccagtggacccggagaagtccaacagggtcttggggtttccagctctgattacgggcctttgtcagttctacggattgcatgtcgcccccggcaaggcaacaaacgcaccattgccacctccgaagcccctcagctcatccacaaaagctggagcgttgcctacgacccgtggttgaccagcaggcgaccaagtccaaagccaaag

SEQ ID NO: 59646 - DNA, 171 bp, Glycine max
  Peptide Sequence Number=SeqID_151331
atgggtgccaagtacctcgaagtggtcaaacgagggtcgcatcccaacaacggatggtccccggacgaaattagagtgcatgaccttattcgtccaggttgtaataaatttttccttgtgggggataatctatgtatcattaacatagtcaacggacattggccaaggtga

SEQ ID NO: 59647 - DNA, 905 bp, Glycine max
  Peptide Sequence Number=SeqID_151332
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaggtccatcgacaggcgcgggctcaacgccatgtgccattgcgcggtggcttcggtttcttcaaggtcgccgagctttctcgcctctacttgagggccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 59648 - DNA, 616 bp, Glycine max
  Peptide Sequence Number=SeqID_151333
tggttgaaagcccacgtgcaaggtttggattggctcccaagtctgagagccactaaaagggatgaagatgaggcaccggaggaagacgaaggggtgcaggcctttaggacagaactcaagcaagctcaaacagtcaaagaaaggttcaaatctgcagctcttaagatccgaaaggagaatgccgaactgagagatgtaaatatagctaccaccaaggctttggaacaagagaccaaaagggcctgtagggaagaacatagccggaacaagttccgaggggctctgtggggcagtaacagcgaacttaaactccgaagagaagaaagggaccaatcacggaccaacatgttagccatcatcaacaagtaccaagaggaactaagtctagccatgacccacgagcatagggtggcggacgagtatgcccaagtgtacgcggaaaaggaaactagaggaagggtgatcgactcgttacaccaagaggcaaccatgtggatggaccgatttgctcttaccttgagcgggagtcaagaacttccccgattgctagccaaggccaaagcaatggcggacacctactccgctcccgaggagatccacaggcttcttagctatt

SEQ ID NO: 59649 - DNA, 153 bp, Glycine max
  Peptide Sequence Number=SeqID_151334
atgcttgacactaaatttgtgttgcatcctcaaacaccttcacaggttgctaaggatcaacttacaatgaaggacaagagggatgaggaaaaggagagttcccttagcactgtcacaattcccacacttgagaccattcccccaaaggcctaa

SEQ ID NO: 59650 - DNA, 327 bp, Glycine max
  Peptide Sequence Number=SeqID_151335
atgtggatggatcggtttgctcttaccttgaacaggagtcgagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgct

SEQ ID NO: 59651 - DNA, 393 bp, Glycine max
  Peptide Sequence Number=SeqID_151336
atggaggatggtgagacctcgaaactcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgaatgtccggcggtgcttttgccggttacgccccacccccgtcagtag

SEQ ID NO: 59652 - DNA, 706 bp, Glycine max
  Peptide Sequence Number=SeqID_151337
atggggaacggaccttgctcagcgcttgcgggcgacctgccggttccacgcgtcggtgacctcggcgcggcgggcgttgatgatgttccagtcgaacaggctcaggttcttgaccgagccgtcggcgccccagggcagcttgcgggccacgtccttggatacctgcacgtccttgaccgcggggcccaggtacagcttggtcgccaggcaggcggccgcgtccggcgtcagcgcggtgtcgatgaacttctgcgcggcggccttgttgggcgcgcccttgaccagatgcaggcgggcgtcggtggcccacacgccttccttcggcacgctgaagccgatgggcaggcccttgtcgatcaggtcccaggcgccgacgttgaagtgcgcgccgatcacggcttcgccgctctggaaggcgttggtggccgcgcccgagctgtcgaagaacagcgcggtgtccagcgaggccagcttggaatagagcggccccaggttcgacgggtcgattgcccacacccgcgccaggaagaagatgaacggcacgcccgacgagttggcgggcgagggcaccgccaccgcgccggcatactcgggcttccacaggtccttccagctgctcggcggctgcgtcacctccttggtgctgtaggtgatgccgagcgagtaataaccggtgctgaccgcgaaggcggcattgccgtcgcag

SEQ ID NO: 59653 - DNA, 598 bp, Glycine max
  Peptide Sequence Number=SeqID_151338
agggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtccttgccaacgtagggctacacgccttcacctttagaggactacacgtcctcgccaacagagggctgcacgccctcacctttagaggactacacatcctcgccttcagaggactccacgtcctcaccttgagaggactacacgtcctcgccttgagaggactacacgccctcgccttgagaggactacacgtcctcgccttgagaggactacatgtcctcaccatcagagggctgcacgccctcacctctagaggactacacgtcctcgccttgagagggctacctgccctcgccttgggtactagttaccctcaccttcagaggactacatgtcctcaccttcgtagggctacatgccctcacctttag

SEQ ID NO: 59654 - DNA, 186 bp, Glycine max
  Peptide Sequence Number=SeqID_151339
atgattatgaggagccaagacatttatagtagcctagatgaggctactacttcaccttcctctagtgaaagtgaagaagcaaaaagggaagaatctagtttgcaagagcttaaatccttgtgctttgttggtgccaaaaataggtggtatgatgaatgttttgagtggtgcaaccctcttttgtaa

SEQ ID NO: 59655 - DNA, 334 bp, Glycine max
  Peptide Sequence Number=SeqID_151340
atgctggatgaatacaacgtgcatgcaaaaagtttcaagatgacaagaaatagattgaaagatggtcaaatgcataatgagatgttgaaattgattgttaaccatgaaaaggatggtcatacatataatgtaccaactgttcaagaagttgttgcactaattgtaagcgatttggatgcaaattcaaaaagagatattattgttgaaactcaacaaggacaattacaaaggatccatgaattacattctagctatctagttctgcaataccctttcatgtttccttccggggaagatggatatagacctgatatcctccatagtagttcaccag

SEQ ID NO: 59656 - DNA, 174 bp, Glycine max
  Peptide Sequence Number=SeqID_151341
atggccacatcacaagatggaaatggtggtgtccttcctctagcattcgcggtggtcgaagataaaaatgatatttgtctgatatctgatcgacacgcgagtataaagtccgttgtcgctaacgaagcacttggttggcaacctccctgcggttatcatgtctactgcgtgtga

SEQ ID NO: 59657 - DNA, 216 bp, Glycine max
  Peptide Sequence Number=SeqID_151342
atggcaaacctgtggctaagcgagtgttgtctcgctaagcccagtgttgctcgcgctaagcaccgcctctgtgggctaagcgctatttgttacagcatgcataaggctaagccagcgctgctcgctaagccattgtttgaaataaaaatggcatccaggaagaggaagagcactacttctaggcctatagctcagtatgatactaggggattctaa

SEQ ID NO: 59658 - DNA, 135 bp, Glycine max
  Peptide Sequence Number=SeqID_151343
atgggaccagcaatgcatgtgagcagcggggaattttacatggtagtctcatttcgaagggaaaaagagacaatgctgaccatatctatgattcattgcatctcaaaagggattctagtatttgttcttctctaa

SEQ ID NO: 59659 - DNA, 561 bp, Glycine max
  Peptide Sequence Number=SeqID_151344
atgaggggagcaccgacggaagaaagcctctctcctttccttgtgagagatttcggtacgcaaagtttcaagattatacaaagagtccataaggcgtgggaaagcccgttaaggaaagaaaaagaacttaggggcattcgtaatggcatcatcggtggttatcatgaatggctgaaagttcatacacgagggttagattggctctccaagttaaagattatcaacgaagagaacttcgaagctccagaagaggatgaagaagttcgagctctaaaaacagaactaggaaaagcaagacttgccaaagaaaaattcaagttggtcactacagacgttcggaaagagtgtgccaagttacgagaagaaaatgcggctaccgcaagagcccttgaacaagaaaccaagagggctcgcaaggaagagcatggccgtgacaaatttcgtggagctttgtggggcagcaacagtgagctcaagcttcgaagcgaagagagagaccaatcacgagcacatagcacggtcttgaaagaggagttagctgcttgcttgatgaggacatga

SEQ ID NO: 59660 - DNA, 188 bp, Glycine max
  Peptide Sequence Number=SeqID_151345
caatcactacgcatgactccaaactcgcgggtggaggacacatgaacgaaaacgcaattcatggggctccgaaaaaaggattgagaatggagaattgcactaagcaatcactacgcatggctccaaactcgggtggaggacacatgaacgaaaacgcaattcaatggggactccgaaaaagggattga

SEQ ID NO: 59661 - DNA, 492 bp, Glycine max
  Peptide Sequence Number=SeqID_151346
atgacagatcttgtgagcgcggaagatgacgtaaatctccgcgtgtcaacgggcttgtcggccgtgattgacgaaaggtcgcagaagacgacacagcaaaaagtttatacgaataaccactcaggtatttccgcccgtcagcgtgactcaaaagtcagtatgacagatcttgtgagcgcggaagatgacgtaaatctccgcgtgtcaacgggcttgtcggccgcgattgacgaaggcgcagaagacgacgttagtctctacgtgctatcaggctttttgtcttacagacagcaaaaagtttatacggataaccactcgggtattttcgcccgtcagcgtgactcaaaagtcagtatgacagatcttgtgagcgcggaagatgaccgtgactcaaaagtcagtatgacagatcttgtgagcgcggaagatgacaagcaaaaagtttatacggataaccactcgggtatttccggccgtcagcgtgactcaaaa

SEQ ID NO: 59662 - DNA, 276 bp, Glycine max
  Peptide Sequence Number=SeqID_151347
atgcaatcccagggacttgcattgcctcctgagcctgaggttggtccttcacctgctcatgtcagcacaaaggagagttgtgttgatccctcagggaacgatccaaacacgggtgactcagacaaatacgggttggagctgtgggaccagcaaaacctgcagataggccggatcatgaggtcgatgatccctatatctgatgacattgaccatcccacaactttttctaaagccattgcaggttatgtgggatgctaccgtgttcggggtgtttaa

SEQ ID NO: 59663 - DNA, 102 bp, Glycine max
  Peptide Sequence Number=SeqID_151348
atgtgggtgagtgatatgaatggcagcagaatggagaaggaagagagagaggagacgccacttcaaggagaagatgagtctagaagaagctcaccaccatag

SEQ ID NO: 59664 - DNA, 153 bp, Glycine max
  Peptide Sequence Number=SeqID_151349
atggaggatatgccttcctttcaagaaagcagtttgcctttcatctattatatgaggaagaacacgagccagcctggtagccaagattttggacactattttataggcacaccctataagagagatgggtctataatcattaagagtctgcag

SEQ ID NO: 59665 - DNA, 336 bp, Glycine max
  Peptide Sequence Number=SeqID_151350
atgcataggatacttttagaggatggagctaagtcagtgagacagccacagcggcgactcaaccccgtcattctagatgtggtgaaaaaggaagtgaccaagctcttgaggctaaatcaggtaaccagaaaagatcattttcccctgcctttcattgatcaaatttggcgtcgttcattgatcaaatgcttgagcgcttggcagggttttataggcgttttatcaaggattttagcaaagtggcccttccactatccaatctgctgcaaaaggaggtggagtttgattttgatgaccggtgtaaagaggcttttgattgcctcaagcgtgcagtga

SEQ ID NO: 59666 - DNA, 382 bp, Glycine max
  Peptide Sequence Number=SeqID_151351
atgactagaggcaatccatcttacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattttgattctgagcattctgattttgcacattctcagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcag

SEQ ID NO: 59667 - DNA, 198 bp, Glycine max
  Peptide Sequence Number=SeqID_151352
atggggatggggcagtcaggcgttggtgctttatttaatggcatcaatgcattaaatgcttataacgccgcattgcttacaaaaattctcaaagttagcgttgaagaatttagcccttcaatcgccagagaaatctacgagatgtatgaagcggttagtatgcagccgtcacttagaagcagggatgttctcacctaa

SEQ ID NO: 59668 - DNA, 875 bp, Glycine max
  Peptide Sequence Number=SeqID_151353
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattaacaactgcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59669 - DNA, 881 bp, Glycine max
  Peptide Sequence Number=SeqID_151354
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaagtattggactattggggtgagacagttgtttgtgagcatgcttatggctcagtacactgactacactgaaataaagtcacaagttgtagatagaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59670 - DNA, 351 bp, Glycine max
  Peptide Sequence Number=SeqID_151355
atggccgttggcattatgcatatgcatcctgaataccatacgatcctggatcatcccgagcaataccttgaacaggcttactatccggaaatgggcgaaaccaaccccttcttgcatatgagtttacatctttccattcaagagcaaatcagcatcaaccagccaattggcatcacccctgcttatggcaagctgtgcacacgcttccaggaagaacacgaagcccaacatgcgctactcgaatgtttggccgaaactatctggctggcacaacgcaatcaaacgggcttggatgcggcacattacctgaacttgattgagcaacgcgccggcattgctccatccacctaa

SEQ ID NO: 59671 - DNA, 441 bp, Glycine max
  Peptide Sequence Number=SeqID_151356
gtcgcagaagacgacgttagtctgtgcgtgctatcaggctttcgtcttacagacagcaaaaaggtttatacggataaccactcgggtatttccgcccgtcagcgtgactcaaaagtcagtatgacagatcttgtgagcgtggaagatgaccgtgactcaaaagtcagtatgacagatcttgtgagcgcggaagatgaccaaaaagtttatacggataaccactcgggtatttccgcccgtcagcgtgactcaaaagtcagtatgacagatcttgtgagcgcggaagatgacggcgcagaagacgacgttagtctctgcgtgctatcaggcgtttcgtcttacagaatgcaaaaagtttatacggataaccactcgggtatttcctcccgtcagcgtgactcaaaagtcagtatgacagatcttgtaagcgcggaagatgac

SEQ ID NO: 59672 - DNA, 253 bp, Glycine max
  Peptide Sequence Number=SeqID_151357
tgaactgcttcacagcagtaggagcatggagacagggggagcagaaagctgatgtcacgaaagctggagttgctgcacatgatgtccaacgttatgtcaaggaatccgatcgggctgcacaatgcacaaggcaagatgaaatgtcaaatgaagaattgaagctgcaggattcacgatgtcggatacaatgtccaggacatcctgcccgaaaatactggagttgctgcacaatgcacaatgcaggatccacgat

SEQ ID NO: 59673 - DNA, 711 bp, Glycine max
  Peptide Sequence Number=SeqID_151358
atggcgaatcaagaggagtgggccctgtttatggacgtattagcattgctaatctttggggttgtcctctttccaaacatggacggtttggtggacctagtcgcaattgatgcttttcttgcatatcaccatagcaaagagagcccggtggtagctatcttggcggacttatttgatacatttgtccgaaggtgcgagaagagtagcgcacggatcatctgcttcttgcccactctttgtgtatggttggtttcgcacctattccaacatgacataaggcacccatgtccgctccgaagccatcacgcgtatgtcgaaaatagaagagtagattgggaccaacacttggctgggataggaggcagaacaatcagctggtttcctcgatggaaggaaggaaaggagggagtcctcttctcatgtggggactacccaaacatcccgttgatagggacgagaggttgtattaactacaattccgcgcttgctataagacagttagggtaccccatgaggggagcaccgtcagaagagagcctctcacctttcgttatgagagatttcagcgcgcaaagtttcaagattatacaaagagtccataaggcgtgggaaagcccgttaaggaaagataaagaactgaggggcatccataatggcatcatcggtggttatcatgaatggctgaaagttcataaacgagggttagattga

SEQ ID NO: 59674 - DNA, 846 bp, Glycine max
  Peptide Sequence Number=SeqID_151359
atgatcaaattctatggtgatctgactcatagtcatcatttatcaaagaataactctggttatcaaatgattgaacaaccgggagcaatttacttacgatatttagttgacattcataaaaagtatctagtgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaaaaaatgtcccatactaatggattcgggtccacaacgatgggttcaaatgtacgagatcttgtagcacttaccaacgaggccctatcggattag

SEQ ID NO: 59675 - DNA, 363 bp, Glycine max
  Peptide Sequence Number=SeqID_151360
atggccagcaataagaaggagacaaaaaaggagttgatagacagagacatatgtcatgcgctatggggggatcctgatgtacaatgggcagatcaaccagcaactcatacggctggcggcattctatgcctatggagtgaaaaagtttttaggatggagaggaagatcattgggccaggatatgggattttaattgtaccagaaatcacacagagagatttggaacatgccacaggagtttggagaatattgggtctagagaatttaatggatggattgaagacttggaggttgacgaaccaccttgggtgggaagtaagttcacctgggtacgacccaatggatcagctaggagcaagttag

SEQ ID NO: 59676 - DNA, 207 bp, Glycine max
  Peptide Sequence Number=SeqID_151361
ttggaagttggaagtggaagttactggaagttggaagttggaaatgaaagttattggaagttgaaagttgaaatggaggtggttgtcatcatcaaaaagggggagaatgtaaatcatgaagattttgatgatatcaagaagaatttgcttgagaaagagggagatgtaaatcatgcaagctttgatggtgtcgagaagaaatcacat

SEQ ID NO: 59677 - DNA, 686 bp, Glycine max
  Peptide Sequence Number=SeqID_151362
atggggacatatcaaactagcaaaaggttttatcaagtcaagattaagggcctagatatcactagcattaaggagttggggcggttgatgggacctctccaaatgcaagccttccgcaaggcgtacggaaagatcttagatttgaccatagcagagatatccacagaagccattgcatcactcgcccaatactatgaccagcccttgagatgcttcacgtttggagacttccaattagtaccgaccgttgaagattttgaggagattctaggatgtcctcttgggggaaggaaaccgtatcttttctccgggtttcttccctccttgagcaaaattgcaattgtggttagggattcggtgagaggattagaccgcgtaaagcaaactcgaaatgacatagtgggcctaccatggaagtacttagaaggcaaggcgagggatatggcgaatcaagaggagtgggtcccgtttatggatatattagcattgctaatctttggggttttcctctttccaaacgtggatggtttggtggacctagccgcaataaatgttttccttgcatatcaccatagcaaagagagcccgatggtagctatcttggcagacttatttgacacatttgaccgaaggtgcaaaaagagtagtgcacgaatcatctgttgtttacccgctctttgtgtatg

SEQ ID NO: 59678 - DNA, 264 bp, Glycine max
  Peptide Sequence Number=SeqID_151363
atgtacaacaccagttttcaattgttactcatatggaacagtgctatcaagggtcttgatgatgctccacagcctaaatcaaaggcttctgctatgtggattgtcgtcaagtgtaatagacaaaaaggaagtactaagtgcggctactatgtgatgcactggatgtccaccatcattttaggaacttttaggaataattgggaagcatattttaacgattctagaccattggagccagagagattaaaggcattgcagatctag

SEQ ID NO: 59679 - DNA, 483 bp, Glycine max
  Peptide Sequence Number=SeqID_151364
atgtggtctttccttaccggtcgtcagatcgactgggctcacttggttcagtaccgaatgcataaggcattatgggccaatgcacctctcccttaccctcaattggtcactctatttctccgtcattttcaaattccgcttgatgatgaaccatttggtcaagtcaagagttcctttgctactggtgctggtgcagtgacttcttttggatactgtaaggatcggaatggtcaatggctaaagaaagatgcacttcctcctcaagatgagcgtactccttctcctcctcctcagcgagatgattcagccctcatgactgaagttctttccgagttacgaggtcttcgtacttatgttggtgaacattttgattctctggatactcgctttgccggcatggatatccgtctcacacagcttgaagaagatgtgggttatattcgtcagagcttcgaccttccaccaccacctccaccttcttag

SEQ ID NO: 59680 - DNA, 863 bp, Glycine max
  Peptide Sequence Number=SeqID_151365
gagcgtctgtcaactggttcccccgatggaaagaaggaagaaccgggattctcatttcgtgcggaggatttccaaatgttcccttgatggggacaaggggttgcatcaattacaatcccgtcctcgctataagacaacttggctaccctatgagaggggcaccactaaaggaagagctcacacctattattgcacgaggtttcaatagcaccaacgcggaggcacttcagaaggtccgcaaggcatgggagatggtgcaaaagaaggacaaggaactcaaaggtagtagcaacaagcccatcggcggctaccatagatggttgaaagcctacatgcaaggtctggattggctcccgaatttgagaaccactaagggggtggaagttgaagctccagagaaggacgaagaggagaacaccaaactgagagacataaatatagccatcgctaaggccttggaacaagagaccaaaagggcccatagggaagaacatggccggaacaaattccgaggggctctgtggggcagtaacagcgagcttaagctctggagagaggaaaaggaccaatcacgagtagacagtttgatcttgaaggatgaattgaggatttgcctaaggtccaagagaagcttgtctcaacagttatgcgagaccgagaccaacatgttagccatcatcagcaagtaccaagaagaattaaatctagccacagcccacgagcacaaagtggcggacgaatatgcccaagtgtacgcggaaaaggaggctagaggaagggtgattgactcgttacatcaagaggcaacgatgtggatggaccgatttgctcttactttgaacgggagtcaagaacttccctga

SEQ ID NO: 59681 - DNA, 285 bp, Glycine max
  Peptide Sequence Number=SeqID_151366
atggtggctgtgggtgatggagaaactacacgaaagcgaaggctgaaatgcttaaataagagatgctctcgagaacggaagcttctagcacactccagacatcttctaaacgatcccaacggtcagatcatggaaaattgtcttgtgaagttgaaaaccaaatttcgagaagatccaacggttaacgaaggctgggaagcatttttaccgaggcagcttcatgtagctttctctagaagcttcattaagaggcttcctccagaagcttcctcgtggcttctttga

SEQ ID NO: 59682 - DNA, 601 bp, Glycine max
  Peptide Sequence Number=SeqID_151367
aaccatcaaagaagcgaaagggttcttcaaatcagagtcaacgacattccgagactcaggaaacgccaattccttcctctattccctctgcctcattgttttcattcgaagaacagcggatatagcatttgaaaactccaatcttattcctttcatgtctttaaaattgcttgtttactctgagttagtcaaagccttctattcaaaccttgaaatccaagaaggcactttaatttctgaagtttatgggattaaaatggtcattgaccaatccctattctatgagttaacccaattatccagtgaatgtgtaccatttgaaggtacactgattgatgattggaaatatgaattttctgtgcatgatgctcgccggttggtttgcaccaaccaagcggatatgaccggaaggcttcttgctggttcattggcttttgagagccacatccttcattaccttattgtttgtatcttgcttccaagatctttaaaccttgcacaggtttctgaagaagatcttattgttatgtgggcttttcataaaggccgacaaattgattgggcacacttactccgatatcgcatgcataaggcattgtga

SEQ ID NO: 59683 - DNA, 282 bp, Glycine max
  Peptide Sequence Number=SeqID_151368
atgaatgttttgagtggtgcaaccttcttttataaaatcactcgtgcacctaacatcttcatggtgtgtgtacatagggacccattaggtgttgaggaaaaaagcctagagtttcaagaaccttgggatttgaggtcaaatccttttcaaggggagggaatgatgcaatcctaccccgcaagggcattggatagaagactccaagaagattgggccaaagatgcaagagaaggccctagggttctcatgagccttagggtagatttcaggcccatgggttaa

SEQ ID NO: 59684 - DNA, 255 bp, Glycine max
  Peptide Sequence Number=SeqID_151369
atggagttgccaactgtcgcaacctacccttcgacgggagggcgatgtggggctcacgggtgcgtcttccaagaaaggaaaatgcgtggaatcgctaccaacgtttattcgaagaaaacatcagaaaaaccggaaaaggtgtggtctacgaactttaatcgtgaaaggttcgggagttgtttttacacacggggaagggtgtttccctcgctcctacgtattctcaattgcgatgaggaaatcagacctacgtag

SEQ ID NO: 59685 - DNA, 444 bp, Glycine max
  Peptide Sequence Number=SeqID_151370
atgtcataccgactgagtttgctcgacaaatcaccgattgcagcaggtgagagcgccacgcaggccctgcatcgcacactgcagctggctcagcgcgcggaagcctggggttatcaccgcttctggctggcggagcaccacaacagcgaccagctggcgagtccttcgccggaattgttgattgcctggatcattggccagacccgacatatccgcgtgggttccggcggcgtgatgttgcaacactacagcccttataaagtggcggaaaactttaacctgctggctgcgctggcacctggacgtatcgacctgggcgtggggaaagcgcccggcggactgccgctttccacccgcgcgctgcaactgggggtgcatcagcaggagaaaggcagctttgccgaacagctggcgctgctggatagctggctcagtgtgccgccg

SEQ ID NO: 59686 - DNA, 306 bp, Glycine max
  Peptide Sequence Number=SeqID_151371
gaagctgcacagtcaggaaacgttgatggcgtcatcgaccctccatccccggtcagacgccacgtgaagtggaagatggcccgcacgaagaagacaggggagatgacgactgaggtcgtaaaggaaatcgctgagaagattgattcgtttgaggagcaggccacacagggatcgttcgtcccccatggacgtcaggatgtctggccgctgcaattggacgtccagagcaccctagacgtgtctgtgctgctggagccgatcagggaccagctagaggagtccatcatagagaaagtgacgaggtag

SEQ ID NO: 59687 - DNA, 141 bp, Glycine max
  Peptide Sequence Number=SeqID_151372
atggctggcagcaagcagcagatgcaccacagccacctccaaagcccctcagctcatctacaaaagttggagcgttgcctacgacccgtggttgaccagcaggcaaccaagtccaaagccaaaggtagcaagataccttag

SEQ ID NO: 59688 - DNA, 69 bp, Glycine max
  Peptide Sequence Number=SeqID_151373
gtccgtgacaaacaagccataaggcgtccaggtcaagacgttaaagaagcgctactaggaggcaaccta

SEQ ID NO: 59689 - DNA, 420 bp, Glycine max
  Peptide Sequence Number=SeqID_151374
atgcaatgcatgaatatgttacgagagcctggaaaatcatctcttcttacttgctattcgagggcgcagtgccccatgtgtgcagttaagaaggtgatatggacctttcggcttcccgtgtcaaaagacgagatcaacatacaatgcatgcgtgatgacaagatcagatgcgcaaaagcgcaacaaggggaggtatcatcccattcgaaaaaacatattgtggctgtagggactaccagcaacaatatgttatcaaagagaaaaactctagatgagggttcactatcatcaagcaagtcagagacccagcatgaccacagattcacctccactccttatgttcccatggacccaggtatagggccccttttcaactcaccgtgtgtacaaatagtgttggtgtttgtgttcatcaaatga

SEQ ID NO: 59690 - DNA, 324 bp, Glycine max
  Peptide Sequence Number=SeqID_151375
atgcatcctccaccatccagtctaggagccccacgaatttattgccttacagctgttcgtctatcctccaccctcaaatcttacccggagccccatgaattgattatcattcatgcatcctccaccatcgagtctcgagccctacgaattgtattacctagcgctgttcgtctatcctcaaccctcaaatcttattcggagccccatgaagtgattgtcattcatgcatcctccaccattgagtctggaaccccacgaattgattgcctagcgttgttcatctatcctccaccctcaaatataatccggtgccccacgaattga

SEQ ID NO: 59691 - DNA, 1695 bp, Glycine max
  Peptide Sequence Number=SeqID_151376
atggggagtgatgacagtctaaagacatgggtatcagataagttgatgtctatactgggatattctcagcccacagttgtccagttcatgattggactatccaagcaagctacttctccagctcatttggtgggcaaactagtggagtttgggatctcgtcaatggacactcatgcatttgcggaagaaatttactcaagagttcctcatagatcatctggaagcagaagacttacttactcaattttgaaggctgatgacgatagtgacgatgactatgtagataaatcttcagtaactactgcatcatctagaagaaaggaaaaggagagacaagttaagagaagaacttcccctgatgaagttagtgattctgagtccgaagaagaaagattgaaagatcaaagagagaaggaggaattagagcagcatatgcgagaaagagatgcagcagggacacggaaggtacttgtcaatgttcaaattgatttggatattgctcgtttccggcctgatctcaagctgctgatatcaagtgctacacttgatgcagagaaattcactattgtcacatcacttcaaatccatgtcactcaacctcctggagatatattggtattccttactggtcaagaagaaattgaaacggcagaagaaatcttgaagcatcgaactagaggcttggggactaaaatttctgagttaataatatgccctatatatgccaaccttccaactgaactacaagctaaaatatttgaacccactcccgaaggggcacgaaaggttgtccttgctactaatattgcagaaacatcattgacaattgatgggatcaagtatgttattgatccaggattctgtaagatgaaaagttataatccaagaacaggaatggagtctttgctagtaactcccatctcaaaagcttcagcaaatcaaagagctggccgttctggaagaatgggtcctggaaagtgcttccgactgtatactgcatacaatgatttggatgataacactaggactaaccttgcaaatgtagttttgactttaaaaagtcttggtattcatgacttattgaactttgattttatggatcatccacctgctgaggccttattgaaagctttggagcttctatttgcattaagtgcgttaaataagcttggtgaattaactaagtgttcagatgatatcatttctattgcagctatgctttcggttggaaactcaatattttaccgtccaaaagataaacaagtacatgcagacaatgcaaggctgaattttcacactggaaatgtgggagaccatatggcgctgctaaaggtaaggagtatgaaacgggctagggatattcgtgatcaactggcaggtcttttagagagggttgagattgaactaacttcagatgctaatgatttagatgccatcaagaaatccattacatctaggtttttcccacactctgcacggctgcaaaagaatggatcatatcgaactgttaaacattcacagactgttcacatacatcctagtttggggctggcacagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 59692 - DNA, 489 bp, Glycine max
  Peptide Sequence Number=SeqID_151377
atgtcaaacctccgctttctggagcagaggggcaaaaacgacgacgttttccttacaggaatcggaggctgccacgtcagtgtcatccgaaaccatgctaacgaaatcttcgagagagagttttccgtacttgtgttcgtccttgtggagatacttaacgacgttagtgaacaacgcgacctggcagggaaggaccaaaccgccgttacctcggagtccgaactcttcttcggtttgtttgaggaggccatcgaagagcgcgaggttaaggaagcgcgcagggatggcgaagcgagtgcgttcggtgcccacatagacgaagatgaagccggggggagggcggcgcgcggcggagggttcgtcgtcggagcggcggcggaggctgatgtgcttccagcgcgtcataagcttgaaggagaagcgagtgctttggtttctgagttgttggaaagagttttgaaaacgaagaaagaaaaagagataaaatag

SEQ ID NO: 59693 - DNA, 87 bp, Glycine max
  Peptide Sequence Number=SeqID_151378
atggaggaagtgaatgatatgggaatcaaatttctctttggatttaggcttgattgcaatgattggcgaatcgaggattatacgtaa

SEQ ID NO: 59694 - DNA, 1230 bp, Glycine max
  Peptide Sequence Number=SeqID_151379
atgggtaaagttgcaatattttggccgattcagcgtttcagatggcttttggggttgcaagctgagaaatttgagatgagcagccaaaagggtcgtcatgaacatgaagaagagatgggtaccggtaaagtggttgtggttgcagtaaaagcttctagagatatttcaaggaatgctttggtgtgggctttgactcatgttgttcagccaggggattgcattaagctgttggttctcattccgcctctttcctcaagcaagagggtatggggactttcaagatttactactgattgtgcctcgagtcattggagatccagtttaggaactatttcagatcagaaagaagttattacagattcctgttctcaattagtacttcaactccatgatttttatgatcccgagaagataaaaatcagagtgaagattctttctggttctttatccggagctgttgctgctgaagccaagagagtccagtcaagctgggttatattggacaacaattatctattcttccacaatttcagaaaattgaagcttgaaaagaaagactgcatggagcagctgcattgcaatattgtaattatgaagcggtctaggccaaagattctgcgcttgaatttgaacagttcgtctaagatggaactaaacatggcttgtccattggcactttcaaacttcaaagacaactctgaacatgcagatataattagaggtccagctgttactcctgctagtagtcctgagcaagggtcaccactactgactgcaactgatattggaacatcatccatatcgagctcagaccctgcaacttcaccatttttccactccgacaatcatgaaagacaaaggagaggttttacctttgttcacgagggactgacaaacctggaggatattgagtctgactctgagagtgaaaagctaagtatgtcatccaagagctcatattttcagccatggattgcaaatgtaatttgcatggatggtgattactcaaaacatgagaacatgcaaagatctagtgacaagactttagctactgcctatgaaactttgcttcagaaattctcaaagttggatcaggatcctatcctagggatgctcaattgtaaacttgatgtgaacttaagcaaaagtgttagagaagcaatttcactatctaaaacttcagctcctggacctcccccattgtgctccatttgtcagcacaaggctcct

SEQ ID NO: 59695 - DNA, 1035 bp, Glycine max
  Peptide Sequence Number=SeqID_151380
atggggaaccatgagcatcatattcgaactggctgtggtattgtgtctgtcatagtctatggcgatcccgacaaaccagctctgatcacttatccagatttggctctaaattatatgtcatgttttcaaggactatttttctgtccagaagcagcttctttactgcttcacaacttttgcatatatcatatcagtcctcctggacatgaggtttttttccctctgaaacttccacaagagttcttgcagttgggagcagctgcaatttgtgccgaggatcctgttccttctgctgaagacttagcagatcaaataattgaggtcctcaactattttgggcttggtgcagtgatgtgtatgggagtgacagccggtgcttatatccttactctttttgctataaaatatagggagcgtgttcttggtttaatacttgtatctcccttatgcaaagcaccttcttggacggaatggttttataacaaggtgatggcaaatttgatatatttctacggtatgtgtggcttgctgaaagagtgtttgcttcagcgatacttcagcaaggaagttcgtggaaacgttgaagttgcagaatcagagatagttcaagcttgcagaaaactgctggatgagagaaaaagaacaaatgtcttgcggtttcttgaagcaattaatcagaggcctgacatttcagatggattgaaaagattaaaatgtcgtacacttatttttgttggggacagttctcctttccattcagaggctctatacatgacttcaaaacttgataggagatatagtgccttggttgaggtccaggcttgtggatcaatggttacagaggaacagccgcatgcaatgctgatacctatggagtactttttcatggggtatgggttgtatagaccaacccagttcagcgacagcccaagaagcccactaagcccatcttgcatctctccagagctcctttctccagaaagcatgggattgaagctaaagcctataaagacccgtgtttcactacaagtttga

SEQ ID NO: 59696 - DNA, 114 bp, Glycine max
  Peptide Sequence Number=SeqID_151381
atggcaggggcaccatggccagctaagaagacctccactcatgttggaaatggattacaaatcttaagatgcaagttctcagagccaattgaaagtgcaatcatgagatattga

SEQ ID NO: 59697 - DNA, 1542 bp, Glycine max
  Peptide Sequence Number=SeqID_151382
atgacaaatttaagtgctggtgggtttgtatctggagctgtgacaaaggggaatgaaattggaattttagcatttgaggttgcaaacactattgtcaagggttttagtcttatggaatctctttcaacaaaaaatattaagcatttaaaagaagaggtgcttcaattagaggctgtgcaagatttagtatcaaaggatacggatgaacttctaaagattgttggtgcagacaaaagggatgagttgaaagtcttttctgatgaggtaattcgttttggaaatcgttcaaaggatcctcagtggcacaacttggaccgatactttgagaaagttagtagagaacttaattctcaaagacaatcaaaggaggaggcagaattactaatgcaacaattgatgactatggttcagtttacagctgaattataccatgagttgcatgctttggatagatttgcacaagattatcagcataagcgtgaagaggatgataattcaggtgcagctcaaagtggtgatggcctttcaatcttgagggcagaacttaaaagtcaaaagaagcaagttaaacatttgaaaaaaaagtcactctggtccagaagtttggaggagattatggagaagcttgtagagatagtccattttttgcatttggagataaacaatgcctttggcactgcagatgaccataaaccattaattcgaaccatcagcaatcgccaaaaattgggtcctgcaggccttgctttacattatgctaatatagtgctccaaattgatactcttgttgccagatccagttctatgcctgcaaatacaagggatgcactgtatcagagcttgcctcctaatataaaattagccttgcgttccaaattaccaagctttcatgttgtaaaagaggtacagtcttatctgctgctcaccatatcagatattaaacaagagatggagaaaacattgcattggctggttccgattgctacaaacacggccaaagcacatcatggttttggttgggtaggggagtgggcaagcactggttctgagctgaataagaagaccatgaaggctgatgtgttgcggattgaaacgcttcaccatgccgataaagataaagtagaaaattatattcttgaacttctcctatggcttcaccgcttggccgtcaaaagtaaagctggcatcgataccggagaaacaaggtctaccttaaagtcccaagttggcactgcccttcaaactacaaatcaacaatcaacaaaagccttatcgccattgttaacaactgacgagcagaaaatgctgcaagatgttagtaataaaattcgtataagaaggatcagtaaaagcttagactttgacagtgtgatggcagataatgacagacttactaagagtagcagttattcttattcatcaacaagtagaagcaaggaattatcttttaatagaattttgtctaagcttcctgttattgattttggtattgacaaaaagagagcattggatgtgattgacagattagacgtggtcagataa

SEQ ID NO: 59698 - DNA, 285 bp, Glycine max
  Peptide Sequence Number=SeqID_151383
atggagcttcatgtcaaaaacagggagaagctcctcacttcccttcgtcaacacctgtccgagtcttctcgtcctccttcaagatggcgaagagcaaacgcgttacgacaccgatcacttgaagctcttcatgagagtttcttcgcttacttttttggagtcattgagcctggattctatgcagctattgacgttgcaactgggaattctatcctatttgctcccaggttaccttctgagtatgctgtttggttgggggtgattaagccactctcttactttaag

SEQ ID NO: 59699 - DNA, 723 bp, Glycine max
  Peptide Sequence Number=SeqID_151384
atggacaatatatcaaagccagaggtaatattgcagagtgaggggttactgaaggatgcaagaattatatgtcagtatatattggagaccggcgtttacccgcgagaagcggagatcctcaaagagctaagaaatgcaactgcagagcatcctctgggtttcatgggtgctgcacctgatgcggggcagctaatggccatgctcttgaagcttttaaatgctaaaaagacaattgaagtgggagtttttactggatactctcttctcctcactgcactcaccattcctaatgatggaaagattatagctatggatccagacagaaaagcttatgagataggactgccatttattaaaaaggctggtgtggaacacaagattgacttcatagagtgtccagctttaccggtccttgataaactcttagaagaacctgcaaatgaagggagttttgactttgccttcattgatgctgacaaaaacaattactggaattaccacgagaggcttataaaattggtgaagattggtggtttagtagcgtacgataacacgctgtggggaggaactgttgccttgcctgaaaaggcagtttcggaaccgaaacgagaatggagacgattatcacttgcttttaacaaagccatttccaaggattgtcgtgttcaaattgcttttctttcaataggtgacggagtcattatctgcatgcgtgttcgctga

SEQ ID NO: 59700 - DNA, 243 bp, Glycine max
  Peptide Sequence Number=SeqID_151385
atgaaagtagacataactgattttcgagatctcataaatggctacctatggagagtcttgaccggttatcatcgcgtgaagtattgtagtgtaagaaccgtcgagaagttgacaatcaagggagttgcaaatggtatcaaagcaaatctctcttctagtacggtggggttcgaggacgagccagacagaagttggtgggcatgtaacactccagacaaatcacactggaaagagtgggattaa

SEQ ID NO: 59701 - DNA, 486 bp, Glycine max
  Peptide Sequence Number=SeqID_151386
atggctgaactatctcaggcctcatatcaagcatggagacttcactcgtcaggaagaccaacttatctgcaccctttatgccaccatcggaaccatgcacgttcattctttccttctatatccttaaatttaactctctcaaaatcagcaaacaccaatgccattgccagtactgttttctcaacttccacttctcagcctcaacttgaagactacagtgtctttgatgatcacgagaactcagctgagtatcttgtcttgggtttggagcaaacaccattgcctttaggatcagatgtttttggtcttggaagcagttgtagtgtacgactatccaatgaagcagtttcagcttccttggtaaaaaaggaaaatgagaatgagacccaatggtttgctgaagatgaatcatttttgcttgattttgtgtatgaagataatgggtttgtttctcaagaaaatagcagcgaagttccacctctctaa

SEQ ID NO: 59702 - DNA, 1422 bp, Glycine max
  Peptide Sequence Number=SeqID_151387
atgggttcgtcgccgaattcaaagcccaagatcattagaggctccgcaggctatgtgttggaggatgttccacatatggccgattacatccctgatattccaacatattctaatcctttgcaaaacaatcctgcttactcagttgtcaagcagtatttcgtgcacgtcgatgacagtgttccgcagaagataattgctaataaagatagtccaagaggggtacattttcggcgtgcaggacctcgtcaaagggtgtatttcgaatcagatgatgttcaggctgcaattgtgacatgtggtggtctatgccctggcctcaacaccgtcattagggaactagtatgtgcactatatcacatgtatggcgtcaagaaaatcttgggaatcaatggaggatacaagggtttttatgctcacaatacaatcactctaactcctaaaagcgtgaatgacatacataagcgtgggggaactatccttggttcatcacgaggtggacatgataccactaagatagttgacagtattcaagatcggggaattaatcaggtttttataattggaggagatggaactcagaggggtgcagataggatttttgaggaaattagaaggcgtcgtctcaaagttgcagttgtaggaatccccaaaaccatagataatgacatcccggttattgataagtccttcggctttgacacagctgttgaggaggctcaacgtgctataaatgcagcacatgttgaggctgaaagtggtgaaaatggcataggtgttgttaaattgatgggccggtacagtgggtttattgcaatgtatgctactctggccagtagggatgtggactgttgcttaattccagagtcaccctttcaccttgaaggtccaggtggactttttgagtttacagagaaaagactaaaggaaaacggccacatggttattgtgattgctgaaggggcaggacaggaacttgtttctgagagcatccaatccttgaacaagcaggatgcttctggaaacaaacttcttcaagatgttgggctatggatatcccaaaagataaaggattattttaacaaacagaagagaatgaccataaatctcaaatatatagatccaacgtatatgatccgagcagttccaagcaatgcttctgacaacgtgtactgcacacttcttgctcaaagtgctgttcatggagccatggcaggttacactggatttacaagtggacttgtcaatggaagacaaacgtacatacccttttatagaatcactgagggacagaataaagtgataattactgatagaatgtgggctaggcttctgtcttcaacaaatcagcccagctttaccattgctaagactgtctctgaagaaaagagggaagaagaagcaaacggtcatatctctgaataa

SEQ ID NO: 59703 - DNA, 2220 bp, Glycine max
  Peptide Sequence Number=SeqID_151388
atgcaagagacccttctctctctccctctctcccaccacgaagacatccacattctccccaagaagaagaaaacgcaacagcttcatcacaacaaagcgggaagcgacaacaccaccaacaccaacagccaccccactcgcgtgtcgcggcgggtgagtccggcggtttctccgtcctccggcggcggcgagaagtctctcccgaacggcgacatctacagcggcgccctgtcggggaacgcgccgcacggcaccgggaagtacctctggtccgatgggtgcatgtacgagggcgagtggcgaaagggaaaggcctgcggcaaaggaagattctcatggccctccggcgccacctacgagggcgaattcaagtcgggtcgaatagacgggttcggatccttcatcggcgtcgacggcgacatgtacagaggctcatgggtcgctgacagaaagcacggcttcggcgagaaaagatacggcaacggtgacgtgtacgaaggttggtggaggtgcaacttgcaagagggtgaagggaggtacacgtggcgcaacgggaacgagtacgttggggagtggaggggtggtgttatttcggggaaaggggttttggtttgggcgaatgggaaccgttacgaagggtattgggagaatggtgttcctgtcgggaagggtgttttcacgtggtgtgatgggagcacgtgcgccgggaactggaggaaggagtttatggaagaggcacgtgaggagaagatgatgaagaggtcttcggtggatgatgggtttaagagtgtgagttttcccaggatttgtatttgggagctcgatggtgaagctggggacataacttgtgacattgttcacaatgctgaggcttctttgttttacagggatggtactactactactactgcttgtgagtctgagaacagtggagatgataataataagagtccttgttggtctcttgatggtactgctggtggtgatgttaagaagcctggtcagactgtgtcaagagggcacaagaattatgatcttatccttaatcttcaactgggtattagatacactgttgccaagcatgcttctattgtgagagagcttagaccgggggattttgatcctaaggagaagttctggacgaggtttccgccggaagggtctaagtttacaccccagcaccattcagtggacttcaggtggaaagactactgtcccatggtgttcagacatctaagggaattatttgccatagatcctgcggattacatgcttgctatttgtggaagtgacacacttagggagatgtcttccccgggcaaaagtggaagcatcttttatctcactcaagacgaccgcttcataattaagactgtcaagaagtctgaagtcaaggtgctcataaggatgcttccaagttactaccaacatgtttgtcaatacaagaactccttggtgacggcattcctgggcgtgcattgtgtcaaacctgttggaggtcaaaagacccggtttattgtaatgggcaatgtgttttgctcggagtatcggatccacaagaggtttgacctcaaaggctcttctcatggtcgatcaacagataagccaagggaacagattgatgagactaccactctcaaagaccttgatcttaactttgtctttcgccttgaacagtcttggtttcaagagcttatatggcaacttggtagagattgtgagttcctggaagcagagggaatcatggattacagtcttctaattggcctgcattttcgtgatgatagctcagttgatgaaatgaaaagttcacctcgcagttctcattcaggcaagagagacatgtttgataatgagatgctcacatgccggggacctctaatccggctgggaatgaacatgcctgccacagctgagagagtgtgcaaggctggattggatcaccaaacaactagtggaagtagtaatagccagatctctgatgtaatcctctactttggaatcattgacattctccaagactatgatattagcaaaaagatagaacatgcatacaagtcactacaagtggactccacttctatctcagctgttgatcccaagctatactccaaaagtgcttggagaccaaaggagtatagaatgcgaaccggaaccaactctggcttgctaaggtggcattccatgcaccaggaaatgctacaaacatgggtgatctaa

SEQ ID NO: 59704 - DNA, 1347 bp, Glycine max
  Peptide Sequence Number=SeqID_151389
atgcgtagatgcttctggtctgggagggatgcaccttccgttggttgggtatactccgggtctcataattttagtgctgctgcctgggggcgacaaatttcaaatccatttaggacaaaggctgatagacctaaaaaagaggatccttctgtgaattatgggcttcatatttgcaattatgagcttgggattatatttacttttcctcctacagaaaataatggttgtcttgaagtaaagagcacaaaattagatgatataattcttccgtttgttgtgcctgctcctaaatatagatctagtgatcggccagctacaaagcaggctatgagggaggttatggttgaacttgctgagcgagagaaggagaaacatacagaagaagaaatgatggatgagcttgatgatgaagaggaatatgttgagcttccagaagaactggaagcaaccaattatgttgaacaggagaatgaagatgagaaagcatatgctgatatactctggagtcaggatttgaaagtggtggctacacatcatgcaatagctgcagcagtgaactgtgcaataaccccaagaagatacaagcgtgtaacatccttttctgttaagatcttgatactttggaaatgtgcaattcgacaagaggctgttggtccggctgttaaatggattccagggaaaaacgtattggaatctcttccaaaaactgagcaattaactcaaggtgttgctgatgctaacctagactcaggacaagatgatggtgaatgggtgatggagttactcggaacgacgggggagttggaagggcttctggaagagtcccaaaatgttaacttcaagacacctgctggcagaggaaataattggcaatctatatctggctccaagcagtccaagagtgttgacgatagcctggtgaagggtgaaattaccgacgagtcccctgtgaagaatgatagtgttgatgatgaaggggaggaggaggaggaggaggaggaggaggggtttgatgctatggaagataccgatgatgatctaatgagtgatgattatgattcggatactagtcaaaagagccacgagactcgtggtcctggtgctattgattggtatagaggactgcagcctctgattactcatggcaaaacaaaggggtcaaaaaaggtgaagatccatagggagtttgctgcgcttttggaagtggaactgcgcagaagaggtacttcagtaattccacctggggaagtatttggtaagtggaaaggtttaaaagatgagaaagatcatgaaatagtttggcctccgatggttgtcattcagaatacaaggcttgaacaggattaa

SEQ ID NO: 59705 - DNA, 2811 bp, Glycine max
  Peptide Sequence Number=SeqID_151390
atgggaggcacttgtgcagatcttcaccaccatgaatcagatatagaactcactgatgctgaaaggattggcactgatgttggacctgacagtggcaccaaatcccagggtgaagaagctgaaggacaacactacgttgaggtgaccatggacattcatcgtgactctgtggccttacacagtgttaaaactgttgcagctgatgatgttgacatggtggaagaagaagaagaggaaggtgataaattgggtttgatgggaaagaagaggcttgagaaaaaaacatcctttggtgcctctgtggttcagagtgctgccaatcgcatgaagcagctgaagcgtttggcatcattttcaaaaccagcgcccaaacactttgaaaggacaaagtctgcagtgggtcatgctctcacggggctcaagtttatcagcaagaccgatggtggcgcaggatgggttgaggtggagaagcgctttcacaagcttactgctaccactgatggctatcttcctcgtgctctctttgcccaatgcttagggttgaacaaagagtctgaggcttatgcagagaagctttttgatactcttgctaggcagagaggtattcaggggggttccattaacaagatccagatgaaggaattctgggatcatatttctgaccagagctttgatactaggctcaaaacattctttgacatggttgataaagatgcagatggcagaatcaccgaggaagaaattaaagagattatctgccttagcgccactgccaacaaactgtcaaacatccagaagcaagcagaggaatatgcggctttgattatggaagaattggaccctgatgacacaggatacatcatgatagacaacctggagacgctcttgttgcatggaccagaggaaactacaagaggagaaagtaagtacctgagccaaatgctaagtcaaaaacttaagcctacatttgcggacagtgcagttatgaggtggtgtagagatgccaagtacttcttgctggacaactggcaaagatcttgggtacttgcactttggattggtgtgatgtttggcctatttgcctataaatttgtgcaatataggagaaaagctgcctatgaggtgatgggccattgtgtatgcatggcaaaaggtgcagccgagacacttaaattgaacatggctcttatcttgttacctgtttgccgcaacaccatcacctggctcaggaataagaccaagctaggtgttgtagttcctttggatgacaacatcaacttccacaaggtaatagctgtggcaatagcagttgctgttgctgtacattccatctatcatcttacttgtgattttcctcgccttcttcatgcaagcgatgaaaagtacaagctcatgcaaccttttttcggagacagaccatcagattattggtattttgtcaaatcatgggaaggagtaacagggattataatagttgtgctaatggcaatagcctttacgctggctaatcctaggttcaggagaggccgggccaaactacccaaacctttcaacaaattcacgggtttcaatgccttttggtattcccatcacctcttcgtcattgtctatgccctgttggttgtacatggaatcaaactttacttgactaaggaatggtacaagaaaacgacctggatgtatctggctattcccatcaccatttatgcattggaaagactggttagagcattcagatcgagcattaagtccgtcaaaatattgaaggtgactctttatcctggaaacgtgttatcacttaaaatgtcaaagccgcaggggtttagctacaaaagtggacaatacatgtttgtgaattgtgctgctgtgtctccatttgaatggcatccattttccataacttccgcccctgatgatgattaccttagcgttcacataaaaatacttggtgactggactcgaagtctgaaagccaaattcacacaggcgtgccagcaacccctaaatggacagagtggacttctaagagctgaatgcttgaaaggagataacagcccaagttcctttcctaaggttctggtggatggtccgtatggggcgccagcacaagactacagggagtatgaggtggtgttgctggtggggcttggaattggggctacaccaatgataagtatactaaaggacatggtgaataattttaaggcgaatgatgaggaggagggagggcaagagagggtgagtgacttcaagacaaggagggcatacttctactgggtgactagagagcagggttcatttgactggttcaaaggggtaatgaacgaagtggcagaagaggaccgaaggaaagtgattgaactccacagctactgcaccagcgtctacgaagagggtgatgctcgctctgctcttattgctatgttgcagtccctaaaccatgcaaagaatggagtggacattgtctctgggacacgagtcatgtctcactttgcaaaacccaattggcgcagtgtctacaagcgcattgcgcttaatcatccagatgcccgagttggggtattttactgtgggccatcagccctcacccatgagcttcgtcagctagcattggatttctctcacaacacatccaccaagagaaataaccactccttggaaacaccttgggagaaactagaaaatttgctaacttatgtcaccgttctatctagaattccagaatccagacagcgaaagaaacacatgatggtatatgcggtccaagacaaaattaagccactttcggttaggcaagtaggcaacagctag

SEQ ID NO: 59706 - DNA, 1515 bp, Glycine max
  Peptide Sequence Number=SeqID_151391
atgtatcgctgctctggaggccatgtggagtcttctactaacattaatcccttgaaaaattgtgtagtgggaagaagtactttaggatggtttgaaactcaacccttggtttctgagcaattactcaacaggcgcttgttgtcagtggaagctttagtcactcccacagttcaagatttttctgatacacctcttattggtgatgataagattggagtgttattgttgaacctcggaggtccagagactttagaagatgtgcagccttttttgtttaacctttttgctgacccagatattatacgactgccaaggttatttagctttcttcaaaagccattggcccaatttgtatctgttttaagagcacctaagagcaaagaaggctatgcttcaattggtggtggatctcctcttagacgtataactgatgcacaggcacggcactttccaataacttattttccatacatcactacagctgaagaattgaggaaatctctttggtcaaagaatgtcccagccaaagtgtatgttggcatgcgttactggcatccattcactgaagaggctattgaacagattaaaagggatggaattacaaagcttgttgtgcttccactttatccacaattttcaatttcaaccagtggttcaagtcttcgtctcttggagagtatattcagagatgatgagtacctagtcaacatgcagcacacagtaattccttcatggtaccagcgtgaaggatacattaaggccatgacaaatttaattgaaaaggagctaaaaggttttgactgccctgaggaggtcatgatattctttagtgcacatggggtgcctcttgcttatgtagaagaggctggtgatccatacaaggcagagatggaggaatgtgttgatttgatcatggaagagcttgaaaagagaaagataactaatgcatacacccttgcttatcagagtagagttggacctgtggaatggttaaaaccctatacagatgagacaataattgaacttgggaaaaagggagtaaaaagcctgctggctgtaccaattagctttgtcagcgagcatattgaaactctcgaagaaattgatgttgagtacaaagaattggctctaaactctggtatagaaaaatggggtcgtgttcctgcgctaggaactgaaaccactttcatttcagatttggcagatgctgtaattgagagtctcccttatgttggtgcaatggcagtttcaaaccttgaagctcgacagaaagtttttgctctttggaagtctttggttccactgggcagcgtagaagagttattgacagcatatgactcgcaacgtagggagttgccaccaccagtaattgtgtgggaatggggatggaccaaaagtgctgaaacttggaatggaagagcagctatgcttgctgtgcttcttctgttgtttttagaagtcaccactggtgaagggtttctgcaccagtggggaatattgcccttgtttaggtga

SEQ ID NO: 59707 - DNA, 246 bp, Glycine max
  Peptide Sequence Number=SeqID_151392
atggagttgggcggaggctttgaggacaaaggggaaggtgtggaagtcaggggggagggagaggcggcggagggtggagaagaggtggagggcggggagaggggagaggaggagggtgtggattctgatgagggtgttgaaggagaatgtgctagggtttgggatggaatggaagagggagagagcatagaaggatttctagtcatgcccgataaccactccggcacgtccactttctatccttaa

SEQ ID NO: 59708 - DNA, 942 bp, Glycine max
  Peptide Sequence Number=SeqID_151393
atggccatggcttcaaccgctacctcgatcagttctttgaatactgccactggttttccattaccacggtcaagctttttcactcccctaagtcgggtgcacggtgaacccttaaggttactcacatcacacccttatcttctctcattctactttttcagcaacacaaaagttgcaccatatccacatgcagctaataccaacacacatgaaaactacaatattgcgccacatctatatgagaaccagagacagaaaccttactatgacaatctatgtcgccctgtttcggatttgcttccattcattattgtcaatgggttcagagattttgaaagagctatttcatcctcaaatgcctacgatgaccggttgagggaattggtagaggcagggaaggacatagaaagtgcttactgggaattggttgtcaaggacatacaggatgcttgcaaactcttggagccaatttacaatgaaaaagatggggaagatggaaatgtatctgttatggtttccccaaagctagcaaatgataccaaggggacaattgaggcagcaaagaaacttcataaaatggttggaagtcctagtgtttacattaaaattcctgccaccgatgaattcatctcttccatgaaggaggtcatttgtctggggataagtgtatatgccactctcatattctgcctccctaaatatgaagcagtgattgatgcttacttggatggccttgaggcttgtagcatgactgatctctacaaggtttctagtgcagcagcattctacatcagtagagtggatgctacacttgacaagaaacttgaccaaattggtaccactgaggctcttgatctcaaaggaaagggtgccgttgctcaagcagtcttagcttaccaactttaccagaaaaagttctctggtccaagatgggaacgctag

SEQ ID NO: 59709 - DNA, 147 bp, Glycine max
  Peptide Sequence Number=SeqID_151394
atgggcaaacttcctgatggtaacaataaatgcacaatgacccttgctgcaacgcaagccagcacgggcgtcagggctgtggagtgtggtggaagtttagagtccaattgcaaggttcttgtcatgtccacacttcaagctgaatga

SEQ ID NO: 59710 - DNA, 480 bp, Glycine max
  Peptide Sequence Number=SeqID_151395
atggtgagaaaaactgagctcctgtacaagatagatattttccaacttcgaataacatattctgagaaaatatttattccccggacaaagaaaaaccatcctgtcttttcacgggcacaactggtgcaggaaagcatctgtggcaatgataagaaagcagtgtaccagcatattgtcaagtcggattttgacatcaatgccatcggttggcaagcatcgtctggtatgtcttcttattccagaagtctaaactccagcaaaaattttggtgttggaaaaccagtcgggcaccactacatacattattgtattactaaagggaagaccgcagctgcaaaagtgcttatcatgagaatgccaaacatttacaggggagacaatacatatgtcacagataaagaaggcaaaattcctgttaagcttgcatcagaatctggctgtgttgataatgaaattatcgctctcttgacaagcagatga

SEQ ID NO: 59711 - DNA, 267 bp, Glycine max
  Peptide Sequence Number=SeqID_151396
atgtggcgtagggtgcacagccaacactttttcaaaagagataattactgcaaaggcaagagtactgaagtacttgttgatagtaagaagaggaagacgtgtaataatattattggagaaggtgggtcggggttgaattatgattctgatgagatcagtgatgacaataataagatggaagagattagtgcaaggaacggtggaaacagccccaatgccaatagcaccatcactggcggtgtgcatcaaaagggcaagaagacgtga

SEQ ID NO: 59712 - DNA, 225 bp, Glycine max
  Peptide Sequence Number=SeqID_151397
atggcgaaagccagagatagaaatagaagaatatgttccaaaaagtcaaactgtgggagggaccaagctgctcatatcgtggcagggatgaaaatggcagaatcgtctgcaggcactaccaaagtttgcatgttgataaaccaacttcaacttgcattgattctgttcgttttgacattccatctctctcctaagttctcatccttggaaccaaccccgtgctaa

SEQ ID NO: 59713 - DNA, 1011 bp, Glycine max
  Peptide Sequence Number=SeqID_151398
atgcaaaagcttcatgatccatccattgttcccaaccacactctccgccacttgatcgatcagtggcttcaacttgatccccaattcgaccctgctaaccctgaagcttcaactattgaatccttagcttctctgaaactcaaccttgaatcctatgaaagcagcttagaaaacaagctccaagcacttaggaaaatcagtgtcttatctgatgagtattgctccttcaacaaatcatgcttcctccaattggatttcctaccactgcttttggaactagtttttggaactcaagtgtcaccagaaaatgacatgaacttcatagagcttgcactttgttgcattaaaaaattgctaccacttggtagtttggagcctctaaatatgatcaaagatgggtctaaattagcgacgtttgtgctactatttgaaaagggtactaactccgttaagactagcttgtgccgtgttatagagtcagcatcatcatcatcatctgagacagaagatttatgttctactcttggaaaaactaacgaactagtgcacgagattgttcaagttgttaaccaaaattacgaggtttctggggatgcaattaaagccatgtcagcactatgttcgttgcagtccaacagagagagtttggtgagaggaggagcaatagaagaaattatgagatacattacatcatcagaaagaagaaacatggcaccagtggcaatgagaatagtagagaaacttatggggctgagaagtgctaaagaggcattggtgaatcaccctaatggtgttcaaactttggtgaatatggttttcagggtatctgatcaaaagtgcagtgagagtgctgttgaagtgcttttaactgtttgtggtgaatttgagcgtgcaagagaggaagccattgagagtggagttttgactcggttgctgttgcttctgcagagtcagtgtagtaacacaacaaaatcaaaggcaagaatgctgctcaaattgctaagatcctag

SEQ ID NO: 59714 - DNA, 1521 bp, Glycine max
  Peptide Sequence Number=SeqID_151399
atggttagaacaagaggtggacctcgtgccttaggtagtggtacagacagaggcatgggtcgagatgaggatgatattgatgtttcccggcatcgtaggcctatcgcttctgcccgtaggcaacgggttcaggttgatgtcgctgagaaagttcctcaggtgattgaggatgttcctcctcaggtgactgaggatattcttgatgtgacaaaggatgttccttatgtggatgaggacatttcgactgcagacttagatgctgcgaacgtagatgttgcagacgtagctgctgatggtgccgagggatcacctactgagcatggcgagggattccctagtgggccacatgacacatcattgctgacatcatttgcagaccatgtggcatacaatatctggtgtggtgaggaacgacctgagttgaagctggtctcctatggtaggaaagttgataaatttaggagtccaacgcctgagattgaagaccttgttgccggcaccagattaagtccattgatcgggtgttctatggtcaccggcgatcctggactgatatccgcatttgcggagaggtttgagcctctgggcgtggacgaggtggtcttgctgttaacggagcttctagaggtatccggcaaggaggctcgagctgagaccgcccaacgttggattgtagtggcgcatgcttgccttctccacctggtgggttgtgctctttttgctaataagagtgcaacccattttcatgtggtgcatctgaaggcgtttcgagacccgagtcagtctgcgggctatgcctggggagttgccgcgctggttcacattgctggatatatgagcactttcgcagtgttcatcagtgcgtcattgatgatgcgtacgctgagactaccccacgtgcctagagcgccatacagggcacgtttagatgctctgacgatcacagacgtttcctggttgccctatagtgagcaccaggcagttaggggcttcaagcttatttcatgctaccatgggcagctcagatggggtcatgttgtggtttacgtccgaccagagcgggtgctacgacagttcgggtacatccagaccatccctccaccgccggttactgcttctttgtcgtatgacgagatagacgagaggtggatgcatttcggggaccatttagcacccgcgggtgagatttgtgttgtccccgggcaggtatcaatggactacatggagtggtatttccagatatctcacccgtttgtcacgccaactcacgaaggcgatgagcccagacaaccagctgccctagatgtggaagcatacgtcgagccacatgtcccggaggttccaattgcagctgatctcccagacattcagtggtattttagttgcgaagcaatcgtagaaaggttggagcgtgtgctcaaccttaggatggtgactgcaggaacaaagttacatgagatcatggaagattgcctgtggctcgctaagggaaaggcctctgatggaagtcttagggcgtga

SEQ ID NO: 59715 - DNA, 138 bp, Glycine max
  Peptide Sequence Number=SeqID_151400
atgggtttgtcaggcttaaaggagcactcaaatccggtgacccccaaggcctacactccgaagagtccgtcagggcctctccctcctgattcaggtccaacccctaaaatcattttagcacacagacactgctcgtga

SEQ ID NO: 59716 - DNA, 261 bp, Glycine max
  Peptide Sequence Number=SeqID_151401
atgacatgtgcagaacataaagaaacttgcgtagtgcgcactgtaattgttctcttgttaaatctacagtcaaaacatgttgtggaaaatgtggacatgaacaaagggtggattgagaaagctacagaagaatccaaagaggaggagaatctagatgatggaggagatgaacaaagcttaattccttcttcttcttctgatgaattgaacaaaaaggttgatgatttcattgcgagagtcaataggcaaaaggaggcttga

SEQ ID NO: 59717 - DNA, 2013 bp, Glycine max
  Peptide Sequence Number=SeqID_151402
atgccgcctatacgcatacgccgtctcaggctcgactccgattccgacggagaagaacaagacccactccaaccccaatccgagccacaaacccattttccggttgaaatctccgacgacgaggacttcctcgacgtcctcgacagcctccctccgccctctcccgcctgtcctgtcaccgacttcctccgccgccttggactgtcacccaagagtgactggctcacttcctgcctccgcgaattccagtcctccgttccggcctttgaacacctcgacgtcgccgcaaaagccaaacgctgtttcgagcagtttctctacgccgacatgaatttctgcggaagtggcatactccctcccaacgtagacgccatgcaccttaacgttctccccggtccctatgtattgcaggttgatgaaataattaatatgacttgtcctctacgaggcagatatgaaaaggcaaatcctggaattaaaagatgtttgaagttatcaatgactgatggcattcaaagagtatttggaatggagtataggcccatcgaagctcttgaagtttgtgcctcttctggtttaaaggttactatctctaatgtacatgtgcgtcgtggacttcttatgctggtacctgaaaccattgaaatattggggggattggttgaggagctggatgctgcccgaaatcgcctggttggagaattaaagaagccacctagacctagggggagaagaactagaaacggagtgtttattcctttagcgactagagcaactcttgctgcgtggcctccaggtggagttgatgatcttgcacgcagtggctccacgctgcacagtactgatcctgtacaggaaaacaatcaaggttctggcccgagcatgtctggcactggtaacagtaattcaataccccacatggcgtcaaatgctgatgctatgaacatggatatgtctagagataccaattctgtttcccgtggtagctctatggctaaccagctctcttctgtcatgtcaaaggctgaggagatgcacatagatgcttctaatgtcaccagggaatattctgttgaccatcagtcttctaatatggtttcaaatgtttcagcagcatataatgatactgttcatataacaagagaaagttctgtggctactgagtgccctcccgttgttgaaagtgttgagacatacagggatagaactccagtagccacagatagttctcatccacgaagaacctcttccactgttagggaatattctgttgacaatcggttttctaacatggtttcaaatgtttcagtggtgcataatgacactgttcatataacaagggaaagttctgcaactactgagtgccctcctgttgttgaaaatgttgagacatacagagatagaactccagcagccactgatagttctcatccacgaagagcctcttcctctgttttaaacaccagcgatgtcgagatgggtgatgccagtgaccatccactcatactgtctggagaccaagaggtcccgttcacatacatggctagtttgtcagccaagtgggctaaaatgaaagaggaagctcctgcaattcggggtaaaatcaagtgctttttgactggtgtaaaaggattccggtacaagaagaggacatcatatgagcttcaggcatatgtagacgatggtagccttatttctgaaatcctcattgatcatgatgttgtacagaaaggaattggtttttctcctgaggaggtaactgcggccatttcttctcctgacacgaaaactgtccaacaaatgagggatacaatgcataaatttcaagcatttttagcaaactttgagggaataattcttgtggaattaaataaaaaatcttcccttccacttgccctagagatgagtcaaggctgtcctcaatctgatgcacggttacttctgagaaggctgaagtctcttaaccctccacaagttcaaaaacctacggatccaattgaattatccccgtaa

SEQ ID NO: 59718 - DNA, 90 bp, Glycine max
  Peptide Sequence Number=SeqID_151403
atgacgaacccttgggcaaacatgatggcatattatgcccacacttctcttagaatttcccttggatatgtcacagggtcaaaggagtaa

SEQ ID NO: 59719 - DNA, 2850 bp, Glycine max
  Peptide Sequence Number=SeqID_151404
atggctaaatcagataaagaaagaaagaaaatttggattctgggtatcatccttgacactgtacttgcagtatctgatcacgttgttctttgtcttggtgggaatcctggtcttcacagtattggtcctttttgtctgcttaggtataaggaataccaacttcaagattttagttctttgtttctcaaagagttaaacaattctcgtaactgggaaaggttgaaggtttgtcttgtcaaatctgaagactgcaataacctatccaaaaaatataagactcttaaacaatataaatcagctaaattatcaccaattgaagctggctgctgccgacctccttcccaatgtggatatcctgctgtaaatgcatcctactatgacttgacctttcatccagttagcccaaacaatgactgcaagcggtacaagaattctcgagccatcaaatgctatgattgtgactcttgcaaggctggtgtggcacaatacatgaaaaccgagtggagagttgttgcaatatttaatgttgttttatttgttgtcttgtctccagcaatgtggggttggatggtcggggaagctggtagggcagcgtgcaactggaactgggtttcgctccgaaacatgggtggcggtcctcgcacctttcccggcggcgtgaacaagtggaagtggaagcgcatgcacgagaagctcgccagagacaaacagaacagactcatcgaacaagagaagcagctctaccaagctcgcattcgctcccacatccgctccaccctctcccccgaccaccaatccgccgccgccgccacccaccgccccctctcccctaacgaccacgtcaaagccctcgccgatcgcttcgtcaaagaaggcgccgaagacctctggaacaaccacgacggtcccctaactccgaacccaacaccgaacctcaattttggccccaaacacaccaggggttaccgttctgttcccgaggttgggaacagtcgtgttggggcccacaagtataggttttggcgaaagggtagtgatgattcttcttctagtgagagtgagagtgaagttgaattgagtgtgaagaagaggggtagtagtgcttctttgggggaatatgatgtcaagagagagaggagggttgtgcccaagacatctccagaggttgagtttattaggtatcagcttaataagaggaagttgagccagattgaggaacaacagagtcaagagcaacaacaaagcaatgaaagcattctaagcaacacaaggtttgacgagtgcggtatatcgccactgacggtcaaggcactttcttcagctggttatgttcaaatgacccgcatacaagaggctagcctacctatttgccttgaggggatggatgctttagtcaaagctaaaactggcactggaaaaagtgtagcttttttgcttcctgcaattgaaacagttctgaaagctatgagtagcaatacatctcaacgggtgcctccaatatatgttctaattctctgccctaccagagaacttgctagtcaaattgcagctgtagcaaaggttttgctgaaatatcatgagaccatcggggtgcagactcttgttggaggcatacgatttaaagttgaccaaaaacgccttgaatcagatccatgccaggccaagtgcaaggctttttttggtgggcaagggatacttgttgctacacctggtaggttgctggatcacattgagaataagtctggaatatctctgcgattaatgggcttgcggatgcttgtacttgatgaagctgaccatttactggacctaggattcagaaaggatgtagaaaaaattgttgattgtttgccccgtcagcggcaatctttgctgttttctgcaaccatgccaaaggaggtccgtcgtgtatctcagcttgttttgaaaagggaacacaaatatgttgatacagttggaatgggttgtgtagaaactcctgttaaggcaagttacagcaactattgtcattgccgtactctaaaaattgcaaaagtgaagcaatcttatcttattgctcctcatgagtcacattttcagttggtgcaccaaattctgaaggagcatatcttgcaaacacctgattataaggttattgtattctgtgttactgggatggtgacatcactcatgtataaccttcttcgggaaatgaaaatgaatgttagggagatacattctcgaaaacctcagctctatcgaactcgtatatcagatgagttcagggaatccaaacaattgattcttgtctcatctgatgtttcatcgcggggaatgaattatcctgatgttaccttagtcatacaggtgggaattccttctgaccgtgaacaatacatacaccgtcttggaagaacaggtcgggaagacaaagaaggggaaggtgtactgttgattgctccatgggaagagtattttttagatgaaatcaaggatctacctctacaaaatttccccttaccagatataaatccacatacaaagcttaagattgagaattcaatggcaaagattgataatgacatcaaagaagcagcttatcatgcttggctgggctattataactccatcagggaaattgggagggaaaagaccactatggctgagctggcaaaccgattttctgaatcaattggtttacagaggcctccggctctcttccgaaaaactgcaataaaaatggtcactcccaactcacaagactgcagtgatgacagttcaatattcaaggctctcacttctgatcttaatcattacgctgatgattggccagctctcaagttgctgcaaggccggcagatggatgagtaa

SEQ ID NO: 59720 - DNA, 891 bp, Glycine max
  Peptide Sequence Number=SeqID_151405
atggcagtgaagggcagcaacagaaagcgtagcgtggtacacttaaaatgtaaggcgccaaaatttgcgtggtatttaaatgaaaggcgttggtttttcccagtccacccatttttgtcgtgtgataaacccctctctcttatcgaagaagctgagcgcaaagcagcagaaaatgggttttgtgatgcaatgctcaagctatggcacttgtatttctatttgtatctctcatcgtttcccccaaacctctctatcttttcacgaaaaattgtggaacacgtttgtctcctcaaagcaaagcatgatttatctgaagaggaagagaacgacatgcttggttatttgtacacaacgcagtaccaaatgggcggtgttgttgcaatttcattagggcgcatttcttctccaaatcctgagcgctacacgcatgctctctttatgcggtttcagaagaaggaaaatcttgaaaagttttacgagaatcccttttacatgaaggttctcaaggactatgtaatgacttactgccatggattgactaatgtggattatgaatcggaagtggcagatgaaatgctttctatatttcgcaaaggagaggagtttaaccatggagtggagtttgtgcttctgatatcatttaatgaggatgcactgggtaaccaagcagagcatgcattagcctctctggcatcgatgatgttggaatctccttccttgatagtccaatttacacatggtttgaatttgagtccaagctctaaggaatatactcatggagttgtgattcgatttcgatccgttgaggcatttgagatatttataaacagcaaagagtacaaaaatatttctgcacttgggctgttatatgccatccagatattggtctaa

SEQ ID NO: 59721 - DNA, 1533 bp, Glycine max
  Peptide Sequence Number=SeqID_151406
atggcgccattgttttctacttggaaatggatcagggaagagagaactgtgaaatcattgcggctttcaaaggcattgacagttcctgaaacaacaaccgtctatgaagcttgccgtagaatggctgctcgcaaagtagatgctctgttactcactgattccaatgctttgctctgtggaatcctcacagacaaggatatagcaacaagagttattgctcgtgaggttaatctcgaagaaacacatgtttccaaggttatgacaaggaatccagtatttgtcctttctgacgctcttgctgttgaagccctccaaaagatggtgcaagggaggttcagacatttacctgtggtggagaatggagaagttgttgccatacttgacatagcaaagtgtttgtatgatgccattgcccgtatggaaaggaaagctgagaaaggaaaggcaattgcggcagcagttgaaggtatcgaaaaacactggggaacatctactcctggctccaattcgacattcatggagactcttcgggagcagatatttaagccatctttgtctacaattattcctcagaattcaaaggttgtaacagtttcaccaacagactcagttttgacgacaacaaagaagatgcttgaacttcgtgcaagttcagctgttgtgacggttggtgacaaactttgtggtattcttacttcaaaggatatcttgatgcgggtaatagcacagagtcttcctccatcgtcaactcttgttgagaaggtcatgactccaaatccagaatgtggaacaattgatacaccaataatcgatgcacttcacactatgcatgacggaaattttttgcatcttcttgtggttaatagagatggcattgttgttgctacggttgatgcgattcatatcacgcatgctgctgtggcgacagctagtcaggtcggaaatactcccaattttaacagcgaagctgccaactccatgatacaaaaaatttgggattcggccatggccttagctccaaatgaggaggaagaggattcacaaagcgagacttccttgaaaatgatttctgagggaggagaaacaggaagatccatttcttatcttgcgtcaagcatgcagaacgcattttccttcaaattacaagacaggaagggcagattgcataggttcacatgcgatactcggagcttggcagaggttataacgtccgtcattcagagagtcggtgatgatattgaccccatggacctgccccaaattttgtatgaagatgaagaaaatgataaagttgtactggcttcggacagtgatcttgctgcagctgtggaccacgcaaagacggctggtttgaagggactgagattgcatttagactactctggaacacatggttatggaactgattcaagttcattaagttggaaatatgctaattcagaagcatgggcatcggcatacagtgccattgctgctggagctgcagttgttgctgccttaggtctattggcgtttgtgaggcgaagtcaatga

SEQ ID NO: 59722 - DNA, 288 bp, Glycine max
  Peptide Sequence Number=SeqID_151407
atggatggactaatagttgcggaggcaaagcaaaaacactcaccctcaggagttgtactgagtaacgatgttctaacgttggatttggctgcaggcacagatcattcccttataatagctcttgtcacagtatatggattgatatgcggtataataactagtatgattaagcatcccgacaagacaagcatggtagggatgcgttttgtcctcgcagcccctgttgaagatagggccgaatttgaggaggtgatggcaaaaaagacacttaatccttttcccatctag

SEQ ID NO: 59723 - DNA, 591 bp, Glycine max
  Peptide Sequence Number=SeqID_151408
atggcgtttgaagacttcgatcctattttcagtaaacccaaagtggaagtggagtgggcttctcaaagttctcgtccctttttcttccacgcctattcccctgattcttctcaccttagggatattgttagaatagggggttcttggtcagagtttgctggttattttgtaacatccctcaagtcacaagatctgaagctgcttctagagctagattcaagctcttatggtgttgttagtcatgcaaaattagtagctcagaaatcaaaaggaatgcctttgatcaccattcctcttatcaaacttgtggactccgctgctgctatggaagttaagtcaaatttttgctcgagcctgtctgaggcatttgaaatcaaaagcatggagtgttctcttgaaaaagaaatgaagccatacaactggaacagcgacaaaagtttcaagattagcaactcagagaatggcgtttctactgacggattgcaaaactctccagtagttccaaaattatctcggttgaaggttttaccaacttctctgtggtactatggtatacatggtgagcttgtgaataaaatgtctcaaggctga

SEQ ID NO: 59724 - DNA, 216 bp, Glycine max
  Peptide Sequence Number=SeqID_151409
atgggttgttggagatctctgaagaattttcccgatcaagatcttgcggttgacgcaaatctggtttcccattttgatgatgatgttgggtcgcgcacaaagctttgctggtgtgggtgtgggtctcttttgaggaagatgaagggtggtggagacagagagggagaagaaaagaagaaatgggtaaatcgaaaagaaaaaagagaaaaaatctag

SEQ ID NO: 59725 - DNA, 1176 bp, Glycine max
  Peptide Sequence Number=SeqID_151410
atggcgaccaagtttttagctttagcttgtttacgtaacaatgaggggtcggggtacctatcgccacgacctcactacccgtcgatgccgaaatatccaaagggagtgacagaagaagaaggaagcagtaacatatcgtccaaggcacttttctccgtcgtcggaatgacttgctccgcctgtgctgcctccgtcgagaaagccgtcaagcgtcttcccggaattcgccaagccgtcgttgatgttctcaacaaccgtgcccaagtcctcttctatccatcctttgttaacgatgttttgaaactcaattttatccgcttagatgcgttatttttacatgaaatgatgaatgattccattagttttcatgttggtctatctaatggtagtattcgcgtgcctcaaatcacactaaaaatcaacattcatgcgcctcaaatcacactaaaaatcaaagtaaaacaagcctcaaaaacgaaaaaaaaaatcacgcagaaggatgcagtccaaagtaacgccaccaatttagacaaaccacctgaaaaggaagagaccattcgagaggtcattgaagatgctggattccaagccacattcatcagagatgataacgagacatctgttcagatatgccgcatacgtatccaaggcatgacatgcacgtcgtgttcctccaccgtcgaatccgctctacaatcaatccaaggagtggtgaaagcccaagtggctcttgcaactgaggaagctgaagttcactacactccaaacgttgttacctacaaccaaatcttggaagctgttgaagacacgggctttcaggccacgcttataagcacaggcgaagacatgagcagaatagaccttcaagttgaaggcataagaactggtcgttccatgagactcattgaaaattctcttcaggccctccctggggtccaaggtgtagaaacacaccctgagttcaacaaagtgtctctttcttataaaccagacttgacaggacctagaaatttcatcaatgtgattgaagaaacgggatctaggcgtttcaaggcgaagattttccctgaagaaggaggaagaaggaatagtcataggagggaggaaatcaggcaatactatagatctttcttgtggagtttggtgtttactattcctgtgtttctaacctctatg

SEQ ID NO: 59726 - DNA, 3207 bp, Glycine max
  Peptide Sequence Number=SeqID_151411
atgaacatgcagtgggagcaggaggggcgggggagagggggaactgacaacggaaatgggtttcctcgggcaggtagccagcagcttgtgtctctggtgaagtggataaatgcggtgcttcctaattttaatctgcctttagatacttcagaggaggaattgagggcatggttgagggatggatctgtattatgcagcattttggacaatcttgttcctggttcggtgaagggaagtggttctttgaatgagctaatcggtgtgaaaaggtttctggtagctttggatgaattgggattgtctggatttgaattgtcagacctggagcagggatccatggtgcctgtgttgcaatgcctcgagactctgaaaactcattttgcttataatgctgcacgagaaaatatccaaagttgttcaagaaagagatgggaccagtcaaatttaacatcctttgaggaatctgatagttgcctcaaggatgcttcaaaattgcaacatgctgttgatggttctgttgtatcagatgaaatcacttccgtagatcatactggaataaagtctaacgaactgttccagttgaagcaaggattgcttgcagatttttctgatgctaaacttaatgaagtattgaaatcaaacaatttggatagtgtctcaactcaattgctttttaatataggaaataggatcctaagtgatatctttgaaaggaaaaatggagatgtacctcaggctcatcgtgctgcatgcctgttgaggaaaattctgcaagtaattcagttgcgcttttcaaatcaagcagaaagcatgaaaaatcaaaaccatcttttcaaggctcgtgagggaaagtatcaaacaagaataaatgcacttgaaaccttggcggtagggacaacggaagagaatgaggttgttacaagttgggttcagcagttgaaggttgaacaaactaagtttgaggagaagaagaaacttgaagagcaggatttttctcgtttaaagaaagaaaaagttcatagtgaaatcaaaatttctgaattgaagcaagatttggaaatagccaaaagaacatatgaagaacatgtttcagagttagaattgcaagctactgaatctaaagctgaatatgaaaaaagaatagagggacttaagcttcatcttgcagatgcaagaatgcaagtgaaggaactagaggcattttccgaatccagatttttgaaatggaagaataaagaggatacctatcaaactatcgtaaatttccaagttggagctttccaggaactgagagctgccatgaagtctgtcaaagatgatgtgataaaaacaaaaagaaactacttagaggaattcaagtactttggtaggagggcgagccctggtgcagcggtaaagttgtgccttggtgacttgttggtcatgggttcgaatccggaaacggcctctttgcatatgcaaggatgtgtatatgtaggaatcaagttgaaaggtctagctgaggctgctgaaaattatcatgtagttatagctgaaaataggaaattgtataatgaagttcaagatttgaaaggtaatataagggtatattgtcgaattaggccatttcttccagggcaaagtcaaagccatacaacaattgagtttgttggtgatgatggagaactgattgttggcaatcctcttaaacaaggaaaagaaaatcgcaagctttttaaatttaataaggttttcggtcaagcaacaagtcaagaggaaatattcaaggacactcaaccattgattcgatctgttcttgatgggtacaatgtttgtatatttgcttatggtcaaactggctcgggaaagacatatacgatggaaaaacataccaagtattgtttccttgacttgcacacacttgggatttggaatactgcccaaccaaatgggttggctgttcctgatgcaagtatgcattctgtgaattcaatggcagatgtccttgagttgatgaatattgggttgacaaatcgggcgacaagtgccacagccttgaatgaaagaagtagtagatcacacagtgttctctctgttcatgttcgaggaacggatttgaagaccaacactctgttgcgtggatgccttcatcttgtagatcttgcaggaagtgaaagagtggatcgttctgaagcaaccggagataggcttaaggaggctcaacatataaataaatcactgtctgcactaggagatgtaatatttgctctatcacaaaagagttcacatgtgccatatagaaatagtaaattgacccaacttcttcagagttcgttaggtggtcaagcgaaaacccttatgtttgtacagcttaatcctgatgttgcttcatattctgaaactgtaagcaccttgaagtttgctgagcgggtttccggcgtggagttaggcgctgctcgtagcaacaaagagggaagggatgtgagagaacttatggagcagttggcatctctcaaggatgtaattgcaaggaaggatgaagagattgaacggttacagtcgctcaaggctaatcataatggtgcaaagcttggtatgatctcagcaagacatgggtcatcatctccaaggagacattccatagggactccccgaaatagcatgagacttgcaggagcgaggagctttggagtcaatggaaaggcagcttctgaaatggataactgctcagagtacagtgataagcattcagaagctggttctcatcaatcaatggatgatttcaggaacaagtccagttcccttcggttgaaattaaccagagatgatagcagtcaaaatgtcaatgaagacattgacctcttaagatttggagatgcagattcagaggagagattaagtgacatatctgatggcggtctttcaatgggaaccgaaactgaaggttcaatcagcagtattgtggagtacactcttttccctgaacttgagaaggcagctgaaattacaccagtgaaggacaccacaactgacaaccttccagctgagagcacagaaaagcttattatgccatccaaaattcccaaagctgctcaagtcccacaaaaagtccagtcaagaccttctaggctttcattgaacaaaacctcctcgaaggttctgtcaagtgttagaaaacctgcagccagtagctcttcttcggtgaagccccctaaacgatggcaatag

SEQ ID NO: 59727 - DNA, 576 bp, Glycine max
  Peptide Sequence Number=SeqID_151412
atgtggtttcttggttggaaagggcaatcggggttctcagcgtcctccacagccgaacaagtcactcaagggattgatggaaccgctctcacagccatcgtcacagcaacaagtggccttggtctggaaaccacccgggttcttgcattgcgcagtgtccatgttgttatggcagtaaggagtgtggacagtggtaagaatgtcaaagaaacaatacttaaggaaattccctccgctaaaattgatgtcatggaattagatctaagctctatggcatcggaagaaggagtggaaataactgtcaactcccttcatcctggatcaattgttacaaatattctgcgataccatgactatattaatgctgttgctaatatggtgggcaagtacttccttaaaaatgtgcaacagggagctgcaactcaatgttatgtggcattgcatccacaagtcaagggaatatctggtgaatactttatggatagcaataagggaaccccagcctctctggctaaagattcagagctggcaaaaaaactatgggaattcagcttaagcctgactaatccaaagtag

SEQ ID NO: 59728 - DNA, 414 bp, Glycine max
  Peptide Sequence Number=SeqID_151413
atgttgtcaaaaagtgagccgaagcaagaggatggggcagaacctgtgctttatggctcggttcacccaacgcgccatggcttggcgcagagtgcgcgtggtgaattccagtgcggcggttttacgttggaacagccacgtgtcgccgtcggagttgaagatgccttcgccgagcaaatcgtggaacgcggactgccacgtggggcctttggggtagttgtcgaagcggagcttgaggatgtgctcgaggtttttggggtcgcacgtgacggtgacgaggcactgtttacgggcgaggaagggaagggcgcagatgcaggtttggtacgtgccgccgcacgcgcggaggttgtcggcgatccagtcgtgcatgcggttggcgtgttggatgaggccagggaggctgccgaatag

SEQ ID NO: 59729 - DNA, 2991 bp, Glycine max
  Peptide Sequence Number=SeqID_151414
atggatattcaagaagagagctccaccacacttggacccttgacagcaaagagttcaaggaacatgtcatcctcgtcttcagcctttttttcagccaatcagtcacccttcttctctccaagatcatcatcatgtcagttatcagagtctttgcgacccgatgctcccagtgacagaattcattcagatgctgctgcccccagcaccatttcagggattccagaaccaaagtctattgtgaatgttggatgctccttctctgaggtggctgcatctccagctggctgtaatgcaggtgatttgcagaaccttgatcgcatatcttcctcagtcggcatctctagtagcactgtgtctggttattgccatccttatgatgatggttattctgggctgaaagagaagagaagcaagagaggcagaaacaaaagaacatcatcaacaccaggttctagatcactttcttcttatagactaaagagttgtgatgtctttataggactacatggtcgtaaacctcctctaataagatttgccaattggttgcgtgtcgagttagaaattcaaggcataagttgttttatatcagatagggctggatgtagaaactcttgcaagcttggcattgcagagaaagctatggatgttgcttcttttgggatagtaattataacaaggaagtctttcaagaacccatacacaattgaggagctgcagtttttctctggcaagaagaacttggtccctatatactttgatttgagtccagccgattgtcttgtgagggatatatttgagaagaggggtgagctgtgggaaaaacatggaggggagctttggcttttgtatggagggttggagcaggagtggaaagatgctgttcatggcctctcacgtgttgaagaatggaagttggaagctcatgatggaaactggagagattgcatactgagggctgtaacattattagcaatgaagttaggcagaagaggtgcggctgagcatttgacaaaatggagggagaaagtgaaagaagaagagctgcctttcactcgtaatgagaacttcattggtaggaagaaagagctttctcaactggagtttatgctttttggtgatgttactggagattcaaggcaagactatatcgatcttaaggccagaccgaaacgaaggcatttgactattggtcggggaaagagtagtgtgctagatgagagacatatgggaaatggaactagggaggaaaaaacatcagttctatggaaggagtcagaaaaagaaattgaaatgcaaagtattgagttttctcacgggcaccaccgatcaaggatcaagtgtggtggaaagtatactaggaggaaaagaggaatgaagattgtgtatgggaaagggattgcctgcatatcaggagattcaggaattggtaaaacagaacttattcttgagtttgcttacagatttcaccagagatacaagatggttttatggataggaggggagagtaggcatataaggcaaaactatctaaaactcaggtccattttagaagttgatttgagtgttgagaatagtttggaaaaaactaggataaaagggtttgaagaacaagaagaagcagccgtttctggaattcgcaacgagctaatgagaaacattccgtatcttgtgatcattgataacttggaaagcgaaaaggattggtgggatcacaaacttgtgatggatctcctccctcgttttggtggagagacccatataattatatcaacatgccttcctcgtgtcatgaacttggaacctctaaaagtttcatacttatctggagttgaagcaatgtctctaatgctaggaagtggcaaggactatccagttgcagaggttgatgctctgagaactattgaggagaagcttgggaggttaactttgggccttgccattgttagtggaattttgtctgagatacctataaccccaagcaggctcttagataccataaacagaatacccttgaaggacatgtcatggagtggtaaagaagctcactcattcaggcagaacactttcctgctgcaactctttgatgtttgtttctcaatatttgatcattcagacagcccgaggagcttggcaaccagaatggtactggtaagtggatggtttgcaccttgtgcaattccagtttccttattggcacttgctgctcagaagataccagaaaagcaaaaggggacttgtttctggagaaaattactgcaatccttaacatgtgggttcacatcctcacacaccaaaaaatcagaattagaagcatcttccctactgctaagattcaacattgcaaggagtagtactaagcaaggacatatctatttcaatgacatcatcaaacaatatgctcggaaaagagaagttaccggatctgcacaagcaatggttcaagctgttatcagtcaagggtcaatatctgaaaacatagagcatttatgggctgcatgttttctgctatttgcatttggtcataatcctccggctgttgaactcgaggtttctgagttcttatatcttgttaaaaaagtggttctgcctcttgcaattcacactttcatcacgtactctagatgcactgctgctatagagcttctgcacctttgcaccaatgccttggaagctgcagaccaagcatttgttaccccagttgacaagtggtttgacaaatccctttgctggaggtccatccagactaatgctcagttgaatccttgcctttggcaagagttggctttgtgtagagctactgtgctcgagactaggggcaaactaatgctaagaggtgcacaatttgacataggggatgatctaatcaggaaggccgtttatatcaggacttcaatttgtggtgaagatcatcccgataccatatctgctcgtgaaacattaagcaaactcaccagactaattgcaaatgtccaaattcgtgcttctacatag

SEQ ID NO: 59730 - DNA, 1593 bp, Glycine max
  Peptide Sequence Number=SeqID_151415
atgaccttaaccttttctactaagagtgaggtgttgactgttgaaattgcagctacacttgtcagagaggatgaaaggattacagatctgaacttcctgattggtcccaagctgtatgaggccaattggctagatctagtaaaaggtggatttattgcaaatgtacagtgtgctgaagtatggtgtccgatgacaaaagagttttttgctgagtatttgaagaaagagaactccaagaagaggcaggcactttacgtaatgaatcctaataagttcagagcgtgtgagtttctcataaatttccatgaagggacacgtggtgataaaattatagtctttgctgataatctgtttgctctcactgagtatgccatgaaactccgcaaaccaatgatatatggtgctacaagccatgttgagagaacaaaaattttgcaagcattcaaaactagcaaagatataaatactatatttctttccaaggtgggcgacaactcaattgatattcctgaagcaaacgtaataattcagatctcttcacatgctggttcaaggcgacaagaagcccagcgtctgggtcgtattcttagggcaaagggaaagcttgaggataggatggcagggggcaaggaggagtataatgcatttttttattcccttgtttcaattgatacccaggagatgtattactccactaagaggcagcaatttttaattgatcagggttacagctttaaggtgggaaagtgggatggcatgatttgctgtcttacttggaataagtgggaacacgagctgaatttccttgtgataataagagaaaagaatggaagagaaatgagaagaaatattttagttaaagtagagaaagaggtaattactagcttgcctcctcctgatgaagggcctaatttgagctatcatcgtcttgaggatcaattggcacttcttggaaaggtgttgagtgctggtgatgatcaagttggattagagcaactagatgaagatgcagatgaaattgcccttcagagtgcccgtcgctctcaaggatccatgagtgcaatgtcaggtgcaaaagggatgatctttggtcatgattgctttcttccccgtgcagtactgtgcgtaaaggccaacaaggacagatcaagagcaagccgaaagatccagcgaagagacatttcttgtttaaaagaagatatggggcaacctaaatgtgccgtctttgtaatgaaatcattcgatgcttcgaaaagcaggcataatggtttttctactgttcactttatggagatgtggacaaacagatgtttgactttttcttcttcaaagaatcaattactgaaaagtgaaaatgtccatcagactgacaaacatagaatgttaaaggaagaaaattatagcgttgcacgacaaatagacaacaggcacatgctcaaactagtgctgcgtaatagaacttgcatagagataaagatccgagggtggagacgcaaaggaaggtgccatagacaaaatagagagaaactgaaagttagaaaaaggatggtgatgaaggtggtagttggaaaaggaggtaaaggcagtggctag

SEQ ID NO: 59731 - DNA, 516 bp, Glycine max
  Peptide Sequence Number=SeqID_151416
atgcggatattcagcgataccagaggcagcccagagtctctcaataaaagcaccttgcatttcgtcgggtataaagggcattctgcagagagggcatgttctctgatcgtaccccatccaacggtccaaacatcctcggtggaatatgtggcgacaattcgccagctgtctgatctcatcgttttcctcgaactcgctcagacacaccgcgcacgtctccggggggtccaccagctcccggaacttcaccaccggcaggatttcccggatgagcgtggccgacacggactcgaattcttcgggcattcgggtttcgggccaggcggcaatgtcgggctcgaggaagtcgtggaggcccatgaagcggaggaggctgcaaatcagcttcctgaggaggcccaagagggagaggatgtgaaggagaagcttcgggaacaggagctccgagtaccccactgggaaacccatcaaagagatttctttctttctgcgtcaagagaaaattggggaaagtga

SEQ ID NO: 59732 - DNA, 1191 bp, Glycine max
  Peptide Sequence Number=SeqID_151417
atgcctgcgacaacagagaacaacaaccaaggctcattcctgggtcgaataagcatccgcagaaaccaagtgatgtccatggacggaagccacgaccaagagatggaagacctggagcttttccagaagcacatcggagaccgcttctcggagctcttatcctccacctccgaagactcctcctcctcctcctcctcctcctccggcgacgcgcttctctccattgcgtggctccgcaggctcctcgacgagttcctctgctgcgaggccgagttcaaagccgtcgtcttaatgggccgcgacccttcccagatcacgaagccaccgctcgacaagctcctcccggatctcctcgaccgcggcgtcaagtccctcgacgtctgcaatgccgtcaccctcggcctcgacgccgtcaagaacctccagcgcctcgccgagatcgccgtcgcggccctcgaacaaacccccctcggtgacggccaggtccgccgcgccaagaaggcgctctccgccctcgtagccgccatgctgaacgacgacagcaacgccgccgccaagggaaccgaacgcacccgctccttcgggcgccgcgccggaaacaccaacaccactaaatacaagtcgctgtcgtggagcatggccaagaactggtccgcggcgaagcaaatccacgcgatgatgtcgaatctgacggcgccacgtggcgcggagtcctcgggattggcgcaacccatgtacatgatgagcaccgtgttggtgttcgtgatgtggactctggttgcggcggttccttgccaggaaaggaatgggctagggacccattttcctctgccgaggcaattgggctgggcccagcccatgatcggcctgcaggagaagattgcggaggagtggaagaagaaagagaagaaagggaacgttgggttgttagaggagatgcagaggatggacaagctgggtcagtccctgattgaattcgcagactcgtttcagttcccaaccgaaacggagcgtatggatgaggtgaagaagcacgtcgaggaattgggggacatttgtaaaaaaatggaggaaggcttggaacctttacagcagcagattagagaggtctttcacagggtcgtaaggagcaggactgagtttctccttgccttggaccaagctgccaagtccactacacccgctctgtaa

SEQ ID NO: 59733 - DNA, 1347 bp, Glycine max
  Peptide Sequence Number=SeqID_151418
atggcggcgcctgaatcccctctctgttacgtcggtgtcgccaggcaatccgctgcttttcgcctgatgaagcaaatggggtgggaagaaggagaaggtcttggaaaagagaagcaggggatcaaaggacacgttcgagttaaaaacaaacaggacactattggtattggccttgagaagccaaacaactgggccttcgacaccactcagtttgataatattcttaagagattgaaagttcaagcaccgcaatcccatgacatagaggaaaaagtggaaaccaaggctagtgttcctgttgataatgaggaggattctgtccccaaaactacaagaccacaaggaagatacgcgagaagagagagggggaagcttgtctcgcaatattccttgaaggatctggaaggaattcttgttaaaaagggtgacgtatctgggagtactgataattctgatggtgaactggacatgttaaagacatctgaaattcaaaaatttgaagatgaaggaagcaaatatcctgctatacctccagattggtggggctacaagtatggttttgtctctggtggatttcttggagcagaatcaaagaagaaaaagtccatgatttctggtaaggcagagaggactgcatttttcgaagaggatcaagaaaacctttataatctagtccaggatatggtgatgctcaacctaagaagcatggcggcggctgcgcaggggcgtgtcccgcgtcggaatcgcaccagatacttattcagacatgactcacattcaacgtggtgtcgggtgcatttaagttttgccggacacggttgggctgttggacatgcgcaattggatccatctgggtgcgaacacgtgcagagctcctcgctgccgcacgcaaagcacgccgtcactgcgctcagacctctgtcgctgtgcgtagaccgggagaaatccacaacggggaagcaaggactaggcatcaaggacagacccaagaaagtagctggctgctattttcagggtaaaaagaaatcctttgatgatagtgatgaagattctgctgataacgattccctggaacaagcagcaaatgatgacttaattaaagtagaaaagattgttgaaggcaaagtgaagctgaaaaagttgtgcaaacagattttacaacaggtgcctggagaatcattgaaactgaaacagctcaaagttcttattgatgaacattcatcttcaatttggtctgatttttcttcaagaagagagtctgttgcttacttgaagcaaaagctgacaggtagtaggaagttttatatcgaagggaaaagagtgcgattggcatcaaagagaagctga

SEQ ID NO: 59734 - DNA, 684 bp, Glycine max
  Peptide Sequence Number=SeqID_151419
atgactgacctgcgcaatgaagcaaaagaaacacttcaacttaacgctttctccttccacttcaagcaaccacttgctcttcaaagaaaacctcaactcccagcctcacttcacgcatcccacaaattcaaggtggatgaggttcccattgtgtccttgttcgccaaagcctcgcagcaggggaatgttgctgaaactgccaaggtgaagttgggtcagaagcaggggaatgttgctctgcctgcgggtctacgcaagcatttaggcaaggcccgttcggcggcggtgccgcctccgccaccaccggcgttggtgtcttcgaaacggcgtgatgattcactgttgcagcaacatgattggattcagggtgctattttgctttgcaaaaactccttcaatgcttctcctgaatgtgagatttctcagctgccacgatcagtgagcgacggatctcctgaactatctgagaattctaagaatgaccgagtgcctttgagatataatataatcaattttcatgtcccaggcacccaccgaaggaacattaccatagttagtcgagacgacggaaaatgcggtcagagaagtgggaaagatggggacatgagcagtgaaagtgagatcttttgggtgaaggggagggaaggaaaggtgttattgaccgtggcacaatttaccaagtga

SEQ ID NO: 59735 - DNA, 2208 bp, Glycine max
  Peptide Sequence Number=SeqID_151420
atgcttgccaaggctttagctcattactttgaggccaagttgcttctgttagatttaactgacttttcattgaagattcagagtaaatatggtttttccaacatggaatcttctttcagaagatccacttcagagactactttggagcggctatctgatctatttgggtcattttcaatcttttcacaaagggaggaacctaaaggcaaaatgaacaggcctagcagtggagtggacctccaatcaatgggggctgaagcatcttgtaatcctccaatactccgtaggaatgcttcttcctcttcaaatattagtggccttgcttcgcaaacctatcctacaaattcagttcctctgaagcgcacaaccagctggtcttttgacgaaaagcttcttatacagtctctctataaggttctggcttttgtgtcaaaaacctatcccattgtgctatatttgcgggatgttgataggctgttatataaatcacaaaggatatataacttgttccaaaaaatgttgaagaaactatctggaccagttttgattcttggttctcgagttatagattctggtaatgactatgaagaggtggatgagaaaattaattcgctcttcccatacaacatagaaatcaggccaccagaagatgaatcgcatcttgtcagctggaagtctcaattggaagaggatttgaagatgatacaagttcaggataacaaaaaccatatcatggaagtgcttgcagccaatgatcttgattgtgatgacctggattccatttgtgtctcagacacaatggttctcagtaactatatagaagagattattgtgtcagcaatttcgtatcatttgatgaaaaacaaagacactgaatacagaaatgggaagctcgttatttcttccaatagtttgtcccatgcattgaatatattccacaaggggaaatccagtagaagagatacatcaaaattggaagatcaagctgtaaaatctgagaagcaaatagaggagggaactgctatgaaaccagaagcaaagtctgaaaatgccgctcctgtaaaaaaggctgaagcagaaacattaagttcagtgggaaagacagatggtgaaaaatcagttcctgcacccaaagccgctgaagttcctcctgataatgagtttgagaagcgaataaggcccgaggtaatactagcaaatgagattgatgtcacattctctgatattggtgccttagatgagaccaaagaatcccttcaagaactagtaatgcttcctcttagaaggccagaccttttcactggaggccttctaaagccttgtagaggaatattgctgtttggacctcctggaactgggaagacaatgctggcaaaggccattgcaaaggaggccggagcaagtttcatcaatgtgtccatgtctaccatcacttctaagtggtttggtgaagatgagaagaatgttcgcgctttattcacacttgcagccaaggtctccccaactataatattcgtggatgaggttgatagcatgcttgggcaacggaccagagttggggaacatgaagccatgaggaaaataaagaatgaatttatgacccattgggatggacttttgacaaagcaaggggagcggatccttgttcttgctgcaaccaataggcctttcgacttggatgaagctattattaggcgatttgaaagaaggattatggtaggactaccatctgtggagaacagggaaaagattttgaggactcttttggcaaaagaaaaggtggacaacgaacttgagtttaaggaaattgcaactatgacagaaggatatactggaagtgatctaaagaacttgtgcacaactgctgcttatcggcctgttagagagctaattcagcaagagaggataaagagtctggataaaaagcagaaagcttccaggggacagaataaagatgtccaagaaagtcgaggacaatccgtagtaggaaatactcaagatgctctagatgaagaagaggaagttaaacaggaaagagttattattacccttaggccattgaatatgcaggatttcaaagaggccaaaaatcaggttgctgcaagctttgcagctgaaggggctggaatgggtgagttgaaacagtggaacgatttgtacggagaaggcggttcaaggaagcagcagcagttgtcttacttcctgtga

SEQ ID NO: 59736 - DNA, 480 bp, Glycine max
  Peptide Sequence Number=SeqID_151421
atgggaaatggagagtcaacacatgattcccatgatgattttttccagcaacccctttcctatgatgattttttccggcaacccctttcctatgatggatgttcagcagatattagccatcaatatcatcaacccgcttcctatgatggaagttcagtgaatactagccatcaatatcatcaaccctctacatatgctgagagttcggtaaataccagacatcaacataagcagcgacccacatatatagcagacaatttcagttcattggatcaggttgtttctgctttgagagaagctggtctggaatcttcaaatttaataattggcattgacttcaccaagaacaatgagtggacagcatctacacatgatcagaatgtgttcagcttttatcgtgatgagcgctattgccatggttttgaggaagtacttgcacgctaccgagagatagtgccacacttaaattggcaggtttaa

SEQ ID NO: 59737 - DNA, 609 bp, Glycine max
  Peptide Sequence Number=SeqID_151422
atgtgtaacgcaacagattataatgtgcaatctattggcggttacgttctcttgattcaattgtgggcatgcaactactgcagccagcttaatgaatggaatagtctttatgaaagacggtttcaagaaacgctaccacaagttgggcccctcagtgtgaattctgagtatatgaagtggtttaggcataaaaccaaattgtatatcagtcgacaacatgcaagaagaggactaatgggtgaaattatagaaataatgcaattcatgttgttcctatatggcagaagagtgtcaactttggatgatctggcgttgtgccttgataagatgactcttttagctgaggaagatgatagaattattgaggcacgcgaagaagctcctccttcggttccacaatttgaaggtcaagagtttgacacgttgggtaggagtgtggagacccaaggtttagggcgacatagggaaagtgtggatgcagaagcacatgttattcccgcgatgccagagcgacaacatggaatgtattacacacttgatcagttcacccaagtgccgtctcaaatgtcccccctgtatccgtacccatatcaaagcgaaacttcatga

SEQ ID NO: 59738 - DNA, 420 bp, Glycine max
  Peptide Sequence Number=SeqID_151423
atgaggttggggagggagccgacgtggtggcaggggcgggagggccactcaacgtcgatgtcgtcgggctggagagggacaaagtcagagcgggagtgggtgaggaacccgacggcgcaattgtcaatgccggtggggcactgcatcatcttgtacgctgcgaaactcatggtggaagaaacattctcagcggcgaaagagaagagagagtatgagagcgtgagagtgagagggtcagctgagtggaggccagcagggagaaaggttcaagaactagggttcgcgaaaggaaggtgggaggattgctattatttgctagctaaggagaaggagagaaacacaataccatgcactttgaaatcgatcgggaaggaagcaatacttagcaatttcttgaaaacaattgctaggaaatactaa

SEQ ID NO: 59739 - DNA, 1545 bp, Glycine max
  Peptide Sequence Number=SeqID_151424
atggaaattgagcactacaggagggagatcctacaatctgaagtgattaatggaatccatgaggtgtactgtgaggaattatcatcaagtctcaatcaagatgatgcagaatcagaattgctattgcatttcctcatctcactaaaagagcagaagcacatggatgccaacaaattggcagaagaaatcagatgcttagaatcagatgtgaaagaggtggagaggagacatgacttgagaaaatccttgcttccctcaagcttgcagaatgactcctctcttcaaatagagaatgtatctcttaaagaatccataatttctaatgcaaatgaactgagattgatgaaaattataccccgacttgaaagtgcttacttttccatgagatccaaaattaagcttcctgaaacagatactgcaactcacccagataaagatatactgataaatcatgacaattggtgtggagctcaaaaagacatggaacaacataaagcgacagatgctttaggagctttctttgacagtttgtgcaagtatgcacgttatagcaagtttgaagtgcggggcatactaagaaatactgattttaataatcctgcaaatgtaatatgctctctgagttttgatagggatgaagattactttgctgctgctgggatatcaaagaaaattaaaatatttgagttcaatgcacttttcaatgattccattgacatccattatcctgtagttgagatgtcaaacagatcaaggctcagttgtgtttgctggaataactacatccagaactatcttgcctccacagactatgatggtgctgttaagctatgggatgctaatacaggccaagggttttctcgattcaccgaacatgaaaagagggcttggtctgttgatttctctttgttatgccctactaaatttgccagtgggagtgatgattgttctgtgaaactgtggaatatcaatgagaaaaacagtttagccacaatcaggaatgttgctaatgtctgctgtgttcagttctctactcattcctctcatttgctggcctttggatctgctgattactcagcatattgctatgatcttcgcaatcttagaaacccttggtgtgtgttggctggccatcgtaaagctgtaagctatgtcaaattcttggactctgaaacacttgtttctgcatcaaccgataacatgttgaagatctgggatctcaataaaacctctcctgtgggtccatcaactagtgcttgcagcttaaccctgtctggacatactaatgagaagaattttgtgggtttatcagttgccgatggatatatagcatgtggttcagaaacaaatgaggtttatgtctaccataaatctcttcccatgccagtcacttcgcacaggtttgggtccattgatcctatttctggtgaagagacagatgatgacaatggtttgtttgtttcaagtgtgtgctggagaggaaaatcagacatggttgttgcagccaattcaagtggatgtataaaagttctacagatggtttga

SEQ ID NO: 59740 - DNA, 954 bp, Glycine max
  Peptide Sequence Number=SeqID_151425
atggatcttaagagatcactggaagagcgagaagaatcatatcagaagttgaatatagaatataaacaaattgatagtttgtttaaggaatggatggtcaaacttgaagttgcagagaagaagattgaagaaatggcaggagagtttcatgaaggcattgagtcgaaagatcagaagatagctgatttggaacatacggtggaagagctaaaaagagacctagaagagaaaggagatgaaatcagtacttcgcttgagaatgttcggatgcttgaggttaagcttcgtctgtcaaaccagaagctccgggtcacagaacaattactgagtgagaaggaagaaagcttttggaagacagaggaaaagtttcagcaagatcagagagcccttgaggacaggattgctactttgtcagcaataataactgccaacaatgaagcttttgatgaaattgtctctaatcttaaagagtgtgcaaacagtgtcacgactggcatagaaactataagctggaaagtttctgatgactgtaaaaatttcaaggacagtgtctcaaacgtctcacacgagcttggggttgcaaaggaccatgtgagggagatgaaaagggaaaaagaacagttaaagagagacaaaaggcacttgttggagcagctgcaggttaaaaatgaacaggaagtgactttgaggaagagtgttgagaagcttgaggcaaaggcaagcaaggaggaatcagagaagatgaatctgacaacaactgtagttcaactaaagaagacagtgggagagttagagaaaatgatgaaagagaaagaggatggcatgttggacttgggagaggagaagagggaggtcatcaggcaactgtgtttgtggattgattatcaccgcagtcgttacgactatctcaaggacattctatcaaagtctcgcagaggccagagagctgcataa

SEQ ID NO: 59741 - DNA, 1317 bp, Glycine max
  Peptide Sequence Number=SeqID_151426
atgcgcgccacttttcatcaagttggcgagagtggtcctttggctgagagatggaagtggtcgaggccaaatgcaaatgtttatacattgttgattcaaggtttagcggcggtgttaagggtttctgacgctctcagggttattagatatatttgtgaaatcggcgtttctcctggtgaggaggttccgtttgggaagatagtcaaatgccctagctgtcggatagctgttggtgttgcacaaccacaacaaggtattcagatagtgtcttgtgcaaagtgtcgctaccaatacgaacttgtttcaggagacatagtcagtattgaatcagaagaaatcagcatggacattaccgcatgggaaagggggttaagatacgtgaaactgatgaagcaaagcattcctgctgctgttcactctattgtggtgcagaccccttctggtctggctcgcactcatagatttgcaactgaaacagttgatctgccagctcaagaaggtgaaagggtaactgttgctgtggcagctccatctaatgtgtatcgaaaggtgggcccctttaaattcagtccaagagcccctgatttctatcctggtgaggctatgtgcataacaaaccacaaggatgggcgggagtcactactgttaagagccccaagaaaagaagtaaattcgtcattactcaaaccctccctcatctttccacttcttgctttgttggccaccggtgatgttgcctctggaattattgaccccggccttccccaattgctgtcagttgttgcagtttcaactcttgttgttggatctacagtgaatactgttgttcttcctcagtttaatcagcttccacagaaatcagtagaagtaactgcgatcaaacaacagcttttatctcaatatgatgttcttctgtctcgcatcaatgacctaaaagaagctgctgaaaaagagatttggatgttagctcgaatgtgccaacttgagaacaaaatttcagctgttggagaacctgcttatcggactcggataagtaaagtcaaaagggttcgcgagagcctgcaaaactccctcaggggacggattgaattgattgaaagctatgctaggatttcctcaatgattgaaatcgaagtggagatggagactgatgttcttgctgctgaaactgctagtaatatggatagtatcaaagaacagatagagcaaatcatggagcttgaaaatttggaggagagatggaaaatacaagcagaagcaaatgatgaggctgaaagacttcttagttcccagcccatgcctttggacgaagtttaa

SEQ ID NO: 59742 - DNA, 477 bp, Glycine max
  Peptide Sequence Number=SeqID_151427
atgggagcaatgaatgattaccagctaacaatcaagaaaatcgttgacaatgacaccttaattgcaataggtttcccaattgatgaatttgattatgctgaagccattctcgatggattagctaatgacttagtatcgtctttggccaaattaatagtaacacaactgggtaaaaatgcttgtccctattggacagaggtcaccttcttgaacgggtcacaggctgtaggtggccaagaacctaccattttgggagaagatagtgaaaaagagtttgagaaaacaaggtggggtagtggtaatgaagtgggagaaaaagaagggatgagagtgaggattaaattgacaaaggaagaagctgcacggttgctatcaaaatgcaacaatggaggaattctccaattcaaggatgttgctcatgagcttgtgctgatcccggttaaccgagttagcgttgcgcccgatgcacaatgctaa

SEQ ID NO: 59743 - DNA, 399 bp, Glycine max
  Peptide Sequence Number=SeqID_151428
atgcctgtgtctgatcctagttcagggcgcacgttcatatggatcatagctggtcttttgttcatctctgtagccgcaggaggggcatgccttgtggcataccttctccttcctgaatcagaaacatcaacatcttggatacccgaaattggggtgggattggttagcctaccatggctgttttggttgctcactttcatatacagaatcctctcaaggatttttggatgtagagttagttttggtggaggaagtgtaggaaattgggttcctgctgcaaaggcagatgtggaggttgcagttgcatctcatgcaaaaggtggagatcagttgaatagggcatcatcttttgcttcacacgaaagtgaaatggcattggcaaaatctatggcaacatga

SEQ ID NO: 59744 - DNA, 1668 bp, Glycine max
  Peptide Sequence Number=SeqID_151429
atgttggaaatagtgggaaacaaagacactaaatcagttgtcatcactggccattccattggaggagccactgcttctttgtgcactctttggcttctgtcttacctccaatccatctcttcatctgtgtcaatattgtgcatcacttatggggcaccgttgattgggaacgagtccttttcccaaaccattttcaaagaaagatggggtggcaacttctgccacgtggtgtcaaagcatgacataatgccaaggttgctctttgcccctataacctctctctctacccagctaaattccctgctacagttttggcacttgtccatgacttcaccagattttgggaagcttgcaaatcagatatctgaaaaagagaaagataagttgttcactgctgtaatggattacttggaagcagcaacacaagatggagaaaaatcagcgccaattttgtttcacccttttgggagctacttttttgtctcagaagaaggagcagtgtgtgtggatagtccatccgctattataaagatgatgcacttgatgcttgcaactagttctccagctagtagtattgaggaccatctgaagtacggagattatgttaataaaatgtctgcacaaacattgtatcagagcaactccatgcaaaagaacatccctgactcaagctatgaagcagggcttgaattggccattcagtcctctggcatagcaaaccaggaaccagctattacatccgccaaggaatgtctgaagacaacaaggagaatgggtccttcaccaaccctgaatgctgcaagcctggcagttagcttatccaaggtggtaccttatagagcgcaaatagaatggtacaagacttggtgcgatgagcaagacgaccaaatgggttattacgactcattcaaaagcagggactcttccagttccaaaagggacatgaaaatcaacatcaaccgttgcaagcttgccaggttttggaacaacgttattgacatgttggaaaggggagagctacctcatgattttgacaagagagccaagtgggtgaatacttcacacttctataagctattggttgagccactagacattgctgaatattatgggaaggggatgcatagaaccaagggccattacatgcagcatggtagagagagaagatatgagatttttgataggtggtggaaggataaaacggttactactggtagagaagaaaacaaggagaggagcaaatttgctagtttgacccaagattcatgcttttgggccagagtggaggaagcaagggactggttgaattgtgttagaagcgagagagacactaacaagttggctctattgtgggataagattgaaaattttgagaaatatgccatagatttaattgaaaataaggaagtgtctggtgatgttctctttaagaattcaagttacagtatatgggtggaggatttaagagaattgaaacaactgaaagctaaggtgcaaaggtttcctcgtcagtttaccggttttctagatggggaagaggaaaatgcggatcatgtattcttgtcttgcaaaaccatagaggcaatctggaaattcttcttagctggggtatcaatggtgaatggcacatgtaagcgtcaaggattgaaaccgtggatgaggtgctga

SEQ ID NO: 59745 - DNA, 351 bp, Glycine max
  Peptide Sequence Number=SeqID_151430
atgaccggttcctcccattccttgctccgccgagacgaaaacagaggcaggccgccgatgctgtacaaaggagtcaaatttctccagttcgggtcggactcgccggccatatggacgccggagaaagccacatacacggaggcgccgacacgctcagtcacgaaggtcaggaagggagtggcgttggcctgggtgcagaggcgccatgagtccgacagcaggggcgtggacgagacgaaggatgcgagcatctcgcgagactcaaacctgccaccagggactgctcagctcaattgcttttggaaaaaagatgagcgagaaaggggaaagagtactgagtacttacggtga

SEQ ID NO: 59746 - DNA, 369 bp, Glycine max
  Peptide Sequence Number=SeqID_151431
atggatatggctgtgaggttcttagaagatttagaaggcattagcattcactcggatcgagaagacaagtggatttggaaggaagatgcatcgggtgtatacacagtcgggaatgggtacaagatgcttatgtcagaccaaactgatgaaaatcaggatgatgcttttacagagttgtggaaggtcaagcaaaattatgtcgctttggtgggaatcaacatcgtggacaaacacttcagcaccatttccgtagaacccgagaatgcacttcctccagcatgtggttgggaaagaaaatggaagcagttttcaaaaatggaaattgaggaggatctccttgacttggagtatttggcagcatcgaaataa

SEQ ID NO: 59747 - DNA, 2626 bp, Glycine max
  Peptide Sequence Number=SeqID_151432
taatgagcaagtttatataaaggatgatgatggaaatgtcaagcctgaacttctggatggagatgacaagtctgaacttccggatgaagttgcacaaaagaaaattagagctactggtagtcaaatgaccagtagtaatgactcagctggtgctcatcttttagaaaatgctcagaaatgccctgctttaaagcagtctccaacaaattcgattgtcaaatcagatataatgaatatagttaaagggacaaaccggaggcactccaaggaacgtactgacactaatgcttgtgacaagttatctgaaaacaaaggaaatatggctgggttgagggttaaaaagatcatgaagagggtctctgatgatggagaatcatctttggtagttcaaaatctaaggaaagaaattagagaagctgtccgtaacaagtcctctataaactttgaggataaccattttgatcccaaacttcttgaagcatttagggctgctataacagggcctaaaactgaacttgtaaacaagttatcccctgcagctataaaggcaaagaaatcaatgttgcagaaaggaaaagtgcgtgaaaatctaacaaagaaaatttttgggacatccaatggaagaagaaagcgtgcatgggatagggactgtgaaattgagttttggaaatatcgttgcatgagagctacaaagcctgaaaagattgaaactttaaaatcagttcttgatctactgagaaaaggttcaaacaatccagaatcaaagcaggcttctgaatgtcaggccaagaatcctattctttccaggttgtatttagcagatacatctgttttcccccggaaaaaagatgtcaaaccactctctgtgcttaaaaccattgctaactcggagcaaactaaacatagcccgtcagaaaaagtaccaaatctatcggttgataacaatactattaaagcaactgatataaataatcttttatcaaagaacagtgtttgttcatctgaaaaaaaagtagataagaagcttgtacgtggtccagttggtgataattcaacttctggtaaagtacgttcagacaatcactcagaaaggacatcagtttcatcagctggtgccaaaactagcacaaaagagttagaccttaaatctggttgtatgaagagtgataaaagaaaatgggccttggaagttcttgcgaggaaaacagctgccacaagtgggaacacagcaaatggaaatcaggaagacaatgcagtttttaaaggaaactatcctgttcttgcccaattgccaattgatatgagaccagtattggcaccttgtcaccacaataaaattcctatatcagtgaggcagacacagctttaccgcctgacagagcgcatattgaggaacacaaatctggctgtgattcgcagaactgcagatacagaattagctgttgcagatgcaattaatattgaaaaggaagttgctgacagatcaaacagcaagcttgtgtatttgaacctttgttcacaagagctcttgcatcacacaaataacacaaaaaccaatgtagccacagacacaagtccaccagcctcttcatcaatgcttactgatcaacaatcggaacttaatactgatgatctttcaactgaccctgaagttgaaacagccttgaaaaatgccggtctgttgtctgattccccacctagcagtccacacgagaacagagaaacatgtaatggtgatatgtcagggcctgataatatacttgaaccagattctcatcctgatctggatatttatggtgattttgagtatgatttggaagatgaagattatattggtgcaagtgttacaaaggtctcatttccaaaacaagagcaaaatgagtcaaaagtgaaacttgttttctccaccatgaacttgaaaaagtcagatatcgctttggattgtgcagactgtgaggggtctgaaagaaatgaagtgccaggagatgcatccttctcaccaaattttcaagatgatgcagtccttagggacagggcttctacaattgatgcggagacgggccagccttctgtttcttctgtgctcctatcctgtgagggtgctgttgagccacctgactcagaatttgaagaattatatggcccagacaaagaaccacttataaaaaaaaatccagttggtgaatcaagatcattacatggagatggcaagacagaaactctaagcgtggccaatgactgccataatgacgaaaaacatgtcttggacaatgcagtaaatgcttcggaacttggaaatgagaatctcacagaaaaagtatctgaggctggtgaaaatttccaaagaaagaaagagaaatccgatgtcactgctaagcagactgactctgtaaatcatataattaaaaaggtagaagcttacatcaaggagcacatcagaccgctgtgcaagagtggtgtaatcacagctgaccaatacaggtgggcggttgcaaaaacgaccgagaaggttatgaaatatcattccagatcaaagagtgctaattttctcataaaggaaggcgagaaagtaaagaaacttgcagagcagtatgttgaagctgcccaacagaacagaaaaaattga

SEQ ID NO: 59748 - DNA, 630 bp, Glycine max
  Peptide Sequence Number=SeqID_151433
atggggaattgctctatgaagggtaccactggagagtgtcaccactctattcgtgttatgtgtgacagtggtgccattttgcagttcaaagctcctaaaacagtagctcaagtgcttcaacattacccgggttatggtattttccgccagggtcatgcctcatcacctttgccagagcaagagactttaagctatggtcttttctattatcttctccctctgaaggaggttcaagtggagcaccaagaaagttgctgcgacaaagtccgagtttcagaggaaatgtgcaaatctgcagcatcagcatgtgattatgttgagaaattgtcaaatgggtcagcccttgaagtgctgccaacagcaaagaatggggtttggagagtgaagttggtgattgaccctagacaacttgagaagattttgtctgagcaggtgaatactgaagcgctgattgagaagatgaggatggctgcaactgcatgttctactactactccttctccttcaaggaccccaaccccaaccatgagctctaggaaactactggggtggaagacaacactcttcaatgcgaaaattgctaaagacacttcccctgcagcctctaatttctttttgggttcctgttag

SEQ ID NO: 59749 - DNA, 630 bp, Glycine max
  Peptide Sequence Number=SeqID_151434
atgttatctgcttatatgatcattaaccggtcatctccttcttcctcctttttacaacctctccatgcaccaccgccaccatcgaacaacaaaccacaccaccaaaccacatatcgcaacgctaacacaccaccacgaggtgaacacgatgcgcaaacactgccattgtctcatatcaccatcgtgccctcattcacgtgcacgaacactgtgtcacaactcgcaaccaccatctccatccttcttcagatctggttcaccatcatcacaccgtcgcctccttcctccctagagatcaccatggcctccaacaccacaatacccatccagatcaggcccgccaccaaatcatctagaagtagagatccgtcgccgagaaccactcctttgtcgccaacaagtgccccgcccccgacttctctcgacacagccttgacgttgttggagatcgaagtgggtggaggaatatgtggggatgatgggtttggttctgagaaatggaatgtggagcgaattagatatattcaaaatggtttctggtggagttccgaggaggttaaggatgttctgggtttgtattgcgaccggagaagaaaggttgaagatcacctaaaaaggtggccactttga

SEQ ID NO: 59750 - DNA, 1119 bp, Glycine max
  Peptide Sequence Number=SeqID_151435
atgtctagatctgtccccaacacatgtggagccaatgttacgttctgtggaatatttcagtacctgaatctattgggaattgtaataggatacacaattgccgcttctattagcatgagggcaatcaaaaggtcaaactgtttccataaatctgggggcaaaaacccatgtcacatgccaagcaacctatacatgataatttttggcgcaaccgaaatgtttctttctcaaattcccgattttgatcaaatatggtggctctcaacagttgctgcaatcatgtctttcacctattccataattggtctctctcttggaattgccaaagttgcagaaacgggtcccttcaagggtggcctcactggagtcagcattggaccagtgtcagagacccaaaaaatatggaggacttcccaagctcttggtgacatagcctttgcctattcgtatgctgtggttctcatagaaattcaggacaccataaaatctccaccatctgaagcagaaacaatgaagaaggccacattgataagtattgcagtgaccacaacattttacatgctctgtggctgcatggggtatgctgcttttggagatgctgcacctgggaatctgctcactggctttggcttctataacccatattggcttatagacattgcaaatgctgctatagtaattcaccttgtgggagcataccaagtgttttcccaacccatctttgcctttgtggagaaagaggtaacacaaagatggcccaactttaacagggagttcaagattccaattcctggtttctccccatacaaactaaaggtgtttagattagttttgaggacagtgtttgttgtcctaacaactgtgatatcaatgttgcttccattcttcaatgacattgttggagtgattggggcattgggattttggccattaacagtttactttcctgtggagatgtatatttcacagaagaagataccaaaatggagtaacagatggattagtctcaaaatatttagcatggcctgcctcatagtatcagttgttgctgctgttggctcagtggcaggagtcttgcttgaccttaagaaatacaaaccattccactcaaactattaa

SEQ ID NO: 59751 - DNA, 3300 bp, Glycine max
  Peptide Sequence Number=SeqID_151436
atggtgaggcgaaagactagtgtgggaataactacgggagtgaagacttggatggtggtgtcctcggagacaggagagcaacgccttgaggatgtcggcaagcactccctaatgcggcggactggcttgccggcgcgtgaccttagagtcctcgatcccatgctttctcacccctcttccatccttgtacgcgaaagagccattcttgtcaacttggaacacctcaaaggaatcatcacttccaccgaggttctcatgatcaactcttccaaccctttctttcttctcttccttcaagaccttctcacccgtcttactcatcaacctccctcaccgatgagcaatgacatgaatcctggttacgaagcaaaacctccagcgatgtgtggttctgaagattcttcccaaaatgtttcgcatgtgaaaatatctgaggaagtaaaagcagatagccctaagatggcacctatagctcccaagcagttaccttttgagttccgagccctcgagacatttattgaatctgcttgcagattggaggaagaggcatacccagctttagatgaattgacctcccaactttgcacactcaatcttgaacgtgtaaggcatatcaagagtcgtttggttgcactttctggtcgtgtgcagaaggtagcagatgaattggaacatttgctggatgatgataaagacttggctgaaatgtacttgacagaaaagcttaatgctagtttattagatcaggcatcattaaaagaagagtacaattctgaatctgaagataccgatcaaagcgatgaatcaaattcggaaaagtatgacaaattccctggtcttaaacttaatgttgaggaattggaaatgcttctagaagcatattttgcgcagacaaatggaatcttgcaaagattgtttagtttgagtgagtacgtggatgacactgaggactacatcaacatgatgttagatgataagcgaaatgagcttctgcaggcaacaataatattcaacaccctaaacatgatactaaatgctggtattgtggttgtaggattaacttcttcaaccaccaaccttggaggagctcaacctctttctctgcgcttcctatccaaaccagcgccctttctatctctgagcttcttcttcccctatcactctgctaacaatggcattgcggtttcttcaacccagtgcaaacccagaatccggtgcgacaaagaagtagggaatggtaataataatggaattgaagaagatgaagaggctgaacgtgaggtgcagtgtgaggttcaagtggtttcttggagggaaaggagagtcaaggccgaaattcctgtcaatgctgacattgaatccgtttggaacgctctcactgattatgatcatctcgctgatttcattccaaatcttgtgtggagtgggaaaattccttgcccgtatcctggacggatatggttagagcaaagaggatttcaaaggtcaatgtattggcacatagaagctcgtgttgtcttggatcttcaagaactcatcaattctgcatgggatcgagaacttcacttttccatggttgatggagactttaagaagtttgagggcaaatggtctgtcaaatctggaacaagatcttcatcaactaatttatcttatgaagttaatgttataccaagattcaatttcccagctattttcttggaaaggattatcaaatcagatctccctgtgaacctccaagccttggcatatagagttgagaggaatatttcaggaaatcagaaactctcccttccagaaaatcacttggataaaacttctagtgatattaatgagtcatctgcccaaaagataaatagtgctttgtgtgaaaacaaagaagatttagtcaactcaattcctggcaccttgcccatgccttccagtgaggtgaacatcaataattggggtgcatttggaaaaagttgcagacttgacaggccttgcatggtggatgaaattcatctccgtagatttgatggacttttggaaaatggaggtgttcatcgctgcgtttttgctagcataacagttaaagctcctgttcgtgatgtatggactgtaatgtcttcatatgagtctcttcctgagatagttccaaatttagcaatcagtaagattttatcacgagataacaataaagtccgcattctccaggaagggtgtaaaggtctgctttatatggtgcttcatgctcgagttgtgctagatttgtgtgaatatctagaacaggagatcagtttcgaacaggttgaaggggactttgactcattccagggaaaatggactttcgagcaactaggaaatcatcacacactgctaaagtactccctggagtcaaaaatgcgcaaagacactttcctttctgaagctatcatggaagaggtcatttatgaagatctcccatcaaacttgtgtgcaataagagactatatcgagaacaagacagcatcaaatattttggaagcatgtaagcagaatacaaattcagggcaacaaactgttccatctggctttgaagatgatgacagctattgttcagctgaagacttgtctgattgcaatgctcaaagctcatctcaacaaagaccaagagttccaggcttacaaagagatattgaagtcctaaaatctgaacttctgaaattcattgcagaacatggacaggaaggatttatgccaatgaggaagcaacttcgtttgcatggaagagtggatattgagaaggctataaatcgcaagggtggattcagaaagattgcaactataatgaacctctctctggcttacaaacaccgcaaaccaaagggttactgggacaatcttgaaaatttgcattatgagcaacaaaccataggtttgcttactttcaagtctagcaaagaaagatggataaaactgatggctgtagcttcatcccacttccaatttgaagtttctcgcctcctctccctcaaggtgaggcggcaacgaagcagacagggcaagcttgccaaggataagaaagttgatgatgatgtagcatcacctgatgtagatcattctggaatcatcagagatgccatcccaggattgagattgagagggcaaagtgtaagcatagccaaggtggttcccacagctgcggcaaaaaagcttggttctttggcgcttggagttgaaaaagggcatccaagaaggccagtgaagttgctggatctgagtgaacctgctctcatccacggagaagaaggagatgatgcctctctttatggactttga

SEQ ID NO: 59752 - DNA, 675 bp, Glycine max
  Peptide Sequence Number=SeqID_151437
atgtggcaggaaattattaggcatcacagggataaactcaaccattccattaaccaatacactgttaagtctttgctctggcagttgctcaatggactaagctatctgcacagtaattggatgatacatcgagatttgaagccatcgaatatattggttatgggagaaggagaggaacatggagttgttaagattgctgactttggacttgcgaggatatatcaagctcctctgaagccgttatctgataatgggcattttcccactattctaaaagtggtccagtactcgagtcatttttccttaaatatacatttagatatgtgggctgtgggatgcatttttgctgagttgttgaccttgaagccgctatttcaaggggcagaagtcaaagctacatcaaatccctttcagctcgaccaacttgacaagatatttaaggacattgttactgtgccaggccatcccacattagaaaagtggccttccttagcaagtcttccacattggcaacaagatgtgcaacatatacaaggacacaaatatgataatgctggtctctataatgttgtacacctgtctccaaaaagccccgcatatgacctcttgtcaaagatgcttgaatatgatcctcgtaagcgtttaacagcagcacaagctttggagcatgagtag

SEQ ID NO: 59753 - DNA, 1662 bp, Glycine max
  Peptide Sequence Number=SeqID_151438
atgggtttgttcaaaagcaagggcgtggtttataggccagtgaaggatgttaacttaggctctgatagcactgaattctatctccaagccaatgtcaaagctccccgcatgacaggaatcctggtcaagattttcacttggttcttggagtctccaatattgggatccttgctattttatatattgaagggaaacaatcttattcataagcttattacaaatgcagagttagaagagtcacccctctttgttccctcacatcattttgaaggttcgttattttccagtaggttctttccatcagaccacaaagagcaagaagtcaaatgcttagattctgctttaactccacaagaacaagttcaacttgcaatagagtgcttacctacatcttcagaaaaagcacataatgaaacaaacccttcgttctctcgttggaccataatggattattccagagcctacagttcgggagatataacaccactcatggttgcagaacgatttatagctgctattaatgaatcttcaaaacctccactccgaatgggattctttattaactacaatgctgaagatatactaagacaagcaaatgaatcaactcttaggtatcagaaagggacaccaatctctgtgctagatggagttccagttgctatcaaggatgaaatggattgtttgccatatccaactacaggaggtacaaagtggttgcacaaagaaaggctttgtacagatgatgcttgctgtgttaagcgtctgagattatgtggtgccatacttgttgggaagactaatatgcatgaacttggggttggaactagtggcatcaatccacattatggggctgctagaaacccatatgatatcaataagatttcaggaggttcttctagtggatctgctgctgtggtgtctgcagggttgtgccccgttgcccttggtgttgacgggggaggttctgtgaggatgcctgcatctctttgtggtgtagttggtctaaaaccaacttttggccgtgtacctcattctgggtggctattggtggagaaatttcatcccatcagtcctctaatatgctttgatgatgtcagattatgctgctcccatgccatgagaaagcttcaggatcattatggttggaaggaagaaggacttacaggaggaagaggcaagaatgctgagctggcaggaacattcctaaccaattctgttattgtaaagattcctagaggatcaggaaatcacaattctgttagtagaaggcactatgtatatagctatgtaaataacagcaaaggaatgagaattataatccttccttatctttggcttttcttctttagctttccttctcttcctcatggagaccctgaatttggatgggacgcaagggtagcacttaatatctacggtgctttcagtggcaaggagtacattaaagctcagaaactgaggaatcgccagttgcagtttcacatgaaaatatttgctgaggcagatgtcattgtgtcaccaacaacaggtgtgactgcatactcgattcaagatgatgcactgaagactggtgaacttgactacgtaaatggagctgcacttgttcggtattccatatcaggaaacttcctaggacttcctgctgtaactgtaccggtatga

SEQ ID NO: 59754 - DNA, 1509 bp, Glycine max
  Peptide Sequence Number=SeqID_151439
gttgcaagtcttagaggatctttaagtagcttccaagagcaagcaagttgtaaaacaaaggttccttcagtggaagtacctttcagtctctgtcttccttttaaccttaaaacacacctttctctcccacttaagataaagtaccacactcctgaggaggaaatagcatttggacctggttgctggttatgggactacttaagaagaagtggagcatctggttttctgcttcctctttctggtggagcagacagttcctccgtcgctgcaattgttgggtgcatgtgccagctggttgtgaaagctgaattagctggagaagtggacctgaatattcatagttcctttcttgaaaatcctgctaagttgcttgaatatagagcatggtggcctcttattacttcagagtgttcaacttgcaaagaagctaaactgtcaactgatgaaattgcaaatggggacgagcaagttaaagctgatgcaatacgaataggaaactataaggatggcctgtatcctacagacagcagagaatttgctaaacgaatattctatactgtgtttatgggatctgaaaacagttccgaaatgacaaggtcacgagccaaggtgctggctgatgaaattggttcatggcaccttgatgttagcattgacgtagttgtgtctgcttttttgtcattgttccaaacacttacaggaaagcgaccacggtataaggtagatggtggatctaatgttgaaaatttaagcttgcagaacattcaagctcgaatcagaatggtgctagctttcatgttagcatcactcttaccttgggttcacagcaagcctgggttttatcttgtcttggggagctccaatgtggatgaagggttacgtggttacttgaccaagtatgattgcagctcagcagatataaatccaattggtagtataagtaagcaagaccttcgggcattcttgcaatgggcagccatccatcttggttactcatctttggcagatattgaagcagctccacccacagctgaactggagcctatacgttctaattacagtcagcttgatgaagtcgatatgggaatgacttacgaggagctatcagtttatggaagactacgaaaaattttccgttgtggtccagtttccatgttccagaatctatgctacagatggggtgcaagattgacaccatcacaagtggctgaaaaagtaaaacacttcttcaagtattattctatcaatcgacacaaaatgactgtcttgacgccttcctaccatgctgagagttattcaccagaggataataggtttgatcttcgccagtttctctataatgcaagatggccatatcaatttaggaaaattgatgaacttgtaagtgaattggatgttaaagatgttaaagattcaggagaccatgaggcaatggcagctacatctgatggtgttggtgggatgggagttgccgcagctggttcaggcaatcctaatgttggattgtaa

SEQ ID NO: 59755 - DNA, 2274 bp, Glycine max
  Peptide Sequence Number=SeqID_151440
atggcaaaaaaaggtgggaaacattgggagccgatgaaagtggagagaaaggaatctgattcgtcggaaatgaatgtaatgtttgcgttaacacggaaagactcaaagtattcctgtggatgcacagtgcagactgaacaaacaaacaaagcgaagatccctatgaatattgtttcgatttctggatcaagctccaattttgaacaagacccagaggtgggaattggggaaaggtgggatatggaagaggaagaggatcaattctacgaaactcgtgaggaattgtgttctgtgtctgatgggggttcggattgttctgaatcagatgaatctagttctggtaataacggacatgttactaggtaccaggtttgggcacaaaaccttgaaagtgttcaccagagacgcctcaatttcctgagatggatgggtttggagtctgatttgaattattcaatgaagggggaggagttgggagatcaaccttgtgggattgaccgaatcactgcaacaagtggggcagtgctgagaacttcttttgctattgaggagggtcttccctcaacctcaaaccagattgtgttggattccttgtctgatgaggcctccggctcgcaagaaaatcgtgaaaatttggcgtgtatgataaggaatttggatgatggaacggagtatattgtggataagctgggtcaggatggagctcctagcacactgcgtgttttgggttcgaaccaattgattagcttagaggagtttcagaaaaatattgggccatcgtcgttcattcgcagacatttgcagagagacactgaaaacacaaggttgttgggagttgggaaaaggaaaatgaagaggggttggctaaggaaactggattctattgcttgttttgttcataatcatgggtttgatgaaactaaatgcaaagactgtgattcagtggataggagtgggatacaaagagttcgagttcattcgtataggaagcggtttaaggagctttcctccctttacaccgaacaggagtttaaagcacataaaggtgttattttgacaatgaagttcagtcttgatggaaaatatctggctagtggtggtgaagatggtatgaagttagttaaaacagagaagttgaggagatcatctgaagcaacctgtgtgattgtcccaccaaagaccttccgcatatcagcaaaacctttgcatgagttccaagggcacagtagtgacattatagaccttgcttggtccaaaagagggtttctactgtcatcctctgttgataagacagtgcgcctatggcatgtaggaatcgacagatgtcttagagttttctaccacaataattatgttacatgtgtcaatttcaatcctgtcaatgataattttttcatcagtggttcaattgatggaaaagtgcgcatatgggaagttgttcactgtagggttagtgattacattgatatcagagagatagtcacagctgtgtgcttccgccctgatggaaagggcacaattgtgggtaccatggcaggcaattgccgtttctatgatatcgtagataatcatctgcaattggatgctcagttgtgtttacgaggcaaaaagaagacatcagggaaaaagatcactggctttcagttttcacctagtgacccaagcaaactattggttgcttctgctgattcacatgtctgtatactttctggagttgatgtaatctacaaattcaagggtctaagaagtgcaggtcaaatgcatgcttcattcaccaccgacgggaaacatatcatctcagttagcgaggattcaaatgtatgtatatggaattacactggccaagatagaaatacctccaaagcaaagaaaatttggtcttcagagagttttctctcccacaacgcagccatcgctgtaccttggtgtggcattgaatcaatgccaggaacactcttatccccatcgctaggagaggatgtaaatcagaggtgttctctgccttctcctgattgcttcttcttgagtcgcggatttctgtctgagttgatcccaaaggtttctgcaacatggcccgaggagactcttgtggactcatcgtgtcaaactcaaactgttgtttctcctacaatgtgtaaatcagagtacaaattcttgagaagtgcttgcaagggaatgtctaattctcacttgtggggccaagtaattgtgacagcaggatgggatggatacataagagtgtaccagaattatggattacccgttcgtggctga

SEQ ID NO: 59756 - DNA, 417 bp, Glycine max
  Peptide Sequence Number=SeqID_151441
atgctggagatgtctggaatgatcatgatcatgatcattagcctgatgggaatttcgtggataaggcaccagcaagccgaggctctatgtatgagggttatgataagagaagagcctccgtcatactcatcctctgtcatgcaaagacacgagtcatttgagaacccccttgcagggaatggattgcacagttttgggtctcaagatgatgagcgagcttcatctggaaatcctcaacatggaagtgcactttatgacttcacagcaggaggagacgatgaattgagtttaaccgcaggagaagaagtcgacattgagtacgaagtagatggctggttttatgttaagaagaaacgccctggtagggatggcaagatggctggactggttcctgttttatatgttagtcaatcttga

SEQ ID NO: 59757 - DNA, 384 bp, Glycine max
  Peptide Sequence Number=SeqID_151442
atggcaatatccatgatgatacattgcttgctaaacttgagactgtttgtccttaacatggaaaagggagttccacttttgcctaaatggttatccttctctagggtgaatgcacgtgcctggacgggcgttgagataggtcctgctcgccttcatttaagcttaagccagaagctaggggtccagattgtgctttgttggaccaccagttgttggaaagacatcactggcatcctctatagttgctgcacggggtgtaaaatttgtgtgcatatccctagtggagtcaaggatgaggctgatattagaggacataggagaacatacattggaagcatgcctgggaggcttattgatggactgaaggttcagaatctaacttag

SEQ ID NO: 59758 - DNA, 759 bp, Glycine max
  Peptide Sequence Number=SeqID_151443
atgacaggaaccttgcaacacctatgtgatgtgaggaaagtgcctgggtgccttattggacttcctaatggacataccgccacatctactaaagaaggaacaataagacttgttggtggtttaagacttgaaaacgatcgcactttgaagatgttgattagagcgggtgaacgaagggatgtactctacttcttccgggaaattccaaaagtgaaggcttgcaaagttgaaggaataactcaactagaagtatggcacaagcgtttgagacatccatcttggcaaactactcagttaatctctgatggtagtaggaacagagaacacctcagcaaaatggcaaggttgaaagaaagcattgacatatcctcaatgtggcgtgagctttgtgatttcaaggaagtttacccattgaattttggggcgaattttctatttcatcacactgaaattgcatcaacttcctcaatctccattattgatgaagctaatctagagaatcaaattgacgacagaccagccaatcaaaatgagtcgctcgtagaacagattcttgatgataaggggggtactgacactaccgaagttgttgtaacagatactactgtgtttccagaacctccagatatacagatcccaaacactcataatgagaatgaaccactaggacgtggctgtcgtgtcaaatatccatccactcagttgcaagactacgtcatacacacgattcaaaagttaagtccttatattcgttcataa

SEQ ID NO: 59759 - DNA, 3186 bp, Glycine max
  Peptide Sequence Number=SeqID_151444
atggagatagagtcgccaacactgggaaagcgaagagaacccgagctcccagtaacagagaccacttcaatgccgaagaaagctcgcagttcggaacgcacgtgcgtgcacgaggtggccgttccgagcagctacgtctcgagcaaggacgaagagctccacggaaccctctcgaaccctctccacaacggtcccatggctaagtcctatcccttcaccctcgaccccttccagcaggtctccatcgcctgcctggagcgcaacgagtccgtcctcgtctccgcccacacctccgccggcaagaccgccgtcgccgagtacgccatcgccatgtccttccgcgacaagcagcgcgtcatctacacctcccctctcaaggccctcagcaaccagaagtaccgcgaactcagccaggagttcaccgacgtcggcctcatgaccggcgacgtcacgctctctccgaacgccacgtgtctcgtcatgaccaccgagattctccgtggaatgctctacagaggatccgaggttttaaaagaagtggcctgggttatatttgatgagattcattacatgaaggatcgcgaacgaggcgttgtttgggaagagagtataatctttctgccaccggcgattaagatggttttcctttcggctactatgtccaacgccaccgagtttgctgagtggatttgtaatattcacaagcagccttgtcatgttgtgtacactgattttaggcccacgcctttgcagcactatgtgttccccatgggggggagtgggttgtatttggttgtggatgagaatgaacagttcagggaggataattttttgaagctgcaggatactttcacgaagcagaatttaggggatgggaagaggggtgggaaaggcgctggaagaggtggtaaaggtggcaatgcctctggtggttctgatatttacaagattgttaagatgatcatggaacggaaattccaacctgttatcatctttagcttcagtagaagagagtgtgaacaacatgcaatgtctatgtccaagcttgacttcaactctcaagaagaaaaggatacagtggagcatgtttttcaaaatgcagtgctctgtttgaatgaagaagacaggaacttacctgctattgagctgatgttgccacttcttcagcgaggaattgctgtccatcattctggacttcttcctgtcatcaaagaattggtcgagcttcttttccaggaaggtcttgtaaaagccctcttcgctactgaaacatttgcaatgggtttaaatatgccggcgaaaactgtcatattcactgctgttaagaaatgggatggtgatagtcaccgttatattggatctggtgaatatatacagatgagtggaagggctgggcgtcgtggcaaagatgaacgtggaatttgtatcataatgatagatgaacagatggaaatgaataaccttaaagacatggttttgggtaaacctgctcctttagttagtacattcaggcttagctactactcaattttaaatttgatgagccgtgcagaaggccagttcacagccgaacacgccttaccagatatggagaaaagggtgtcaaagctagagcaggaagtagccttgcttgatgcttcaggggaggctcaagtatctgaatatcataagctaaaactggaaatagcacagctggagaagaagattatgtcaaaaataataaggcctgaaataattctttattttcttgtccctggtcgattgatcaaagtaagagaaggtggaactgattggggctggggtgttgttgtcaatgttgttaagaaaccttctggtggtggttatatagttgatactttacttcattgttcacctgtttcaaatgaaaacagttctcggccaaaaccatgcccgcctcgccctggagagaaaggtgaaatgcatgtggttcctgttcaattaccattaatctctgcccttggtcaactgagggtatccatacctcccgatcttcgacccttggaagcaaggcaaagtatattgcttgctgtacaggagctgggcaaccgttttccccaaggtcttccaaagcttaaccctgtaaaggacatggacgtacgggactcagaaatagttgaactagtgaatcaagttgaggaacttgagaaaaaattgttcactcatcctatgcataagcatcaagatatggatcaaattaaatgctttgagaggaaagcagaagtgaatcatgaagttcagcaactgaagacaaaaatgcgggattcccagctacaaaaatttcgtgaagaacttaagaatcgctcacgagtcttaaagaaacttggtcatattgatgctgatggtgtagttcagttgaagggacgagcagcctgcttgattgacacaggcgatgaactccttgtcactgaattaatgtttaatggtacttttaatgaccttgaccatcatcaagttgctgcccttgcaagttgtttcataccaggagataagtcaactgagcagatacaattgagaacagagcttgctaggcctctgcaacagcttcaagatagtgcaagaaggatagctgagatacaacatgaatgcaaattggatataaatgtgaatgagtatgtggattcaaccgtaagaccattcttgatggatgtgatatactcatggtcaaagggagcaaattttgccgatgttatacaaatgactgacatctttgaagggagtattattcggagtgctagaagacttgatgagtttttgaatcagtgttatcaaatggcggccatggcggaaaggcgtggcggatttttgaaaaaacgccaccgaatagcggtggcgtggtgggttgcgaatggcagcgccatggtgcgcagccctaccacaatggacagcacagaacgcagcccctcccacgctacccagccgcgaccctgcacgcagaacgtagcacaacagcgacgaccccgtgttccccccgcacgacccagcagcgacaactcgacgagcaccacgcacacggcaacgacaacgacactacagtctgcgacggatggcaacgtgttgcgtgctgctgctaatgcagttggagaggctgacttggagaagaagtttgcagctgcaagtgaaagccttcgacgaggtattatgtttgctaattctctgtatctgtga

SEQ ID NO: 59760 - DNA, 423 bp, Glycine max
  Peptide Sequence Number=SeqID_151445
atgagtcatcattcatctagtgtaatggcgaggagcctaagtgaagaacttcgtgactattatgaaggaaggcataggtcacatcttagacctcactcccataggagagaaaaggaaagaaagcctcaagaggctaacattaacctctcatacttccatgggaaggacaatatagaggcttacttagattgggaaataagggtagagcaacaacttaaaaagaagtctacttcaaaatcttatggctctcactcttattcaaagaaagaccaaggtcaaggcatcttaggggtgacaccttctaagcccaaagatgataaggaggcgataatagaaaagcaaccccttaccactagtgtgcaagagaaaactagctctataaagtgctttaaatgtcttggaagaggacacattaattcttaa

SEQ ID NO: 59761 - DNA, 633 bp, Glycine max
  Peptide Sequence Number=SeqID_151446
atgtggctgaaaggggcgaagacccttgtgtttctgtttggaaatcgcgatgaacgcgctaagtgcgcctgttgcgataagcctgttcatcgtagctatggcttcaaagaaaaaaaatcatttgtttcttcagcttcccaaattagatttgacagatcaagattccattcacaagaagcttgggacagatatactgacattattgttcctaagaagctgctgccagagaggaatgtggtaatctaccacactgagtttgatgagttcaaagaagaattggagagaagaaaatgggatgaggagttgaccagttttgatgaaggcaacattgatgttgccattgtgaaagagttttatgctaacctctacgatcccgaggacaaatcaccaaagcaggtgagggtcagaggttatttggtgaagtttgatgaggacaagttgaataccttcctgaagacccctgtgatcattgaggagggggagacattagcatcttattctaggtttgcactcttgaggtctgatcctcaagagttagctgctactctctgcgtcccatggaggggatttgagcttaatattgatggtcagcctctgaagatcctcaggaagaacatgaccacacttgcttag

SEQ ID NO: 59762 - DNA, 309 bp, Glycine max
  Peptide Sequence Number=SeqID_151447
atgcaaagaagatctactgcaggtgatttgatccccatcaatttggagattaacactacttgcaggaggtgtaacgcagagagaattaaaaaaattttgcaggacttagaagcagcagcaactccagaagaagtacctcgatcttccaaggcgtcttctagctttcctattccagggcaatctcatatagatttaattgaagaagttatcatggatgaagggccaaggagagtgaccctagaagattactcaagttcaagtgtgccacaatttttcaccagcattgcacaaccagaggttcaggcataa

SEQ ID NO: 59763 - DNA, 555 bp, Glycine max
  Peptide Sequence Number=SeqID_151448
atgcagtcgagtgatagaagcccaagtaagcctaaacctttggtgatccatttcaccagggatattactactcatatacctcgaggtttccagccctctatagcaaagacgccaacacctttcccttatacgagtgacaaggcagtaccatggaagtatggcgtacaggggcttggcggaaggaaggacacgtccgtcatacgtgttgggaatggcatgccggctactaagatcacaaatatttctggtacgatcagcatgactcatagtggacgtattttcactccttctgaactaccggcaaggtcgaaagacaaggggaagacaaaggcagatataggtgagagggagaggacgggccttaccgcgaatgatgaggcccttgttggaaagtttgcagaggaagcgcaagacatatcagtggagggttttgggggaatagtcaaaaacatcaccgtaaacaattacctgacttttgctgatgaggagattccagttaagggtaggggacacaacaaggttttgcacgtgtccgtcaagtgcatggacacatag

SEQ ID NO: 59764 - DNA, 293 bp, Glycine max
  Peptide Sequence Number=SeqID_151449
atgcataagttgcattccaaagttggtcctgaacctccaaagcacgaagacctctccgaaatcgcacacggtggtcaatgtctcagcatatcagtgttacagttgtggattctgcatctcactgatacaagtatgcgagcaggcaattctgatatctatggattcctcgagccacagtccattcagagcggacactggcagatggtggtcatcctgcccaaggaacacctagttgtctggttttgttcattgcataacatgctagacaactaccttaaggggattattaacag

SEQ ID NO: 59765 - DNA, 426 bp, Glycine max
  Peptide Sequence Number=SeqID_151450
atggtctctggtaatcgattaccaatggtgtgtaatcgattacacagagtaacaaggcactggtgtttgggagaccctcgattccgtggcacgattcgactcactgctacttcattagtacatccggaggaacctgcacacacacttcagcagcctgtggagtggatactacctacacctactccatatcgactagtggagccagttcaagtgatagaggtgtcatcctctgaagaagatcttgaagaggaccccgaggagttacttcctgaacctgctgtggatgcccctgacttcccagaggatgatgaggacccactccttgatgttgattctccagaggatgttatgtcagcatctgaggcagactctacagatgaaagtggccctggagggacagcgaaaagtgatgactcttcatcatag

SEQ ID NO: 59766 - DNA, 627 bp, Glycine max
  Peptide Sequence Number=SeqID_151451
atggatgaacctttcattatggccgaacaagccagacatgtgttttacatccaagatccatgcgatttaagatttttagtggttctacaaggaagaccaagtggtttcaatcaccgacatgatgattcaacacttgacatttgtgagacaccaacttttttccaaatgagtcacactacgttgatgatgtacacatatttccatttacctaaggtcatgagaacaccaccaccatcccttccgcagttagatgttcagtcagaggctatgtttaggaatactagacaatccacacagctaagaaggttgactttaagaaccttagatcagcccagaccaattgtaaacattgatgctgcaactgggcaaggaccgggctcacataaagagaagttccacaactatctaggggttgtagctagagaaaaaattccaattgaacataaaaattggaaagatgtaccggactcgctaaaggacctagtatgggatgacattttgatccacaaacttgggaggaatttgctgcaagccgcaaaacccctaattggcagggaatcaggaaaaacatgcaggaaattcaaaaatacaatgactgttcccatttactctctcgttgtgatatga

SEQ ID NO: 59767 - DNA, 654 bp, Glycine max
  Peptide Sequence Number=SeqID_151452
atggtcacgtccaacaccaacaacaccatcctcaaaatctccaaactcgcgatcctcctcgttttgttcgcttcagtctgcaacgtcgctatgtcggactccaccgccaaacccctcgaccagcacgccaccacgggctctgaccctactgcgccagcggttcacatcgtgtacaccgagagaccacagaacgaggagcctgaggcctaccacatcagaaccctcacttcagtccttggcagtgaggaggctgcaaaggaagctttgttgtatagttacaagtctgcagccagtgggttctcagctaagcttactccggagcaggttgaacagatttcaacttgtgcacaagcggcttactaccaagaagcgtgtagtgagttgggggattggtactctctcttgtcaccgtttcgtcactttgaagagaccattctgcacgtcatgcgtgattgccctttggctagccagggagcttacttgggtttatccttagcttgggacaagggggataaaaatttggaagtaaatatagattctctgaagatagaatgctatctttgtcatatttacagagaagctaatggatgtgcagatgctttggccaattatgcttgtgctatggaggaggagtatgtgattttggagcaataa

SEQ ID NO: 59768 - DNA, 762 bp, Glycine max
  Peptide Sequence Number=SeqID_151453
atggttaccaaatcagggatgaggactttactgaggcttggaggggttgatggggacccggtgctgagaggaacgagaagggctacgtacgtgtacttaaccacagagtggtacctgaggatatgtcgcggggggtcaggagaccttggggacgtcaggtggggtgctattgcccaaaaccaagcttgtccaatcccgacccaacccaggcatagtcagccagtgaaaacttgtgacgtacctaagcaggcgagctcctggcagtcaaccaataaaggaacaaaagtccacgaagcagggaggcttgtgtggcggctggccagctatctatcttgtgttttatctgaaaaattccctctgatcgtgatggcagtgcagttgatccatgatcgcgttgtgatggagtgcctagagggtgtttgggagaccctcgaatgcaatgagaggtgccgattccgtggcacagttcaactcactgctacttcgctacctgtggagtggatactacctacgcctactccatatcgactagttgagcctgttcaattgatagaggtgtcatcctctgaagaggatcttgaagaggacctagaggagttacctcctgaacctgctatggatgcccttgacttaccagaggatggtaaggacctgctccctgatgttgattctccagaggatattatgtcagcatctgaggcagactctacaaaggaaagtggccctggagggacagcgaatagtgacgactcttcatcatag

SEQ ID NO: 59769 - DNA, 459 bp, Glycine max
  Peptide Sequence Number=SeqID_151454
atggcttatgcttctaacaaccctcctcctcctctgccactgttgatgaccaatgaagtttcagtgcataatgcaactccagtgaaggcgatttcgatgaatgcatatgttgctacactgattgccacctataagagtattcattactcgacgtttgggacaattctattagagtatgaagcacacattgaaagatcaaggaaaagagccttaggttcaattaatctcactgaagtttgtaggctaaagaagaaaaggtgcaaaaagctgttgatgaactcgcttagcgaggcaatttggctaagcgagccttgttcgcttagcgaggcatccagctcgcttagtggatgcaaaaccctagaagaggataagttagagatctgcatgtttagcgtgcagccagcccgcccagtgaggatgttgtctcttgtcgcgcttagcgcacccactcccgcttag

SEQ ID NO: 59770 - DNA, 411 bp, Glycine max
  Peptide Sequence Number=SeqID_151455
atggcagcggaatggagaaggaagagagagaggagacgccacttcaaggagaagatgagtctagaagaagctcaccaccataggaggccatggataagagcttggaggaagaagaagatgaatgaagggagaggaagagaagagcacaaaattttgtgctctaaaagagctctgaaatctgaagattgcatcagtggtgaagacaacaccaatcttgtccatcaaaaatttgtggcgtgtagacgcaatagctttggtgaggaggttagcatgttgatgacgggatggaacatcttctatggaagatttggcaatgctggaatgcttcttgtagttccaggaaatgacttttggaccaaaagtatcaaatcctatggggaaaaatcttcacacaagaagattaagaagtga

SEQ ID NO: 59771 - DNA, 489 bp, Glycine max
  Peptide Sequence Number=SeqID_151456
atgatttacggtaaagttagtaagttatttgttgtcaggtggaaggacgtacttgacagcatatggcatttgattgacaaagatggaaattatcataacattgtctacaacaaagatttggaccaaccagtcattgtagcagggtggacaacactaagagatttttatcaactgaccgaatatcatctagtgtccttaactcattatgtgccaaattttgtcactttcaaggtttatctcactcagcaaaaagttagctacaacaatctagacgttccaagcagcatgtattattttcttaaatacaaaggttggactcatttgcatttggaggacattgcagaatatcggcttgtgttcaatcattggaggaagacacttaaaattggagctggatggaaacatttctgcgaaatcttgtccttgaccgctgacatggaaatagtttttgaattcattgatcctaccattaaccgtgcgcttttttga

SEQ ID NO: 59772 - DNA, 342 bp, Glycine max
  Peptide Sequence Number=SeqID_151457
atgggggggtccctttttgcatggaagccgccattacctttggcgataaagcatgacccaccagtggcaatggcgatacaagcgctaacgtggctgatcccgccattggcactggcgagacgagcttacgtggacaggtgtcgctggtcccattggcgagacacgccacgtgaagagcttgccgcaagtagtaatggcgatactgacgtggaggaagctctcgcctctctcattggcgatactgacatggaggaatcaaccatgcactgtttgcagtgttacataggctatggttgcagttacgcaggctatggttgcagttctgataagtgcagtgattag

SEQ ID NO: 59773 - DNA, 228 bp, Glycine max
  Peptide Sequence Number=SeqID_151458
atgacgtggaaacctcggacacatgcagctcccggagacgttcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 59774 - DNA, 351 bp, Glycine max
  Peptide Sequence Number=SeqID_151459
atgtgtaatcgattaccagaaacctataatcgattaccagtgaaaaatttcagaaaaagctttttgaaaagacacatctcttcaaaccattttgaaaaggcacgaagggcctatatatgtgtgtttgacttcaaaaagcaagagagagatattctaagagaacttctgatgcaagctccattggagcttcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 59775 - DNA, 138 bp, Glycine max
  Peptide Sequence Number=SeqID_151460
atggagatgcagcggaagacaaaggagaagaggattgcatcaaatcctaccccccaagagcattggatagaagactctaagaagattgggccagagatacaagagatgaccctagggttctcaagagccttaaggtag

SEQ ID NO: 59776 - DNA, 213 bp, Glycine max
  Peptide Sequence Number=SeqID_151461
atgggtttacatcattttggtatcagagccaggttcaagggtttttcaaaattgcttgggctgaaatttcttggtggtggtgaacatcaattggatagggcacaaagattcttgttggatgctctcaatgctcaaatgcaaagactattgagagagaacaatgaggagttgtatgaaagaattgagagattagagaatcgtgaaggtcattag

SEQ ID NO: 59777 - DNA, 480 bp, Glycine max
  Peptide Sequence Number=SeqID_151462
atggaacctgaattttgggataagaacccatttaaggcaacagccaaggcgttcccgacaggatttcacttcaaaccaactgccatcaacaagtcaagaaccttctatgaactgatactggttgactcgaattcagtgtctatcaagcatttcaaagacccaaaggatcagacgttgaacacttactcaacaatactgatcctaaaagttcttcaaccaagacattttggttcagacttaaacaaggggaaaaaaatttcagtaccatttgatcctgtaggttatacctattgggattatgttgatgcttggacaaagggcgatgtggggctcacgggtgcgtcttccaagggaggaaagtgtgtggagtcaccaccaacgtttattcaaggaacacttcagaaaaaccggaacgtgtggtctacgaactttaagtttgaaaggttcgggagttgtttttacgcacggggaaggtattag

SEQ ID NO: 59778 - DNA, 210 bp, Glycine max
  Peptide Sequence Number=SeqID_151463
atggctaggagactccaggaagattgggccaaggatgcaggagaaggccctaggattctcatgagccttaggacctcattctccctcttctatctctcaaaatctcattcccatctctccctctccctccactcatcttctcctaccttcaagctctattccatggcttcctatggtggtgagcttgttcttgactcatcttctccttga

SEQ ID NO: 59779 - DNA, 393 bp, Glycine max
  Peptide Sequence Number=SeqID_151464
atgcctgaggagagtgaagaggtgcaagctttgaaagctgagctcataaagacaagagtggtgaaggagaagctaaaggtgccagtcactagggtcaggaaagaatgtgatgagctgaaagatatcaacatgaccatggttgaagcgctagagcgggaaatgaaaaaagcccgaaaggaagacaataataagctcaaacttagaatggccgagagggacaaatcaaggatggaaagcttgatgttagaggataagttaaagagttatcagaggtcgaagagaagtttgacagaacagttgagcaaaatggaagaaaatatgttgataatcattgaccaatataaagagaagatggaactagctgctagtcttgggcagatgctggaagactga

SEQ ID NO: 59780 - DNA, 153 bp, Glycine max
  Peptide Sequence Number=SeqID_151465
atgcaagagaagtatagcaaaggaatggtgaacatagacatcgaagggatgttgaagcagcaacctgatgacgggggtgttccgaagatgaaaatacaagggctaaaaaatcctacattactagggtaccctccctacactatggagccctaa

SEQ ID NO: 59781 - DNA, 336 bp, Glycine max
  Peptide Sequence Number=SeqID_151466
atgaataaagaaggagttggaaaagaaaacgagaaaaatgatgaagtggtgaccagtgaaaaagtggtaagtgaagaagggaagaagaaatcaaatgaacaaaccactaataaaggtaaagctatagtaaaccatccacccattgagcatcttccttatccacatgctccgtcaaagaaagataaggaaagtccaatagctattaaggtggttggcccttttttcttgactcaaattcttcaagagatggcaccaatcctccttccaattccctatatggcaacccacaaacaaggaaacaaagagacaagcaataaccaaagaccaaaaaaatga

SEQ ID NO: 59782 - DNA, 222 bp, Glycine max
  Peptide Sequence Number=SeqID_151467
atgtctggtgcttgtgcttataaaatggatgagaaaatgggcactaatagtcaacaagacactcctgataccccttctagatcagccgattctctgcctattctcaagaaacatttcatacttgacaaagtgatgccaaaatacttccaatctcctatgaccagtgcttttattcctaaggatggatccctaatgttacaacatagaaaaatatgtgcatga

SEQ ID NO: 59783 - DNA, 270 bp, Glycine max
  Peptide Sequence Number=SeqID_151468
atgtgggacatgctgaccacaacatataaagggatgtcacaggaaagtgaagacatgaagttgtctagaaaacaaagaaagttccatcatctaaggaatcattatcgagatctagttcaaagatgtatcccaagtgctgagtatggaaaacgttttgatgaaaaatgtgatgaggatgatgagttggctttcatctcgaggaagattcaaaagatgcggaagaacaagagtgagtatagatggaagaactcctccaagaaggtgttttaa

SEQ ID NO: 59784 - DNA, 375 bp, Glycine max
  Peptide Sequence Number=SeqID_151469
atgaagagagaatctcctctatccctgcattacaaactgtttgaggggacacatgtcccagacattgtctcgacatcagggaaagctgctgattcaggtgctgtgtccaaggatgctttgattgctgaactcaaggacacttgcaaggtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgagaaagaagaagaagctgctgaggaagaggaagatgcagcagaggatactgaatcagatgatgattctgaagccaccccatga

SEQ ID NO: 59785 - DNA, 126 bp, Glycine max
  Peptide Sequence Number=SeqID_151470
atggagcagccaaagatagtggaggtgcagtcagagaaggaggggagagttggaaggataaagtttcagtatgaaagggctaaggcgaacaagctaggtcattacatggtgttgccagagagttga

SEQ ID NO: 59786 - DNA, 495 bp, Glycine max
  Peptide Sequence Number=SeqID_151471
atgggatttcctggtggacccagggacccatgggtgtcatatgatgacgtagacgatacgtggatgcactactcaaaccatctggatgcagcaggtgattcatgtgttgtgccaggtcaatgtgcgcctgactacatagactggttctttcgtatttctcatccattcatgaccgcgacacaaccatcggatcctccggcagatgcacctgctgcacaacctagacatgtccctcaggtcccagagtcagatatccctcaggtcccggatgatccagccaggtctgatgtcgatgagcccacacatgcagtggaggcttgcgatgcgatcgccgagaggttggagtgtcacctcaggctaggggtactcacgccaggcacatcgacacatgaggtcatcgaagaatgcctcaacattgccaggagtgtcacccaagaccgcattgtgtacgtgaggtctcgacgcaggcacctattagtcgatgaatacggctaa

SEQ ID NO: 59787 - DNA, 183 bp, Glycine max
  Peptide Sequence Number=SeqID_151472
atgaaggcgatcctcggctatcaagatgtcatggacatcatggaagaaggctacctaagccttcctgaaagggccacagaggcacagaaagctatccataaggagaacaagaaaaacaaagactttgtgatcgaggccgtacccgaatcaaataaacatgaaaatgcagtaactaggaagtga

SEQ ID NO: 59788 - DNA, 492 bp, Glycine max
  Peptide Sequence Number=SeqID_151473
atggcgaggccagctgagcttccttccacatcttcagctcctactccagcatccacttcagtagctccttcagtcccagctcagagtgattctcagcgctttgaagccatgcttcggagaattcaccacgaacagattattttgcttcagagtttacaggtggtggcacctccaggatccattccttccgttgagcagtttatggagagggtagcctggcctggggcccaaccttctcttcacagggaagatgaaggtcccatagcccaggccaccattccagagccattcattgtagaagaggaggcaggtgagacacaggttagacaggaagctactgctactcctgagagatctcttgaagacacttcagagcctcctgcaccagtcctgactctgaacacttctcctccaactactccagtacttcatttgacagatgaggaggatgttcagacacaggacacacaggaccagtcacaggaattctaa

SEQ ID NO: 59789 - DNA, 303 bp, Glycine max
  Peptide Sequence Number=SeqID_151474
atggcttataggaaacacaagagtattggttcaagacccacaacacaatatgatacaaggagatttcactccttagattcttggaactggtacacagataatgtcctggggagaaacatcttaccagagaggaaggtggagctctaccacaccgagttggatgattttaagactgagttggagaggtgtaatttccataaacgcctcaccaatttggtcaatgggagcatagatttggctttggtgaaagagttttatgcaaacttatacagctctgagtgcccttcaccaaagcaagccaga

SEQ ID NO: 59790 - DNA, 969 bp, Glycine max
  Peptide Sequence Number=SeqID_151475
atggctacgcaactttccgaccgcctcgagccatggcacaccctcgccggaaaagtcgtaatggtcaccggcgcctcctccggcctcggccgcgacttctgcctcgacctcggtcgggctggctgtcgggtcgtcgtggcggcccgcagagtcgaccgcctcgagtccctgtgcgacgaaattaacagcatggccgccggagacggtggccgaagccgccgcgccgtcgccgttgaactcgatgtcgctgccgatgaccccgccgtcgacaaatacgtgcagaaggcgtgggaggcgtttggtcacattgatgctcttatcaacaacgctggtgtcagagatattggtggtgccggcgacttggtcttcgagaaaaacctctctttgccattggataggaattcttggatccgggctgttggtattttttgctgcgaaggaattcaacaccaattggtggggaatgtcaaatcacctttggaattgtctgaggaggaatggaaccatgcgttcagaacaaacttaactgggacatggttggtctcaaaatatgtatgcaaacgcatgcgtgatgcacaaagaaaaggatcaatcattaatattgcttcaattgctggtttgaaccgtggtcaattgcctggaggtgctgcatattcatcctcaaaagcaggcgtcaatatgctaacaagggtcatggcattagaattgggggcacacaaaatcagagtgaattccatatcacctggacttttcaaatctgaaatcactgaaaaactaatggagaaaaattggttgaataatgtggccatgaaaacagtacccttgagaaaatttggcacttctgatccagcattaacatcgctggctcgttatttaattcacgattcttctgagtatgtgtcaggcaacaattttgttgtggatgctggagccaccttaccaggtgtgcctatttattcctccctataa

SEQ ID NO: 59791 - DNA, 393 bp, Glycine max
  Peptide Sequence Number=SeqID_151476
atgtcgacaattttagccgctactttcctttccatggaagtatgtcatgaaaagaagagagggacactacggtgttgcaaccatctattgtatgtttggatagtaactcatctatatgaatccaattacatgggttatgccctcgatcctctaagaagatttcatcgaatcccaatgaagaaacaacaacctaccgagtggaaaaaggaactctcaaactatgaagtcgaccatttttcatgggtatgcccttggtatcttccaaagcatataattttcaattgtggggagttttcaaacgtgtcattagtgggactaagaggatgcgtaacatatatcccaactaaggttatcaaactcgagaatttatgtaaattcatgagagttccataa

SEQ ID NO: 59792 - DNA, 174 bp, Glycine max
  Peptide Sequence Number=SeqID_151477
atgacaatctcgacaaacaattctctatttaagtggggtgggagtggtggcagtgatgatggtgacaataatggtggtggtggtggtggcattgacaatggtggtgggactagaatagtggtggcgacaatggtaattgtgacactctcaacccttacaaatataaataaataa

SEQ ID NO: 59793 - DNA, 835 bp, Glycine max
  Peptide Sequence Number=SeqID_151478
atggatagaagtatgatagatgctgccagtggtggagcccttggagacatgactcctgctgaagccagaaatttaattgagaagatggcctccaactcccagcagtttagcgccagaaatgatgccatagtcattagaggagtgcatgaggtagctacaacaaacccatctgcatcatttgaaactaagaagcttgaaggcaaactggatgcgttggtcaacttggtaactcagctggccttgaatcagaaatctgtacctgtcgcaaggcaaaatcaaccatcgcagagcaattatgacctttccagcaacagatacaaccctggatggaggaatcaccctaacctcagatggtctagccctcagcaacaacaacagcagcctgctccttccttccgaaatgctgctggcccaagcagaccatacattcctccaccaatccaacaacagcaacaaccccagaaacaaccaacagttgaggcccctccacaaccttccctcaaagaacttgtgaggcaaatgactatgcagaacatgcaatttcagcaagagaccagagcctccattcagagcttaaccaatcagatgggacaattagctacccaattgaatcaacaacagtcccagaattctgacaagctgccttctcaagctgtccaaaatcccaaaaatgtcagtgccatttcattgaggtcgggaaagcagtgtcaaggacctcaacccgtagcaccttcctcatctgcaaatgaacctgccaaacttcactctattccagaaaaaggtgatgacaaaaatctacctaacgatttctgtgcaggtgatcttcattccacag

SEQ ID NO: 59794 - DNA, 354 bp, Glycine max
  Peptide Sequence Number=SeqID_151479
atggtgaaagttggaacctcttacgtgccgggatcaacgtctcattttcgccaaaagttggcccagggcttcccggtatcaacaggtagacaccaggatttatttattctgcgaagtgtcttccgcacaggtgctccagtctgtttctatcagctgtccctcctgttcagctactgcggggtggtgcgtaaacggcaaaagcaccgccggacacagcgctggtcaagtgtagcggtctacgctgcgcgtaaccaactcttgacacccgccgcgcttaatgcgccgctacagggcgcgtcaccaaaacttcgtcctttcagtagcttacgcgcaactgattcggaagggcgataa

SEQ ID NO: 59795 - DNA, 812 bp, Glycine max
  Peptide Sequence Number=SeqID_151480
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggagacaaaaatagtgctcgcaaggccattctcgctagagagcgaatcagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59796 - DNA, 131 bp, Glycine max
  Peptide Sequence Number=SeqID_151481
atggcggaaccatcaaagaaacaaaagggttcttcaagtcggagtcaacggcattccgagactcaggaaatgtcgattccttcctctattccctctgcctcattgttttcatccgaagaacaacggatatg

SEQ ID NO: 59797 - DNA, 431 bp, Glycine max
  Peptide Sequence Number=SeqID_151482
aaatcagttggaaataatgcatacctacctatgttcggacgtcacagaccaactgatacttccgtagggggagatcggcattacggtcgctgggtgaggacgtctgcatgtctctttgcaaggcaggagtgtaagtcttctgatggcatagagtacgtgatagctcctctcggtgtattacaggcgcctcatcagggggccgtgataaaagaaactaccggccccttaaggccaggagtgcatagtcctcgtgaggacactgtagtccctctaaaggcgagggcgtgcagcactctgaaggtgagggcgtgtagccctacaaaggcgaggacgtgtcagtcctctaaaggtgaggatgtagtctctctgaaaggcgagggcgtgaagccctgcaacggtgaggacggtagtcctctggaaggcgaggacgt

SEQ ID NO: 59798 - DNA, 401 bp, Glycine max
  Peptide Sequence Number=SeqID_151483
atgcctgtggctcatggtggccaaacgcttgtcttctatgagattaagttgatcgaaacgtgcttgggcccacctgattcctttaatccggattccgccaagattcttaatgacgggacttccaccttaaacggttgcacaacctccattccatatactaatgagaacggtgttgccccggttgacgtgcgcactgaggttcacttcgttcatctttggtctgtagggtgtggaattgtgatgttggatcttaaactcctcgcacatttccctcatcatcttgttattcaagttggtgccattgtccgtgataatcttcctcggcaaaccataccggtagatgacctccctctttatgaacctgaccaccaaactcttggtgacgctagcgtacgacgtgg

SEQ ID NO: 59799 - DNA, 239 bp, Glycine max
  Peptide Sequence Number=SeqID_151484
acattgattccacaaaaacctggtgggcttcctgagtctcgccatgacaaaagagtgagaggtaagggttcaagaggacttcatgttatcactccaagtgtagaagattttcaagttgctcatttgtatgtattgaataatagtaatgaagttttgccatacatacttcaccatgaaggcttagtgaaggaaagtaatccaaaaatgttgaagaatagggtgttgaaagagcataacaa

SEQ ID NO: 59800 - DNA, 642 bp, Glycine max
  Peptide Sequence Number=SeqID_151485
atgaccaccctgactcagatctggatgactttgctgctcagcaacatccagcccagcaatcataattccgacctccccctgccgaagtgtcagctggtgtacgccatcctgacacggatgagcattcacatggctcagttaatcgctgatgccatctatctatttgcaggtatggcgcctaccagacaccttctggacccggataagtccaacaggtccctgggatttcccgctttgatcacaggactctgccagtcgttcggagtccccgtcgcacctagcaaggtaattcggccgcccatcacccgagcttttattgagaagtattgcacgcagagacaggcccagggggatgccccgcaggccgcagatgcgccgccacctcatcaggctggcccaactggatcatttgatacagagcagtatttgcggcatttgagccagggttttacttcttttctgtgccctactccggatcagttcagggcagaggtcgcatggcccggagattggcctgaggcccgggcaggagaagcaccagcagaggcaccagcaggggctcccgacgaggcagatgaggcccgcgaggacgaggagatgaccaatttacttgatttcttaggagggaacggagccacatga

SEQ ID NO: 59801 - DNA, 591 bp, Glycine max
  Peptide Sequence Number=SeqID_151486
atgacccaagaactggtagcctgcggaaacaccttacggttatctgcacctcgtcattcagtgaagccaagtatgattgatgagcaaaggccagtgtggtcatttgcaccctttccggaaatgtcagcatcttccggtgggaactttttcaagtctcacaagatacgtaggaacaagagccctttgtctgccgagggggcccatgcatgcggaggacaaaatttggtcatatctgcacccctttgccattcagacacagtcgtgtccgatggcacgcagagacaaaatttggtcattctgcaccctttgtcatccagaggcggcgggcccgatgacatgcggagacaaaatttggtcattccgcacccctttgccattcagacacagtcgtgtccgatggcgcccagagacaaaatttggtcattctgcaccttttgtcatccagaggcgacgggcccgatgacatgcggagacaaaatttggtcattccgcaccccttttccattcagacacagtcgtgtccgatggcacgcagagacaaaatttggtcattctgcacccttcgtcaatcgcggccgacaagcccgttga

SEQ ID NO: 59802 - DNA, 291 bp, Glycine max
  Peptide Sequence Number=SeqID_151487
atgtatacttatgtactagagactttcagtaaaattttcgagtcaatccaacggttaacgaattggaacgaaggaaatgttactgggtccatgatgattggatgtggaattacctggatgttggggaagcttgggaggatggatggggacccggggttgagaaaaacgaggatatgggctacgtgggagtacgtgagctcagttggaggtgggcaacaggggatggtgggtttatgcgcgatttgtggatgtggaaaacttgttgtgcaccatcgcccgaccgccacctag

SEQ ID NO: 59803 - DNA, 1167 bp, Glycine max
  Peptide Sequence Number=SeqID_151488
atgttccgtggccgtaacgaaggcattttacagctgtcgctcaacgccgatccgcagtttgatgaagcgccgcgcgaaagctacggtgaaacgctgatcgccgaccaccttggcctgcgcctgaacaacgcaccggccgacagctggcgcaaagccgtggtcagctggacctggcgcatcaaggtcctgctgcacctcgaaaccgaactgatgggcaccatccgcgaacgggcagaagacgaagcgatcaacgtgtttgcccgtaatctgcacgatctgctgatggcggcacccgccggcatgcgcgctaccatgggtctcgatccgggcctgcgcaccggggtcaaagtggcggtggtcgatgccaccggcaagctggtcgcgaccgataccatctatccgcataccggccaggcggccaaagccgcgacctcggtggcggcactgtgcgcgaaacatcaggttgaactggtggcgatcggcaacggcaccgcttcacgtgaaaccgagcgtttcttccttgacgtacagaagcagttcccacaaatcaaagcgcaaaaagtgattgtcagtgaggccggagcatcggtctattccgcttccgaactggcggcgcaggagttccccgatcttgacgtttcgctgcgcggtgcggtgtctatcgcccgtcgtctgcaggatccgctggcagagctggtcaaaattgacccgaaatcgattggcgttggtcagtatcagcacgatgtcagccagagccagctggcgaaaaaactcgatgcggtggtggaagattgtgtgaacgccgttggcgtcgatctgaataccgcttcggtggcgctgctgacgcgcgtcgccggcctgacgcgcatgatggcgcagaacatagtcagctggcgtgacgaaaacggccgtttccagaaccgccagcaactgctgaaggtgagccgccttgggccgaaagcctttgaacagtgcgccggcttcctgcgcatcaaccacggcgataatccgctggatgcctcaacggtgcatccggaagcctatccgctggtagagcgcattctcgccgctacggaacaggcgctgaatgaactgatgggcaatccgggtagcctgcgcgacctgaatgcgcgcgacttcaccgatgagcgtttcgggctgccgacc

SEQ ID NO: 59804 - DNA, 192 bp, Glycine max
  Peptide Sequence Number=SeqID_151489
atgatcacatatacatgttcggatgcaatcctccctaggaagggaccaatcactagaaccatgagcaagaggctccaagaagattgggctagagctgctgaagaaggccctagggttctcatgaaccttagggtagggtaccctagaaatataggatttttcagtccttgtatttttgggcacctagactag

SEQ ID NO: 59805 - DNA, 312 bp, Glycine max
  Peptide Sequence Number=SeqID_151490
atggctaccattgcattattgagtagatatggtaggtggtgtttggtctcggatgtgcagcaggctagttttgtggctgatttaggggcggccattgtggatgattgggtgttcttggctgacccgggaaggttccagattagtataccagtacatcttcaggtgattcttggggcaagtagtacccttgtacttatcaaaatccagcaccttgaaattcagaggaatgaccatgaggcactcttcctactgcaaaatgccagggttctgatagtgggcgatactgagggccccccaaagtgtttggccggg

SEQ ID NO: 59806 - DNA, 318 bp, Glycine max
  Peptide Sequence Number=SeqID_151491
atggggggtgcaaatagcaattttgaaattttgaaattgggccttccagagaattttcaaagctggatttcttctggaggaagcaacccagctctcctgggcgagctgggcggcaacctcctccccctttttcctataaataggctgaagggggctgttctaggggtcccggatccccctggtgatgtatttcagctgttttgggtgaaaaaaattgtttccgtgaagaaaatccagccgaggtgcttccgtaagcaaatccgtgaaggttttcctccgttatccaccgttcttcatccgttcttcgttcttcaatgg

SEQ ID NO: 59807 - DNA, 249 bp, Glycine max
  Peptide Sequence Number=SeqID_151492
gagcacaggtcgcttgagcaaacagacaaatggcttgcacccacttccggatttacacgtgattctcctcaaatttcagccagcctatatcaattagaccttgcaccttacgcttcagagccctacaatgctcaatggaacgccccggggcttctccgtgacaagcacacgttgcgttcgtgtcgtattcttggagaaatggaggtggtgtttgtcattggaagtgcggtaggtaggctttgtggttga

SEQ ID NO: 59808 - DNA, 388 bp, Glycine max
  Peptide Sequence Number=SeqID_151493
atgaggcttgtaggaccacccacccgacatcttgccggggtacttgacgctacttcaggagacgttcccacgtacttcccggtggttgacgtcgaaggcgcacatgaagggcatcacatgagcatcgagatttcatcgttccatggtcagctcagatggggtcctatgatcgttacagttcgaccggagagggtggtacgccagttcggttacatccagagcttccctccgccgcctgtatctgcggattacatggagtggtttttccgcatatctcaccctttcatgacaccgacccaggcaggtgaccagcagagggatgcaccagctgcagaccctgaggactacatacagccgcccagccctttttcaatgttcaagtacccat

SEQ ID NO: 59809 - DNA, 341 bp, Glycine max
  Peptide Sequence Number=SeqID_151494
gaaatggccccaaggaagcttgcctcaaagaggtccaggaaggacaaggcagccgaaggaactagttccactccggagtatgaaagtcaccgctttaggagcgctgtacaccagcagcgctttgaggccatcaggggatggtcgtttctccgggagcgacgcggcgccggcggtgggcatcactggttactcccatggccaatggatcccgtttgatgccgacactatcagccaactcctaggatatccgttggtgttggaagagggccaggaatgtgagtatggccagaggaggaaccggtctgatgggttcgatgaggaggccatcgcccagatgctat

SEQ ID NO: 59810 - DNA, 306 bp, Glycine max
  Peptide Sequence Number=SeqID_151495
atgggggcgtattctgtggatgaaaaattgttggtccatttctttcaagacagcttggccggggcagatgtagcatggtataccaatctggaagcttcccagatccgatcatggaaggacttggcaactgccttcattcgacaagatctcgcagcccaagtcgtacagcccatgacggagagggagatgatcacaattatggtagatacgttacccacgttctactatgaaaagctgataggctacatgccagctaactttgcggatctcgtcttcgctggagaaaggattgaatcaggactatga

SEQ ID NO: 59811 - DNA, 873 bp, Glycine max
  Peptide Sequence Number=SeqID_151496
ttgctgcgtgcgccgctggcagtggcgtgccgaaccgatcgctgtgcggcatcgctgccgttggcactggcggtacctgcgccggtggccttgacgtagcgggccgtgccatcggcggtcgccgcgaccgcatcgagctggccacgattgaccgcgtcggtgcgctcggtgccggcagcgacacgggtgatctgacgatcactgctcgcgctgccgaccgacacagtgttggcacggtcggcgaccgagcccgcgcccagcgcaacgctgcctgcggcactggcggtggcactcacacctaccgccgtggcattggcgccggttgccttgctgccgtagccggccgcggtacccaggcgaccgctggcctcggcatagctgcccagcgcagacgcaccatcggccgaggcattggcgcggaaaccactggcctgcgactgggtgccgctggccgtggcctgcgcaccgctggcggtactgtaggcgcccttggcctgtgcgccggcaccggtggcactggaaccgagttcgctggcgctggcgccactgcccacggctacgctgtcgacacctccggcctgcgccgcgttgccgagcgccgccgcattgttgccggtggccaaggcatcgaagcccacggcagtggcattggcggccatggcattggcgccgctgcccagcgcggtggcgccgttgccgatggcattggccgcattgccggcagccagtgcgttgtcgccgtccaccagtgcaccggcttcgccatcggcattgccgctggcctggaactgcaggctggtcttgtcggcgacgctggcgaccgcatccagctggcccttgttcaccgcatcgtggcttcgtgcccgccgcgac

SEQ ID NO: 59812 - DNA, 717 bp, Glycine max
  Peptide Sequence Number=SeqID_151497
atggttatgggagatttcatcagcagactctccttccccgaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcgccgcggagataccttacggttatccgcacccttttgtcatccagaggcggcgggcccgatgacaagcagagaccaagtttggtcattctgcacccaagatacgcggagataccttacgagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaa

SEQ ID NO: 59813 - DNA, 694 bp, Glycine max
  Peptide Sequence Number=SeqID_151498
atgggaaaccccgttaaaaaagatcaagaacttaggggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagcgaggaaaggcgaaacttgccaaggagaagttcacgttggccgctacacacattcggaaggagtgtgccgggttacgggaagagaatgcaattaccgcgagagcccttgaacaagagaccaagagggctcgcaaggaagagtatggccggaataaatttcgcggagctctatggggagttagttgcttgttcaaggtccaaaagaagcttgtctcagcgtttatgcgagacggagaccaacatgctagctatcatcgccaagtaccaagaagagttaggtctagccacggcccatgaacatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccgcccccgaagagattcatgggcttctcggctatt

SEQ ID NO: 59814 - DNA, 324 bp, Glycine max
  Peptide Sequence Number=SeqID_151499
atgcctcctcttctcttcattttcgtttttctctcttctcttcccaaagtcctttctttttctcgcagtgcaccaaacttgtctcagaaaaactacaatctcggacttattcaccgttgcatcgttgtaaaatttgagcaccatatttgcaacccaattcctagaattctaactgttgggaattgcaaaaatataacagagaaaaaggaatcacacgaagacagtaaaaatggagacttcaatcccttctccgtctctctgacgtttgggaactctatcggagcagtcggaggaaaaactagaggaatctcaaggaaccgttag

SEQ ID NO: 59815 - DNA, 801 bp, Glycine max
  Peptide Sequence Number=SeqID_151500
atgcagcaacctagagcaattgagcagcccgaagcttatgctgcaaacatttacaatagacctcctcaacctcagcagcaaaatcaatcacaacagaacaattatgacctctccagcatcagatacaaccctggatggaggaatcaccctaaactcaaatggtctagccctcagcagcaacaacaacagcagcctgctccttccttccaaaatgttgttggcccaagcagaccatacattcctccaccaatccaacaacagcaacagccccagaaacaaccgacagttgaggctcctccgcaaccttccctcgaagaacttgtgaggcaaatgaccatgcagaacatgcagtttcaacaagagaccagagcctccattcagagcttaaccaatcagatgggacaattggctacacaattaaatcaacaacagtcccagaattctgacaagctgccttctcaatctgtccaaaatcccaaaaatgtcagtgtcatttcattgaggtcgggaaagcagtgtcaaggacctcaacccgtagcaccttcctcatctgcaaatgaacctgctaaacttcactctactccagaaaaaggtgaatcttccactggtaattctgatttgcagaagcagcacatccctcctcttccattccttccaagagcagtttccaaaaaaaaaattggaagaggcagagaaagagatcttggaaacattcagaaaagtggaggtaaacatacctctgctggatgcaataaagcaaattccaagatatgccaaattcttgaaggagctgtgcactaa

SEQ ID NO: 59816 - DNA, 135 bp, Glycine max
  Peptide Sequence Number=SeqID_151501
atgccaaaagatagggggaggattgtcatcatcaaaaagggggagattgtagacaaagaatcaagtcgtgccgatgttttgatgatgccaaaagatcacatgcgtctcaaagatttattcaacacaaagcaatga

SEQ ID NO: 59817 - DNA, 768 bp, Glycine max
  Peptide Sequence Number=SeqID_151502
atgaagattgttatctcaattccattaatgaattgtgatttagccggaggagagcatcacaaggacagttgttatttttattctataaataactttgactggaaacaggaaccagtcatgtacgattaccatgagaaagaaagcccccctgatcttgaaattattttggcagacttcatgacataccaagctagatctaaaggttactgttattttatgcaacaacagggaactcaatttgaaaggaaccagtcttctgcaggttatcaatgggagtcataccggaaatctgattatcacaataaagcagaaggagttcttaatctggatgatctgttaatgcaattcaaagatactgtagagtcaatacaagaagcctttagaagaactgaaactcagattaaggaaaagcctgaagtctccagtactccagaatatccctacttggccactgttggctatgttggagggaaaaataaagatagattggaactcagcgtggaggatcaaaagatctcttttgacctctttaaggccatgaaacactcagatatgggtgattcctatttcgaagaagaagaggtggagcaggaaatagcattattagcctcaaccatggtactacagtctcctttggaaaaagaacctggctatgggagagattgcttagcttgtgatgaagagcttgatgattcaaaagacagttgtgttgaccaggtggcttttgaagaattggaaaaactgagaccagtaggtgggatcctctag

SEQ ID NO: 59818 - DNA, 132 bp, Glycine max
  Peptide Sequence Number=SeqID_151503
atggctacaccaatgagcactgcttgctatttagataaagatgaaaccggtcagtcaatagatgttaagcaatatcgagatttcaatcaaatcccaaacagtcacatcttagtgtcgttaaaagaatcataa

SEQ ID NO: 59819 - DNA, 1146 bp, Glycine max
  Peptide Sequence Number=SeqID_151504
atggccaatcaaggaaactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgatacatttgaccgaaggtgcgagaagagtagcgcacggatcatctgttgcttacccgccctctgtgtttggttggtttcacacttgttccaacaagacataagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaagggtaccccatgaggggagcaccgacggaagaaagcatgtctcctttccttgtgagggatctcggcgcacaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagaattttgaagcaccggaagaggacgaagaagtccaagctctcaaaagcgagttaggaaaggcaaaacttgccaaggagaagttcaagttggccgccacacacgctcggaaggagtgtgccgggttacgggaagagaatgcaattaccgcaagagcccttgaacaagagaccaagagggctcgcaaggaagagtatggccggaacaaatttcgcagagctctatggggtagcaatagtgaactcaagttgcgaagggaagaaagggaccagtcgcgagcacatagcatggttttgaaagaggagttagttgcctgttcaaggtccaaaagaagcttgtctcagcgcttatgcgagacggagaccaacatgctagctatcatcgccaagtaccaagaagagttaggtctagccgcggcccacgagcataggattacggacgaatatgcccaagtatacgcggaaaaagaggctagaggaagg

SEQ ID NO: 59820 - DNA, 144 bp, Glycine max
  Peptide Sequence Number=SeqID_151505
atgatacaccttgaaaggcttagggccccaatcaatgcatttagaatgcataatgatagggcagtgatcaaagatctgtcataccctaatttcgtccgaggacctttgcttgatgacatgcgacctttctttggtccttgtgag

SEQ ID NO: 59821 - DNA, 860 bp, Glycine max
  Peptide Sequence Number=SeqID_151506
cagcgatctcggccgaaggcagcgcctcaccctgcaggctggccgcagccgccgccaccgcctgccgcgacaccgccgccaaccgggacggcgcggccacggtcgagcgcgccagccagccgcgcagcgatcgccaccaggccggcgtcatcgccgcccgccctgtcgttgtggtgcccttgccgtcactgaccgccctgcctcttcacgcgaatccggccacccgccgtcgtcgcagcatcggccgcactttcatcttctttaaccggaaggtcgccgatgtcgacggcaccggccgggggaatggactagaatggcgccgcgcgacccgtccccctgcaccgacgacgtcgctttttttgttttgggaccctaccgttcactggccgttcgctgcagtggtgttctgccacaaccacgacgccggcctgaaggcgatcatcgccatccacaacaccaccctcggcccggccttgggcggcgtgcgcatgcgcccctacgccagcaccgacgaggcgctggccgatgcgctacggctgagccggacgatgacctacaagaatgcactggccggcctcaacgtaggtggcggcaaggcggtgatcatcggcgaccccaaagtggacaagaccgaggtgctgttccgtgccttcggccgttatgtcgattccctgggcgggcgctacatcactgccgaggacgtcggcaccgacgtcaacgacatggagaacatctacctggaaagccagttcgtgaccggcgtgcaccaggtccatggtggctccggcgatcccgctccgttcaccgcctacgtgcgctgcagcactgatggcgtcgatgcgcttcaagttcggccatga

SEQ ID NO: 59822 - DNA, 72 bp, Glycine max
  Peptide Sequence Number=SeqID_151507
ggcgacgcgagactcacgggggcatcttccaagaaaggaatactcgcggagtcgccaccaacgtttatttga

SEQ ID NO: 59823 - DNA, 345 bp, Glycine max
  Peptide Sequence Number=SeqID_151508
atggagtcaggtgacatgtgggggtatcgtatggttacccgcacctttcgtcaaccaggggcaaacgagcccgttgatgcgcaaagacaaacatcgtcttctgtagcttttgtcatccagggacagcgagtcatgtggcaggcggagataccttatggtcatctgcacctttcgtcaaccgaggggaacgaattcgacagtttttactctcgtcgtccagagacattcaagcccgacgacgcactagattcttctctggtgggcggggacgatcaagttcgatggcgtagggaagtgttgtggttgtcccactttatcgctttcaagacactgaagttttgttga

SEQ ID NO: 59824 - DNA, 533 bp, Glycine max
  Peptide Sequence Number=SeqID_151509
atgtccattgaatttaatgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 59825 - DNA, 654 bp, Glycine max
  Peptide Sequence Number=SeqID_151510
atgttgctaagtagcaatgtcatctatatctgtgtaagagtggtcatgttggtgcgcatgatccgcactcgtctctttacagcggcacgaatgaaatcttgccccggtatgcatagtagctgtgtaatagcctccctctctggttgtgctcgcacagttggccctcctccaatattagggggtggcccaggaaccgtgtggatatggagcccactgaaagtgaggacgcatagtcctctaaaggcgagggcgtgtagccctctgaagttcaagacgtgtcgcctttcgaaggcgagggagtgtagtcctatgatagcaaggacgtgcaatcctctaaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctcaaggcgaggacgtgtagtcctctaccggtgagggtagtagtacccaaggtgagggcgtgtagccctaccaaggcgaggacatatagtcctttggag

SEQ ID NO: 59826 - DNA, 480 bp, Glycine max
  Peptide Sequence Number=SeqID_151511
atggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggcccagggtgatgctccacaggccgcaggcgcgcccccaccacctcatcaggctggccaggctggggcatttgacatggagcagtatttacggcatttgatgagccttagcatgcagagccagggcttcgcttctttttcatgccctactccagaccagttcagggcagaggttgcatggcccggagattggcccgaggcccaagcaggagaggcacccccagaagctcccggcgacggagaagaggcccacgaggatgaggagatggccgatttgcttgacttcttgggagggagtggagatacgtga

SEQ ID NO: 59827 - DNA, 288 bp, Glycine max
  Peptide Sequence Number=SeqID_151512
atggctatagtcgttgccgcaagtaccgccactaaggtggacctaactcatccatttggcctcaatcaagtaaatcgtccagtctcggatatggtaggtcagggaggcgaagcattgggaagtatgggtggcctccattttgtgcaggtccctcaacccatgggggagacacataaagtaccccgagaccacactttagccgcattcgaacctcccctcggatatgccacagaggggcaagcatttggtggcatacccctgccaaacactttagagggccctcagtag

SEQ ID NO: 59828 - DNA, 141 bp, Glycine max
  Peptide Sequence Number=SeqID_151513
atggagagagctgcccagcagagacagtggctgacagcagagaaggagaacgcaggactggcggaggccatttttgatcaaaaagacgaagccctaacggagaacgagaagggaacgcaagagctggacagcaaaggctga

SEQ ID NO: 59829 - DNA, 546 bp, Glycine max
  Peptide Sequence Number=SeqID_151514
atggcacgcagagaccaagtttggtcattctgcacccatgatacgcggagataccttatggttatccgcacccctttgccattcagacacagtcgtgtccgatggcacgcagagaccaagtttggtcattctgcacccatgatacgcggagataccttatggttattcgcacccttttgtcatccagaggcggcgggcccgatgacaagcagagaccaagtttggtcattctgcacccatgatacgcggagataccttactggttatccgcacccctttgccattcagacacagtcgtgtccgatggcacgcagagaccaagtttggtcattctgcacccatgatacgcggagataccttacggttatccgcacccctttgccattcagacacagtcgtgtccgatggcacgcaaagaccaagtttggtcattctgcacccatgatacgcggagataccttacggttatccgcacccctttgccattcagacacagtcgtgtccgatggcacgcaaagaccaagtttggtcattctgcacccatga

SEQ ID NO: 59830 - DNA, 363 bp, Glycine max
  Peptide Sequence Number=SeqID_151515
atgcctccgaagatcgaggttcttcttctggagttgctgctgcttcaagtcctgcaaaaatttcctaattctctctgcgttgtgcctcctatctccaaattgatggggatcaaatcacctgctgtagatcttttttgcatacatgagaaacataacaacaattatccaattcaaaggaacaataaaatatgcagcggaagacaaaggaaaagaggtgagaagaggcaccatccgttaaggaataagccatggaataaggagcttcaccaccaagatgagccttggataagaagcttggagaggatgcttcaattgaggaaaagaaagagggagagaaagaaagaggggggagcacgaaattga

SEQ ID NO: 59831 - DNA, 642 bp, Glycine max
  Peptide Sequence Number=SeqID_151516
atggagggtgctaataccttcctcaaacgtaaatacaactcccgaacttggaatgttctttatgaccggtttccttcggtttttccgacgttttccacaaagaaacgttggtggcgactccgcacattttcctcctttggaaagcgcacccgtgagcctcacctcgctcgcccgcaaaagggtaggttgcgacagatggcttctaggaaacataaaagtattggttcaagacccacagctcagtatgacacaaggagattcttttccttagatgcttggaccagatacacagataatgtcctagggagaaacattttatcagagaggaaagtagagatatatcactctgagctagatgagtttatggctgaattggagaggcgtaatttccataaacgcctcaccaatttagtcgacgggagcatagaccaggctttggtgaaagatacctatgcaaatttatacagttctgaggaccatccaccaaagcagtccagagtcagaggtcatttggtgaagattgatgctgacagtctcaacatattcttggagacacctgtgatactgcaggttgcctacagactacagaaagatagaggttgccttatgcatacctggccgagggttcatcttgaactctga

SEQ ID NO: 59832 - DNA, 1971 bp, Glycine max
  Peptide Sequence Number=SeqID_151517
cgggcggatatccaggtgcagctcgcagcaggcgcagatgcggttggccgcgtcgccgccgctgatatggccgaaggttttgcgcagctccatcaggcggccgatggattcgtgcatcagatcgatggcgttgacgccgcgcgccggatcgctggagtggccggactggccgacgatgcgaatggcgttggccatatggcccttgtgtgcgcgcaccggctgcagcgaggtcggttcgccgatgatggcgaaatccggacgaatggcggtggaggcggcgaaataacgtgcgccggccatcgtcgtttcttcatctgcggtagccagaatgtacagcggcttggtcagtttgctcgcgtcgatatcgcgcaccgcatccagaataaaggcgaagaagcctttcatgtcggcggtgcccaggccgtagagcttgttgtcgtgctcggtcagggtgaagggatcgcgcgtccagcggccttcgtcgtaaggcaccgtatcggtatggccggccagcagcaggccgccgctgccttcgccgatgctggccagcaggttgaatttgtggcgcgattctggcaccggctgtacgtcgacgcgaaagcccaggccggcatcggtggcgctgatcgacttcgttgcgatcaacgcccggtacagctcaataaatggagtaagccgacgcgtaagggaacccgatacccggatgtgaaaggccacatgttgaatacgctgatcgttggtgccagcggttacgccggagcggagctcacggcttacctgaatcgccacccacacatgaacataaccgctttagcggtttcagcgcaaagtgcagatgcaggaaagttgctttccgatctccatccccagttgaaaggcatcgtcgatctgccgctgcagccgctgaccgacgtcgccaaggcggcgcagggcatcgacgtggtgttcctcgccaccgctcatgaagtcagccacgatatcgcaccggccttcctggcggcgggctgcgtggtgttcgatctgtcgggcgccttccgcgtgcaggacgccgatttttatagccagtactacggtttcgagcatcagcatggcgctctgctggagcaggcggtgtacggcctggcggaatggcagagcgacaagattaaacaggcgcagctgattgccgtgccgggctgttacccgacggcggcgcagctggcgctgaaaccgttgatcgaaaaacagctgctgaacctcgaccagtggccggtgatcaacgccaccagcggcgtcagcggcgccgggcgcaaggcctgcatgaccaccagcttctgcgaagtgagcctgcagccgtacggtattttcacccaccggcaccaaccggagatcgccgcgcacctgggcgtgccggtcatctttacgccgcacctgggcaacttcccgcgcggcatccttgaaaccatcacctgccgcctgaaggccggcgtgaccgcgcaggacgtggccgccgcctatcacgccgcctatgacgacaagccgctggtgcggctgtacgaccagggcgtgccggcgctgaaagcggtggtggggctgccgttctgcgacatcggctttgcggtgcagggcgagcatctgatcgccgtggcggtggaagacaacctgctgaaaggcgcggcggcacaggcggtgcaatgcctgaatatccgtttcggcttcccggaaacccatgaagaagcgctggagcgtctgtttaccgcgctggacagctaccggcagcagcatcagcgcccgctggtgatcgtgcacggcggcggctgcgtggtggacgaactgatgaagcagctctctttgccggtggtgaaaaagaacggcctgcgggtcacgccggccgatcagatcgacatcatcaccggcgcgctggccgggcaccgccaacaaaacgctgctggcgtgggcgatttaaacaccaaatcaacgccgtcggcctga

SEQ ID NO: 59833 - DNA, 129 bp, Glycine max
  Peptide Sequence Number=SeqID_151518
atgaatagcacaattgaaagctttttgaaaacaaaacttgctactggtgatgtgaacctgagtaggagtggatcgtttgatacaggctacggaggtttggatgacgccacttccggtgaaggaagataa

SEQ ID NO: 59834 - DNA, 1084 bp, Glycine max
  Peptide Sequence Number=SeqID_151519
gtttcctgctgaaaatatcaacattggttatgccggctatacccgtaatggccgtaacgttgagctggagtcgctgtctccgctgaaaggcacctataacccaggtaacggcgataccaccggtactttcgaatccggcactaatgaatggtatgacgtgatctacaactacctggatctggaaaaccagaaaggccgtaacggtttcaacgtctacaccgaccaggtcgctgatgctgattatctgtataacccggaatccaagctgttcatgtctctggatactccacgttcagtaaaagcgaagggcgaatatgcagcaagcctgggtctgggtggtatgtttacctggactatcgatcaggacaatggcgtgttgctgaacgcggctcgtgaaggtctgggttatgaaattgaatctgaagtcatcgatatggaaccgttctacttcgaaggcatcaacgtagaaaaagatgaatctgaagaagacgataaggcaactgatgtcaatcatgcgccaaaagccgctatcgagctgctggttgtcggcggttctaccgtccagctgtcaggcgcgaattcttctgatgaagatgatgatgaactgagctacagctggggcgtaccgtctgaaattaccgtcgcggataaaactgcggaagtgattgagtttgtggtgcctgaagtgagcgcgaaaacggccttccagttcactctgtttgtgcgtgactgctacaacgaaccttccactcagcaacgttttgtgctgacggcggtgccagcattagcctctcagggcgaacctgaaccggctgatgaagaagaagatgaaaccgacattattccggttccagacgaagatacaacaccggctgaagatgacgcctctgccgatgatgcggcagaccaggatgcgccacacgcgctgtgggatgctaacaccgtatacggcgcaagctggggtaccttcgaaaccgtgagctggaaaggtcacaactaccaggtgaaatggtggtcccagggcgaccagcctgacctgaactgcggtcagagcggcgcatggactgacttaggcgcttactaa

SEQ ID NO: 59835 - DNA, 228 bp, Glycine max
  Peptide Sequence Number=SeqID_151520
atggtaatcacatttggcacccgggtcataccatcttggggtagggtggctgaagacctcccggctcgtgccgggggccgtattgttgacggctggggcaggccatggataagcttgggctggcgttctctttgccgcgggcggtccttttacttgaggctccggatcgggaactgcagcccggctcggatccctgaaaaaatgtactgggggttgcggctgttatga

SEQ ID NO: 59836 - DNA, 870 bp, Glycine max
  Peptide Sequence Number=SeqID_151521
atggctccaagaaagctttccgcaaagagatctaggaaggacgccgcggctgaagggaccagcgccgctcctgagtttgacagccatcgtttcaggagcgcagagcaccagcaacatttcgaggccatcaaaggatggtcgttccaccgagagagacgcgtccagctcagggacgacgagtacacagattttcaggaagagatagctcgccggcgttggacgtcgctggtcactcccatggctaagtttgacccggatatagtcctagagttttacgctaatgcttggcccacggaggaggatgccctcagccagttcctggctgacccactagtgttagaggagggccaggagtgtgagtttagtcagagaaggaactgggccgatggatttgacgaggaggccatcgcccagcttttatgcataccggggccctgggatttccagccgttgatcatgggtctctgccagtcattcggggttcctatcacacttagtaaggcgcatggtgatgcaccacaggccacagacgcgccaccaccacctcatcaggttgacccagctgggtcatttgacatggagcggtatttacgacatttggttcgccagcaggcgaccaaccacagggggcaggtgcagacccatgagtgtctctaccagctcagccttagtctgcaaagccagggtttcgatccttttgcgtgccctactccagatcagttcagggcagaggtcgcatggcccgaagattggcctgaggctcaagcaggggaggcgcccgcagaggctcccgacgacatggaggaggcccgcatggatgaggagatgacaaatttactcgatttcttgggagggagcggagccacatga

SEQ ID NO: 59837 - DNA, 226 bp, Glycine max
  Peptide Sequence Number=SeqID_151522
atgaagagggcaatccctaaatcaaccacaaagtctgtctaccgcacttccaatgtgtcgcaacgtgccctttgcgggcgagcgagggtgaggctcacgggtgcgctttccaaaggaggaaagatgcgcggagtcgccaccaacgaaggtattagcacctctcacgtcgacaaaagcggggcttttgctcctacgtacactcctttggagaggaaatcagaccaac

SEQ ID NO: 59838 - DNA, 1020 bp, Glycine max
  Peptide Sequence Number=SeqID_151523
gaaggcaaggagggagttcttttcttgtgtggggactaccctaatgttccgttgatagggacgaggggttttattaactataatcccgcacttgccataagacagctagggtaccccatgaggggagcgccaatagaagaaagtttctcgcctttccttgtgagggatctaggcgcgcaaagtctcaaggtgatacaaagagtccacaaggcatggagaagtccgttgaggaaagacaaggagcttagaggcatccgtaatggcgtcatcggtggatatcatggatggctaagagttcacacgcgagggttagattggctctctaaattgaaagttatcgatgaggagaactttgaagctccagaggaagatgaggaagtccaagttctaaaattagagctagggaaggcaagactcgccaaagaaaaattcaagtcagctgctacacacatccggagggagtgcgccgagttacgagaggaaaacgcggccactgcaagagcccttgaacaagaaaccaaaagggcccgcaaggaggaacatggccgagagaaattccaaggagcattgtggggtagcaacaatgagctcaagctccgaagagaggaaagtgaccgaggagtttggctcaacacttggaaagccacagagcaaagcatgctagctatcatagggcagtacaaggaagagttgaaccagtctgtgacccatgaacaaaagctagtggaggattttgcacaagtgtacgctgaaaaagaagcaagagggagggtgattgatgcattgcatcaagaagcgactatgtggatggataggttcgccttgaccttgaatggaagtcaagacctcccacgtctattagccaaagcaaaagccatggccgaagaacagatgaaggccgatctatcagccttaaaagatcaaatggcttccatctcggaggtcatgctaaaactccagaaaactatagaggataaagccacggcaaccgcctctaatacaactagggaagcggagccg

SEQ ID NO: 59839 - DNA, 929 bp, Glycine max
  Peptide Sequence Number=SeqID_151524
atggccaagttcgatccagaaatagtcctcgaattttatgccaatgcttggccaacagaggagggcgtgcgtgacatgtggtcctgggtaaggggtcaatggatcccatttgatgcagatgctatcggccagctcctgggatatccgttagtgctggaagagggccaggagtgcgagtatggccagaggaggaaccggtctgatgggttcgatgaggaggccatcgcccggctgctatgtataccggggcaagattttgcccggactgctgcagggaggcgagtgcaaattatgcgcaccaacatgaccaccctgactcagatatggatgactttgttgctcagcaacatcctgaccaccgatcataattccgacctccccatgcctaagtgtatggcgcgcactaggcaccctttggacccagataagtccaacagggccctgggattccccgcactgatcacaggactctgccagtcgttcggagtccccgtcgcacctaccaaggtgattcggccgcctatcacccgggcttttattgagaagtactgtacccagagacagggtcagggtgatgctccacaggccgcaggcgcgcccccaccacctcatcaggcgggccaggctggggcattcgacatggagcagtatttacgacatttggttcgccagcaggcagccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagggacacccccagaagctcccggcgatggagaagaagcccacgaggatgaggagatggctgatttgcttgacttcttgggagggagtggagacac

SEQ ID NO: 59840 - DNA, 723 bp, Glycine max
  Peptide Sequence Number=SeqID_151525
atgttaattgggaggtcagtgcctaagattgaaggactggttgctgtcacaggattaagtccattgatcaggtgttcaattgtaatcggcgatcctggacttatatccgcatttgtggagatgtggcagagggagaccaacacattccaccttccaataggagagttgatgatcacactggatgatgtgttgtcactcctccatctgcctatcagtgacgccttccacagctttcatgctctttatgtggacaaggcgatatttttgttgatagagttgcttgaggtgtctgctgaggaggctagagccgagacaacacgatcacgcggggcatatgtacggctaggatgggttcgagacatctacgagatgagatgtcaggcacggcgatgggttgtagcagctcatgcttatctactgcacctggcttttcacgagctgggtcagagtggtggttatgcctggggagttgtcgcgctggttcatatgtatgaccagtttgatgaagcttctaggaccacgacacgtcagattggggggtacctgactttattacagtgctggatctatgagcactttccgagtgtgcatcagtgtgtcacagatgatgtgtacgaggagacgtccccacgtgcttcccggtggttgacgatgaaggcgcatatgaagggaattacaggagcgtcgtaccgggcacgttgtgatactttgacggtcacaaat

SEQ ID NO: 59841 - DNA, 186 bp, Glycine max
  Peptide Sequence Number=SeqID_151526
atggcagctatacaaatgaccagccttgtctctatgacgtgttgggcttgtttaagtctgcctctggtcatgggaccttcaaagagtgtgaataggaccaatagaatacactttgggaaatatagtagcaagcttagtgataatggagggttcaagttgctcaaaagtattgagtataatagctga

SEQ ID NO: 59842 - DNA, 213 bp, Glycine max
  Peptide Sequence Number=SeqID_151527
atgaaaggaaaagaaactcaaaatagaatgcccaggaatgacaaactagaagactcaagaataaggaactgcacaaaccattgtttgatggcatgcaacctttgtttgaccgcttcgaggtacttggcaccctttgttgcacaatacgtgaagtttcgaggcatgccggaaatcaaaaggaagcattgttacacaagccgtgaaattccgtaa

SEQ ID NO: 59843 - DNA, 471 bp, Glycine max
  Peptide Sequence Number=SeqID_151528
atgactagaggcaatccatctgacttacaaccctttgatcctgagatagataggacatttcacagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggattgattcatttgcttccaaagtttcatggccttgcaagtgaagacccgcacaaacatttgaaggaatttcatattgtctgctccaccatgaacccccagatgtccaagaggatcacatatttctga

SEQ ID NO: 59844 - DNA, 59 bp, Glycine max
  Peptide Sequence Number=SeqID_151529
gacgcacctagttgctcatgatcctgggaatttaaataaaatgagcacaagctcggaag

SEQ ID NO: 59845 - DNA, 257 bp, Glycine max
  Peptide Sequence Number=SeqID_151530
atgactgagacaagtatgcaagcggggaataccgatgtgtatggattcctcgagccacagtctatccagagatctggccaatcgcaatttgaatcagaaagttacattaagaactggatgcaaaattcaaaatgggatgtgtacctgtatggtgcatattggcaaatggtcgtcattttgcctaaggaaaatgttgtcatttggttttgttccttgcataataagccagacaactacctcaaaggcataattaacag

SEQ ID NO: 59846 - DNA, 390 bp, Glycine max
  Peptide Sequence Number=SeqID_151531
atggacattcagcagcaaggatcggatgagtgggaatggctaggagatcagtcaagaaattattcgacacgcagtgcatataatctgatttgggaagctactgcaggaggtcaacaagaggaatggtgtaaggaattatggaagataaaaattcctagtaagattgcggtttttgcttggcgtctgttaagggacaaattaccaacaaagaagaatctgcacaggagacaaatgcagattcaggatatgcgttgccctttttgcagaggtgctaaggaggaggcctacacaacattttctccagcatatcttcatacagacagaaggattaaggggcaagaggtggaggtattggtggttggcggtaacatgggctatttggaagcttag

SEQ ID NO: 59847 - DNA, 315 bp, Glycine max
  Peptide Sequence Number=SeqID_151532
atgaaacgatgtccatttacagctttgggttctatggccctaatcacatctatcccccacatggaaaacggccacgacgcggccaagacatttagaggcaggggcggagcgttgacattgtctgctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 59848 - DNA, 747 bp, Glycine max
  Peptide Sequence Number=SeqID_151533
atgtcgcgggggtcaggagaccttggggacgtcaggtggggtgctattgcccaaaaccaagcttggccaatcccaacccaacccgggcatagtcagccagtgagaacctgtgacgtacctcagcaggcgagctcctggcagtcaaccaataaaggaacaaaagtccacaaagcagggaggcttggtttaaaaattgaaacaaaacgtagagtagctgctggtaatcgattaccatttgtgttaatcgattacatagtgttatatgcagctggtaatcgattaccatttatgtgtaatcgattacacaatatcgcgatggtagcacagttgatccatgattgcgtcgtgatggagtgcctagagggtgtttgggagaccctcgaaggcaatgagaggtgccaattccgtggcatagttcgactcactactacttcgctagtacatctggagcaacccgcacgcacacttcagcagcctgtggagtggatactacctacgcctactccatatcgactagttgagcctgttcaattgatagaggtgtcatcctctgaagaggatcttgaagaggacctagaggagttacctcctgaacctgctatggatgcccctgacttaccagaggatggtgaggacccgctccctgatgtagattctccagaggatattatgtcagcatctgaggcagactctacagaggagagtggccctggagggacagcgaatagtgacgactctccatcatag

SEQ ID NO: 59849 - DNA, 264 bp, Glycine max
  Peptide Sequence Number=SeqID_151534
atgccgaaaatcaaaaggaagcattgttacacaatccgcccacttgggccttccagattgttcctccagaaggcgattgcttctggaggaagcagcttggctcgcctgggcgagctggatggcaagctcctcccctattttcctaaaaatagagggaggagtgaagaagaaaagggttcagccctcttggcatttcgtaatcacttaaaattagtgaggaaaattgtttccgtgaagaaaatccaagccgaggcgcttccgtaa

SEQ ID NO: 59850 - DNA, 510 bp, Glycine max
  Peptide Sequence Number=SeqID_151535
atggctttccaatcctttgaggtggtgagctacgcctcggtggaaccgagtccgtcgctaccttctctctccaacgcggccataatggtggcgcgtgttatgctcaggaacggatttgagcccggaattggtctaggcaaggactgcctcgggaatgccgatgtggtcgatatcaagggaaatccatacaagtatgggttagggtatgaacccgggatgccggggaggaggaacgtgccgtcaagatttcgggcggataaggtatggcccggccgtattagccagtgtttcaccagcgttggaatggtgtccgaagaggaggtggctgcaatagaagaggaatgtgagggtcgattctttgaggaacctaacaacgagggtttgacaatcgatttcgatcgagatataagccaaacgataaacgaggaagaggaagaggacgtcctgtcaccagagttggagaggttggtcgctcaggaagaacgtgaaatgaagcctcaccaagaataa

SEQ ID NO: 59851 - DNA, 543 bp, Glycine max
  Peptide Sequence Number=SeqID_151536
ccaagagaatggggcccgtttgcggatatactagctttgttgatttttgggattgtcctctttccaaatgtggacagtttggtggacttagccgcgattgatgctttcctcgcatatcaccatagcaaagagagtccagtggtggcaatcttggcagatttgtttgacacctttgaccggagcgcaatcgattggtttcctcgttggaaggaaggcaaggaaggagttcttttctcgtgtggggactaccctaatgttccattgatagggactaggggcacgcaaagtctcaaggtgatacaaagagtccacaaggcgtggagaagtccgttgaggaaagacaaggagcttagaggcatccgaaatggcgtcatcggtggttatcatggatggctaagagttcacacgcgagggttagattggctctccaagttgaaagttatcaatgaggagaacttcgaagctccggaggaagatgaagaagtccaagctctaaaattagagctagggaaggcaagactcgccaaggagaagttcaaataa

SEQ ID NO: 59852 - DNA, 369 bp, Glycine max
  Peptide Sequence Number=SeqID_151537
atggcattgcgcctttgcttaagcgcagcgcggatgtcgtcacatgaacaggcattgcgacagcgcagcatctgcgcggcaaaacacaggaactttgccaggcttatagttcactcaacaggaggaaatatgaaagaccgggcatatgaatccgtatccagcggggatgaggtttgctgcatcatcggtcaggcggttatcgagttaagcgatgaacagcagcctgtgaccaggtccaccctgtcgctgaaattactggcgatggccgaccgcgacagagatgatgaacgcgttctgctttactggattgccagaaaagccattaaccaacctcaccagctcaacatcggcgtcgggggctggcgctag

SEQ ID NO: 59853 - DNA, 1218 bp, Glycine max
  Peptide Sequence Number=SeqID_151538
atgacaacagccgttacccctaatcatcagcgtgtccgtatttttaccctggcaggcaccatcattacccagttcgcgctcggctcggtttatacctggagcctgtttaacggccagctggcgcagaagctggatgcgccagtcagccaggtggctttttcctttggtctgctcagtcttggtctggcgattgcctcctcgctggccggcaagctgcaggagcgctttggcgtgcgcaacgtcaccatcggtgcaggcattctgatggcgattggcttctggctgaccgcccatgctgacaacctgatgatgctgtacctgagcgccggcattctggtcgggctggccgatggcgcgggctatctgatgacgctctctaactgcgtgaagtggtttccggagcgcaaagggctgatttcggcctgttcgatcggcgcttacggcctcggcagtctcggctttaaatttatctgtggcgcgctgcttagcactcaggggctggaaaatacctttgtgatttggggtgtgctggcgatgacgatgattattgccggggccctgatgatgcgcgatgcgccgctacagcaggccggttcacgtcagcagcaggccacacaggagttcacgctggcgcagtcggtgcgcctgccgcagtactggatgctggcactgatgttcctgacggcctgcatgagcggtctgtatgtgattggcgtagcgaaggatattggtgaaggcctggtgcacctgagtacgcaaacggcggccaatgcggtgacggtaattgccattgccaacctgagcggacgactgattctcggcgtgctgtcggacaaaatggcgcgcatccgggtcatttcgctggcacagctggtttcgctgagcggcatgagcatcctgctgttcacccacatgaatgaaaccaccttcttcctgtcgctggcctgcgtggcgttcagctttggcggcaccatcaccgtctttccgtcactggtcagcgatttcttcggccttaacaacctgaccaaaaactacggcctgatctatctcggcttcggcatcggtagcgtacttggctcgctggtggcttcggtgttcggcggcttcaccgtgaccttcagtctgattatgacgctgctggtgatctcgctggtgctgtcgctcagtatccgtctgccaaatcgtcaaaacctggtcgcgccggtactgcataattaa

SEQ ID NO: 59854 - DNA, 841 bp, Glycine max
  Peptide Sequence Number=SeqID_151539
ctacccgattcacatctacggtgcggtgatagccggcgcgcaggtgcgctcggtgccgctggacgcgggcggcgatttcttcaatgagctggaacgcgccatccgcgaaagctacccgaaaccgaagatgatgatcctcggctttccgtccaacccgacatcgcagtgcgtggagctggacttcttcgagcgcgtcatcgcgctggcgaaacagtacaacgtgctggtcatccacgatctggcctacgctgacatcacctatgatggctggaaagcgccctcgattatgcaggtgccgggcgcgcgcgatgtggcggtggaattctttaccctgtcaaaaagctacaacatggcaggctggcgcatcggctttatggtcggcaacaaagagctggtggcggcactggcacgcatcaaaagctatcacgactacggcaccttcacaccgctgcaggtggcggcgattgcggcactggagggcgatcagcagtgcgtgcgtgatatcgccgagcagtataaacgccggcgcgatgtactggtgaaagggctgcatgaggcgggctggatggtcgatctgccgaaagcgtccatgtacgtctgggcgaaaatccccgaccattacgcgcatctgggctcgctcgaattcgccaaacggctgctgcaggaggcgaaagtgtgcgtctcgccgggcattggctttggtgactacggcgatacccacgtgcgttttgccctgattgaaaacagcgatcgtattcgtcaggcggtgcgtggcattaaagcgatgttccgcgccgacggtattttgccgggaacgcacgaaggtgccgacccaaagtaa

SEQ ID NO: 59855 - DNA, 739 bp, Glycine max
  Peptide Sequence Number=SeqID_151540
atgtcagaaagtcgcaccgccgagcgcgccgctcgcggagccagaaagatcaagctcgcgctgctgggaccggccttcatcgcggccattggttatatcgatcccggcaactttgccaccaacatccaggcgggggccgcgtacggctacaaactgctgtgggtggtggtatgggccaacatcatggcgatgctgatccagctgatgtccgccaagctgggcattgccaccggtaaaaacctcgccgagcatattcgcgatcgcttcccgcgtccggcggtgtggttctactgggtacaggcggagatcatcgccatggccaccgatctggcggaattcatcggggctgcgctcggctttaagctgctgctcggcatctcgctgctgcagggcgcggtgttaaccggtatcgccacgttcctgattctgatgctgcagaatcgtggacagaagccgctggagctggtgattggcgggctgctgctgtttgtcgccgccgcttatatcgttgagctgttcttctcgcagccgcgcgtcagcgatctggtggtgggcatggcgctgccgagcctgcccacttcggacgcggtattcctcgcggctggcgtgctgggcgcgaccattatgccgcacgtcatttatctgcactcggcgctgacgcagtacggtaataaaggcagcaaggcggagcgctactcctccaccaagctcgacgtggcgatcgctatgaccattgccg

SEQ ID NO: 59856 - DNA, 201 bp, Glycine max
  Peptide Sequence Number=SeqID_151541
atgacggtgaaaacctctgacacatgcagctcccggagacggtcacagcttgtctgtaagcggatgccgggagcagacaagcccgtcagggcgcgtcagcgggtgttggcgggctgcgcaactgttgggaagggcgatcggtgcgggcctcttcgctattacgccagctggcgaaagggggatgtgctgcaaggcgattaa

SEQ ID NO: 59857 - DNA, 351 bp, Glycine max
  Peptide Sequence Number=SeqID_151542
atgcccgcagatgcaccaccaccacctcatcaggctgatcctgcttggtcattaggcatggagcggtatctacaacacttggttcgccagcaggcggccaaccaccgaggacaggtgcagatacatgagtgtctctaccagctcagcctcagtcagcagggccagggtttcgttccttttgtgtgccctactccaaatcagtttagggctgaggtcgcatggcccggagattggcccaaggcccaggcaggggaggcacctgcaggagctcccggtgatgcagaggaggcccgtatggatgaagagatgacagacttgctcggtttcttgggaggaagcggagccatgtga

SEQ ID NO: 59858 - DNA, 348 bp, Glycine max
  Peptide Sequence Number=SeqID_151543
atgggtgaagtagaggaggtacaagggaagatgaaggccgacatggaggccatgaaagagaaaatggccacgatgatggccatgatgagcatgaggaagataatggaagccaatgcggttacatttgccgctaccagcactgttgctaaggtgaacccgatacccccatctggcctcaaccaaatgaatcatccaaccttagatatgcatgccttcccaccatatggcttgcctcccaactatactccacccaatgtggcatacactcccaataagaatgtcaataactccactcctatacccattgagagccaacaaccccaaaccgatcatgcacatgtctcttaa

SEQ ID NO: 59859 - DNA, 546 bp, Glycine max
  Peptide Sequence Number=SeqID_151544
atggaaacaattatccagaatccacaattgaattctgccgaattctatgttgttactgagcttattcctcaacaacaaccatcatctccacaaccttcatgtccacaactacaactaccgcctccacaacaattatcgtacaacaacatcgacctcaataattcagtatcttcatacaacaaccttgaatcacaagacccctttgacatttatacttcatacacacaaatattatcagagaacgattctttttttcatggccaacaaacctcctttgaccaacaaaatcatccttcatccccctttacgccaccttcacaactaccacaaacccaaacatcaaaccgagatgaacatcccattgctaacgaagatcccattatacgatttcatgatgaaaacatggatgagtttactgaggatgaggatcaacagttgtttgatcacatcaatcaccaaagtgatgaccaaagtgatgaccaaaccgatgacgagggtgttggcagaccaacgacacctccatcacctccattgcaatatcagtaa

SEQ ID NO: 59860 - DNA, 369 bp, Glycine max
  Peptide Sequence Number=SeqID_151545
atgggtgtaagcctcgctgctcggaaacacccagtgctgaccacactgagagacacgaaagcgcagcggtacgaaaagagaggtcgtgatgatatcatctacgtccgtaccgctcctcgtggagtagatcccgcatccaaccaagtctttgaccagggaacgggagaattcccactaccgctggaaggccagccgggccgtgagcgcggtgggaacgggcttcccaaaaagccagccccgggccgggccaacttcttgggttgcgggcggagaagagcggacgtggggactcagaccggggcgcagcattattccgctcatgctaagaagtttcttgactctctcactgatgattttgagcctgcttga

SEQ ID NO: 59861 - DNA, 162 bp, Glycine max
  Peptide Sequence Number=SeqID_151546
atggtggttcgcacttctgtaatactcaactccaaagagctgtatgacccacaatctcaggatcctgaaaggacatgggttgtcaatggccaaaggctaaaactgtatcatggaaaagaatttagcaggacacaggacactgttcatttgatcgccaagtga

SEQ ID NO: 59862 - DNA, 414 bp, Glycine max
  Peptide Sequence Number=SeqID_151547
atgttgaaaccatgctcgaaagttttcaacaacaagatcaaatgtcagttctggaattgtacatagaaaaggatgtgactggtggttctatgtttcattctgcaaattctcttacatcatgtggaaataatttatctaataataaggcgcaaccgccaagaaatgtgagcaatttacatggtgatgaagatgatgattatcttgtgtctaactcatacgttgaagagtctttagacaaagatgatagtgtttacggtatatctgatacagacgatgaagtcaccgacatgattcaaccagtaagaattgttcacccagcagaaggtgtagaaggaattcaaaatccattttggaatgatgttttgcgttataacaatatcaactggagtcatcctgatgaggaggacatttgcg

SEQ ID NO: 59863 - DNA, 354 bp, Glycine max
  Peptide Sequence Number=SeqID_151548
atgaccatgattacgaattcgagctcggtacccataaaaatagggcaatgttgctgtgctggttctcgcacatttgtccatgaaagcatatatggtgaatttgttgaaaaggctaaagcccgtgctcttaaacgagtagttggagaccctttcaaaaatggggttgagcaaggtcctcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 59864 - DNA, 174 bp, Glycine max
  Peptide Sequence Number=SeqID_151549
atgaagcataaactcaaaaacaaagggggagaatggaaatttataagttgtcatcttcaaaaagggggagattgtagaagcaagcttcatgatgaatcaagattgattcaaggagttttgatgataacaaagatgatgacaaaaagctcaaaagttaagaacacttcatgttaa

SEQ ID NO: 59865 - DNA, 630 bp, Glycine max
  Peptide Sequence Number=SeqID_151550
atggttaaggaggagtgtaaggaggtaagtgtctcctccaagaggttagctaagaaggaaagtcattttgaaataaagacaaatattaaagaaacttaccctcttagacaacctccacattttctcctttgtaaaaaggcacttgttagcattgccacacctcttaggcttgagtttattcctcaagtaaagaagttgttggataagggtttggtttgcaagagcttaaatccttgtgctttgttggtgcccaaaataggtattattaggcatcaaatccctatgataggtggtatgatgaatttgttgagtggtgcaacactcttttgtaaaatcactcatgcacccaacatcttcatgatttatgtacatagtgtctcattgggtaggaataatcaacatgaaaataaagaaaacggtatgttttattccattactttccttagctttttaaatagtgatcaagggcttcccatggaccctaagagaataaaggtcattcctgagtggcctactccaccaagtgttgaggaaagaatccatgagtttcaagaacctctggatttgaggtcaaatccttttcaaggggtagggaatgatgaaatcctacccctaaagggcattggatag

SEQ ID NO: 59866 - DNA, 1338 bp, Glycine max
  Peptide Sequence Number=SeqID_151551
atggcggatcagagccaggaacccggtatgaatctgacgcgtcgccgttttctggctggcgccagcgctctgatggcggcgccgctgctggcggggctgtggccgcgttcggcgctggcggaggccattagccaggcgatgccgcagtttatcgcattgcgccaggctgaaagcggtattctcaccggcgcccactggggcgcgtttgaagccatcgtccgcgacggcaaaatggttgacgttcgcccgatcaaagacgatccgtatcctaacgaactgattactatggcgccgtatcaggttcacgccgaaaaccggattaaatatccgatggtgcgtaaaagctggttagaaggcggggcgaaaaacggtaagccagagctgcgcggccgcgatgagtgggtccgcgtcagctgggataaagccctgcatctggtggcgggtgaaatcagccgtctgcaaaaagagcatggcccatcatctatttatgccggttcttacggctggaaaagcgtcgggatgttccacaacccgagaacgctgctgcagcgcatgatgaacctggcgggcggctttgtcggctattccggtgactactccaccggcgcggcgcaggtgattatgccgcacgtggtcggttccgttgaggtttacgaacagcagaccgcgtggccaaacgtgattgataacagcgagctggtggtgatgatcggttgtaaccccatgatcacgctgaaaaacagctggaacctgccggatcacgtcggccagacgggttttgaagcgctgaagaaaaagggcacccggatgatctgtatcgacccggtgcgcagcgacagcgcgcgtgagttaggcgccgagtggatcgccccgcgcagctacaccgactgcgcgctgatggcgggggtagcccatacgctgctggcagaaaatctgcataaccctgatttcctgaaaacctacaccgtagggttcgataaatttgaagcctacctgaacggtaaagaagatggcgtcgtcaaagatgccaactgggctgcggatatcagcggcgttgatgctgagactatcaagcagctggcgcgagatatggcgaagcatcgcaccatgatcatgggcggctggggcatccagcgtcagcatcatggcgaacaggcccactggatgatggtgacgctggcggcgatgctggggcagattggcctgcccggcggcggtttcggctttagctatcactactcttccggcggtagcccaagcgtgcgcggcggtattctggcggggatctccgccggtagcccaacgtcgccggcggcgaaagatattacgccgttcccg

SEQ ID NO: 59867 - DNA, 1260 bp, Glycine max
  Peptide Sequence Number=SeqID_151552
atggtctttatccgcccgaccattatccgggatgacgaggtgtatcgctcgctgtcacgggataaatacacgggtttcaaagagatgcagaaagagagaagcgaccagcgcagcggcaaactcattaatgtggatgatatcgacgcgctggatgaccgggcgtttaataacacgcccgcaatgcctgccgctaaaaaccctttcagcgggggtgaaacgaacaccacgcttgagcatatgcttgaggttgcctccgtggcgcgcgactgcacgcagtttacccggctcgcttcgcagcaatttacggaaaagctggagcagctctatcaaccttctggtggttcagcccagcttattgccgaagatatgaataattcggacgatctgagtgcgctttccgatgagatccccacgaatgaagacctgctcaacgagcagtccgacgcgccagtgatccggctgattaatgcggtgcttagcgaagcgcttaaggagcacgcgtcggatattcatattgaagtctttgaaacaacgatgagtatccgctttcgggtggatggtgtactgcgtccggtggttcaacccaataaaaaactggccgcgctgctcatctcccgtatcaaaattatggccaaactggatattgccgaaaagagactgcctcaggacggccgtatcaccttaaaaataggtcatcgcaacgtggatgttcgtgtctctacgctgccctcacagcacggcgaacgggttgttttacgtctgctggataaaagcagtctgcggctctctattgataagctggatatgtctgaagaggacatgcgcgatctccggcaccttatcgccctgccgcacggcattattctggtcacaggccccaccggctccgggaaaagtaccacgctgtatgcgcttctctccgcccttaatagtccggaacgtaacgtacttaccgtcgaagacccgattgagtacgagctagaaggcatcggtcagacacaggtaaatagccgcgtggatatgtcttttgcccgcggattacgtgcgattttacgtcaggaccctgacgtggtgatggtcggtgagatccgcgatgctgaaacggctcagatcgcggtccaggcctcgctgaccgggcaccttgttctttcaaccctccataccaacagcgccagcggtgcggtgacccgcctgcgggatatgggcacggaatctttcctgctctcctcatcgcttgtcggcgtgatcgcacagcgcctg

SEQ ID NO: 59868 - DNA, 222 bp, Glycine max
  Peptide Sequence Number=SeqID_151553
atgaggggtggaggttgcacagcaacttgcctgggcaagctgcttgcttcctccagaagtaacctagctcgcccaagcgagttggttacttcatccctaagctttctagtgggcctaagggctggaaaatgtccccaaagtgacccttttgcccctcttttgaacatttttcacatttccttccgaaacatcacaaaaccctatgaattgcacgacaattag

SEQ ID NO: 59869 - DNA, 201 bp, Glycine max
  Peptide Sequence Number=SeqID_151554
atgcccacttgggccttccaggatgttcctccagaaagcggttgcttctggaggaagcaacctggctcgcctgggcgagctagaaaatccaagccgaggtgctttcgtaacatttccgtaacgtttccgtgggtgatttcgcgaatattttcaaccgttcttcgacgttcttcgttcgtctcgttgtctcggtctcaatcg

SEQ ID NO: 59870 - DNA, 331 bp, Glycine max
  Peptide Sequence Number=SeqID_151555
ttttattgagaagtactgcacgcagagacaggtccagggtgatgcaccgcaggccacggacgcgccgccacctcatcaggctggtccaaccggattgtttgatacggagcagtatttgcggcatttgagccaaggctttacttcttttccatgccctactccggaccagttcagggcagaggtcgcgtggcctggagattggcctgaggcccaggcaggagaggcaccagcaggggcaccagcagaggctcccgacgaggcagatgaggccggcgaggacgaagagatgaccgatttacttgatttcttagaaaggagcggggccacatga

SEQ ID NO: 59871 - DNA, 381 bp, Glycine max
  Peptide Sequence Number=SeqID_151556
ggctacacgccctcaccttgggtactagttaccctcaccgttgagaggactacatgtcctcgccatcagagggctgcacgccctcagaggactacctgtcctcgccttgagaggactacacgtcctcaccatcagaggactacatgtcctcgccatcagaggactacatgtcctcgccatcagaggacttcatgtccttgccatcagagggctgcacgccctcacctccagaggactacctgtcctcgccttgagaggactgcacgccctcacctccagaggactacatgtcctcgccttgagaggactacatgtcctcaccttcagaggactacacgtcctcgccttgagagggctatatgccctcaccttgggtactag

SEQ ID NO: 59872 - DNA, 222 bp, Glycine max
  misc_feature (46)..(46): n is a, c, g, or t
  Peptide Sequence Number=SeqID_151557
atgcgtaaggagaaaataccgcatcaggcgccattcgccattcagnctgcgcaactgttgggaagggcgatcggtgcgggcctcttcgctattacgccagctggcgaaagggggatgtgctgcaaggcgattaagttgggtaacgccagggctaagtctgcagcgttgttttcccttgaggatcaagcacagttctctttgaggttctattattactgttaa

SEQ ID NO: 59873 - DNA, 504 bp, Glycine max
  Peptide Sequence Number=SeqID_151558
atgcagaactatcaacatgcaaagagacgtgattctgcaaaagcgaggaccaacagaaaacgtgttatgcagcagaagcgacatgatcatgctcaatcatcttcacaaccaacagttaattgcacttcagaatataatagttcaggctctaattttatgactccctttgaggattgtcaatctccaactaatcagcctgtaatcaacactaaaggatattttgatattggtgagcaactcatccaatgtagatattgtaatgcacaaatgtggtatgatgaaagaatatcaaaaaataagaattatcagaatccaaggttcagtttatgttgtggagatggcagagttgaattgccattattacaaaatccacccgaatatctgcaacaacttctatttcatgatgatacaattgatagtaaaaattatcaacataacttgcgagcatacaacatgatgtttgcctttacttctgctagaattaagctagataaaaacaattaa

SEQ ID NO: 59874 - DNA, 203 bp, Glycine max
  Peptide Sequence Number=SeqID_151559
tgatcaaggggttcccatgaaccctaagagaataaaggtcattcctgagtggcccactccaccaagtttggtgagaaaccatgttccttcatgggaagatgcccaggaaatgggtgttgagggaaggagcccagagtatgaagaaccttgggatttgaggtcaaatcctttccaaggtggagggaatgatgcaatcctacccc

SEQ ID NO: 59875 - DNA, 441 bp, Glycine max
  Peptide Sequence Number=SeqID_151560
atggaatgtctaagctctgattccgttgataaatcagaaactagtgaggattcgtatttccaatcaattactactgaattccttacttcattgaacacatccagtttgccaactcattctatcaaacttaaaattggaagtcctataatgctgttaaggaacctcgaccaaaatcaaggtctatgtaacggtactagattagtggtaacaaagatggcaaaacatgtaattgcagctgaaattatcttagtttgtcgcaacctacccttcggcgggatgcgacgcgagactcgcgggatgcgtgttccacgaaaggaatacgcgcggagtcgccaccaacgtttatttgaggaaaacgtcggaaaaaccggaaaagacgcgatctacgaacttcttagtgaaaggttcgggagttgtatttacgcacggggaaggtattag

SEQ ID NO: 59876 - DNA, 471 bp, Glycine max
  Peptide Sequence Number=SeqID_151561
atggaggacaaccctggcaaccagttcaataaagaccatggtggatcctcaaacaggccaattcaacaagggcctaacatctttcagaggacaactaagttggaagagtccttgactcagtttatgcaggtaacaatgtcaaatcataagagtattgagtcaacactaaagaaccttgaagtccaggtgggacaactggccaagcaaatagttgacaagtcatccaacagttttggagcaaatacggaaaataatcctaaagaggaatgcaaggttgtgatgactaggagtaaaaggttggtggaaactgaggatgaagagagtgtggtgtacaaggagcaaatgggtgaaaagaaagatattgaggttaaggaaaatgatgtgaagggtaaagagaatcaagaaaaagggaagaaaataatggttcaaaatagagagatggagaaccaagaaaaagaaaaaaaaggataa

SEQ ID NO: 59877 - DNA, 522 bp, Glycine max
  Peptide Sequence Number=SeqID_151562
atggctacttctagacgcgtcatctatcaatcactacaagcggcgtgcatggtctcccgaggtggagatgaaagggatgaatgtttgtttcacctcggggagtcgcaagacatggaaacctgtcccgtggtggaagaattgcttcagcggctcatggattgcgggcagctcgaagtgttcataggagggaaggaagaaccacaaatttgcatgcagtcggaagagaagaaggttcctctaacccccaaggccctagtgatatgttttactaggaaagggaccggctccacacccatatacccccaggcggcacccaagccaacgccatttgcatatcaaagtgataaggtcgttccgtggaagtatacccctcccgcgtccagcgaaagagttgcaaccgaagttgactccctatcagctaaggtaaccaacatcaccggcctcagtggcgtaacccgcagtggtcgggtgttcgcttcccctcacccggcggaattgccctctaaagggaaggcgcccatg

SEQ ID NO: 59878 - DNA, 174 bp, Glycine max
  Peptide Sequence Number=SeqID_151563
atggcaaggagtagaatcgtctcaggtacatggggacggatacatgtagggatagggtcacgaccgaccgatcgttgccccttcccggcgctagacaagcagagaacatcgctgcaaggcagcccagtatcctttgcattcacagtttcttttactattgtttgttttaaataa

SEQ ID NO: 59879 - DNA, 309 bp, Glycine max
  Peptide Sequence Number=SeqID_151564
atgaaggcccaagtggagaaggatgaaggcccagaggcagagacactatcaagactattaattgttgctgaaggcccaagtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccaggcgggttaatgttttcctggcagagtaa

SEQ ID NO: 59880 - DNA, 198 bp, Glycine max
  Peptide Sequence Number=SeqID_151565
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtttatggagtcaatttccagaatctag

SEQ ID NO: 59881 - DNA, 240 bp, Glycine max
  Peptide Sequence Number=SeqID_151566
atgtcccagagacttcacaaattgcctaatgtgctgtgccaagcactttctctacaaggacgcaaacaaagaatgtttgcatgccaaccaagcaagacagcaaaaaagaatgtttatacggataaccactcggtatttccgcccgtcagcgtgactcaaatgtcgagtatgacagatcttgtgagcgcggaagatgacgtaaatctctgcgtgccaacgggcttgtcggctgacgattga

SEQ ID NO: 59882 - DNA, 306 bp, Glycine max
  Peptide Sequence Number=SeqID_151567
atgacgttgctacttaacaacattctgcccagcgaccgcaatgccgatctccttgcgaaagtatcggttggtctgtgccatcccgacatagggattgcgcccgcaagacacccagtggacccggagaagtccaatagggtcttagggtttccagctctgattataggcctcggtcagttctacggagtgcctgccgcccccagcaaggtcatcaggccccctactaaccgagctttcatgaagaagtactgcgctcctaggcaggcgcagggcgatacaccacaacagcctggggattgcagatag

SEQ ID NO: 59883 - DNA, 318 bp, Glycine max
  Peptide Sequence Number=SeqID_151568
atgtcatgtctaccttggagcctacctgaatgggtaagtcagactgaacaactgaatttaaataatgtaaatactataataacccatattggtctccactgcagcacacactggcaaatggtcatcattttgcctaaggaaaatcttgttgtcaggttttgttccttgcataacaggctagacaactaccttaagggaataattaacagtgctttgaaaggacttgatgatactccacaacctaaatccaagtattttaatgatgttagaccattggaagcagagagattgaaggcgcttcgcatccaatggacatag

SEQ ID NO: 59884 - DNA, 399 bp, Glycine max
  Peptide Sequence Number=SeqID_151569
atgcatgagactgaagggcctattattgtgttgttgaccaatgccaggattaaagagggccaaggatcctatccatgctcggttagcaattctttgaaggcttctaaattgactattaatttgccaatggcaccaattgaagaattcaatcagaagctttcagaattgggcgttgagatccgctcagttttgacatgtcgttcgcagtggagttcacagccttcaggttctgctcagttatcatcaagggaaacattcatttccaagtcagaggcaaagaccatttctgagataaacaacctttgtgaagagttggtttatgttactgttggtacaatcacgaggattgttatggacaatcattcatggtgttatgccagcttgcattcagtgccataa

SEQ ID NO: 59885 - DNA, 288 bp, Glycine max
  Peptide Sequence Number=SeqID_151570
atggaagtaagagacaaggagtaccaccttctaagccaaaggatgataagggccacattgcttctcaatacccccacaaagaaaaccatgattatgaggggtcaagacatctatagtagccaagaggaggctacttcttctccttcctcaagtggaaatgaaggtgaagccatgggtgatgagcatattgaagaggtttaccctatgaagaagcacaagcttggtatccaagttgagtctcactatcatttcccacccaaatccttacaagcttcaatggctcaatga

SEQ ID NO: 59886 - DNA, 393 bp, Glycine max
  Peptide Sequence Number=SeqID_151571
atgaccggccctctcgatgagtcaatctcttgctttctcataagggtggacccttggaggactgcacgtcctcgccttaagagggctacatgtcctccccttcagagggctacatgtcctcaccttcagagggttgcacgcccttgccttcagaggactgcacgtcctcgccttcagaggactgcacgtctacaccttcagaggattgcacgtcctcgccttcagagggctacgcgtcctcgccttcagagggctgcacgcctcgccttcatagggctgcacgccctcgccttcagagggttgcacgccctcgccttcagagggctgcatgtctttcgccttcagagggctgcacggcctcgccttcagaggattgcatgtcctcgcctttag

SEQ ID NO: 59887 - DNA, 91 bp, Glycine max
  Peptide Sequence Number=SeqID_151572
atgcatatgacacagatgcaatttactaatacgggagcccgagaaattgtttccttcttggatacaacatttgggcagcgtggcacccaac

SEQ ID NO: 59888 - DNA, 306 bp, Glycine max
  Peptide Sequence Number=SeqID_151573
atgaataacacacttttgttttctgtgaaagaacaaagtttggaaaccataaaactcagaaagcttttggcaaaggaagaagaagaagaagttcaagaagatgttcaaagagattcaaaggttgtaaaagaatatatgaaaaagtactcttcatgtctggtcaagaaaaatcattggaagagttataaccttgagaaaaacctaaaaaccattggaagagttacatctcttgatttttattcaaaacttgtcactgatacactggtaatcgattaccaatatattgtaatcgattacaccatttaa

SEQ ID NO: 59889 - DNA, 303 bp, Glycine max
  Peptide Sequence Number=SeqID_151574
atgtcgacagaaaaatatcagtcggggctatttaacgaccgatgtcggccagacttatcttccttcattggaagtggcgtctacccagacttatcttccttaaccggaagtggcgtctacccagacttatcttccttcaccggaagtggcgtctacccggacttatcttccttcattggaagtggcgtctacccagacttatcttccttcaccggaagtggcgtctatcctgacttatcttccttcactggaagtggcgtcatccaaaacctccgtagcctgttcaaacaatccgccccgtaa

SEQ ID NO: 59890 - DNA, 114 bp, Glycine max
  Peptide Sequence Number=SeqID_151575
atgggtgccaagtacctcgaagcggtcaagcaaaggttgcatgccatcaaacaatggtccccgaacgaaattaggagaccagagcttgaagaggaagccgtcctgggagcttga

SEQ ID NO: 59891 - DNA, 216 bp, Glycine max
  Peptide Sequence Number=SeqID_151576
atgtttgaaaaagaacaatgtgatgaggaaatgaccaagagcaagggcaaggatccacttgaaggactaggaggacctatgacaagggccagagcaaggaaagtcaaggaagctcttcaacaagtgttgtccttactatttgaatacaagcccaagtttcaaggagaaaagtccaaggttgtgagttgtatcatggcccaaatggaggaggattaa

SEQ ID NO: 59892 - DNA, 165 bp, Glycine max
  Peptide Sequence Number=SeqID_151577
atggggatcgcacccacaaagacacctagtggacctgaagaagtccaacagggcccctggggtttccagctctgggatcgcgcctgcaagacacccagtagacccgaagaagtccaacagggtcttggagttgccagctctaaatatggtctctgtcagttctag

SEQ ID NO: 59893 - DNA, 393 bp, Glycine max
  Peptide Sequence Number=SeqID_151578
atgactaagtatagtcccattcttcaacattcggaatggcgatcttggcccgaccctctttcttataaggtacttttgctacagcagagggcagttgccaagagtggagttcacgtgtcccaaagggaagagctcttgagctccctctccctctattttaagacagactttgagtttgagcggggagggcgagatgacaagggaatcggccaaaggcatctatcatctcatcggagaagcggtcctaatctaataaagggttgccttgccttaccaaaaggagtgaaatcagataggcttagagccagtagttgcccttggattattcaaatgtcattgcagatgatcttctcgggcactgatatcccccaaagcaagggtcccgaaggatag

SEQ ID NO: 59894 - DNA, 257 bp, Glycine max
  Peptide Sequence Number=SeqID_151579
gtgctgcacttaccaagaacaagtttgaagtgttgagcaatttggatgaagaatatgaaggcaattttttggtttgcaccaaccaagcagatatgaccggaaggcttcttgtcagttcattggctttggaaagccgcatccttcattatctcattttgcgtatcatgcttccaagatcttcaaaccttgcacaggcaatccatgaagtcccgcgacatgtcgggagtcgaaaggaagcgttaatgcgcaatccgtaa

SEQ ID NO: 59895 - DNA, 306 bp, Glycine max
  Peptide Sequence Number=SeqID_151580
atgcagaacagcagggtcaccctaagggttgaatctcaacactttgcaagtgtcaatgatgccaatccctatgtagctttcatcccttacttttggttcattgatgaaatttgggagcttaactatgtgaaatttacgggcaaaacaattggtgttaatgtagaagatgatgattcatacatggacacctatgttagtcctttgaccgctcaaatcactcctaacgttgtcagagaagaagaagctgacgacgttcatgctaatcgtaatgatcatgatgaaggagaattgattaacatcgtctaa

SEQ ID NO: 59896 - DNA, 279 bp, Glycine max
  Peptide Sequence Number=SeqID_151581
atgccgatctccccctgcggaagtatcagttggtctgtgtcatcccgacataggatcgcacccacaaagacacccagtggacccgaagaagtccaacagggtccaggggtttcaacctctgattacgagcctcagtctgatgtaacggagtgcctgtcacccccagcaaggtcatcaagccccccattaatcgggatttcatcaagaagtaatgcgcccccaggcaaacgcagggcgaaacaccacagcagcctggggatgaccggcagcgggcaataa

SEQ ID NO: 59897 - DNA, 339 bp, Glycine max
  Peptide Sequence Number=SeqID_151582
agggtacatctacttgggttgttgactgagaacaagagagggtacatctcttgtggatcagttctagtggagggtacacccactaggttgttcaaagagaacaagggagggtacatcccttgtggatctttgcttgtaaaggaattttacaaggttgaaaagaaatctcaaggaccgcaggtcgcttggggactggatgtaggcacgggttgttgccgaaccaggattgtcatcatcaaaaagagggagattgtagacaaagaatcaagccgcgccgatgttttgatgatgccaaaagatcacatgcgtctcaaagatttattcaaggcaaagcaatga

SEQ ID NO: 59898 - DNA, 423 bp, Glycine max
  Peptide Sequence Number=SeqID_151583
atgcaaagaagatctactgcaggagatttgattcccatcgatttggagattaacgccacctgtagaaggcgtaattcagagagaattagaatttttttgcaggatttagaagcagcaacaactccagaagaagaacctctatcttccgaggcatcttctagttttcctattgcagggcattctcatatagaatctattgaagatacaatcatggtagaaaagccaagaagagtaaccctggaggattattcaagttctattgtgccacaatttttcactaatgaatcgttgggtgaggcacttgaaagatttagaggtttattgcggaagactcctactcatggcttttcagaaccaatacagctcaacatattcatagatgggttgagaccacaatctaagcagctcttggatgcttcatga

SEQ ID NO: 59899 - DNA, 793 bp, Glycine max
  Peptide Sequence Number=SeqID_151584
tgcctatcacgctaagccaattatgcagagaaaaattttctgtcatgattggctaagcgcaaccctttgcgctaaaccgatggcatccaagaagaggaaaagcactgcttccagacctcaagctgaatacaccgataacattctttgtcggaatatccttccggagagaaatatgcagatttatcataccgagtttgacgagtttaaagtggaattggagaggcataatctacacaaacgcctcgccaacctccaagatggaattatagatgtagttgtggtcaaggagttttatgctaatttatacaccacagaggagcaagcacccaagcaagccagagtacgaggacacctgatcaaaatagatgcaaacaacttgaatgagttctttcatatgccagtggtattggaagagggggaatttttacccacttactctagattttgcaggttgaggactaatcctcagaagattaaagctaggctctgtattccctgcaaggggtttgttttgaatgctgagggccagccatggatgcttcttagaaaagatctaacgacactggcccagacatggagtgtcttctcttactccaacctagctctcacatcccacacctcagatctaaatatggatagagctaagttggtctatggcttggtgactaacatggatatgaacatcagagcccttatctcatgtcagatttcttctattgctcagagtaactcctctaggctcggatttctagccttaatcattgccctatgcaaagctaaaggagttacctga

SEQ ID NO: 59900 - DNA, 70 bp, Glycine max
  Peptide Sequence Number=SeqID_151585
atgggagaaagtaaaaaagggaaggaaagaaagttcttgatcaaagaaactagaagaaatgtgcagaaag

SEQ ID NO: 59901 - DNA, 342 bp, Glycine max
  Peptide Sequence Number=SeqID_151586
atgccaatctccccctgcgaaagtatcggttggtctgtgccgtcacgacatagggattgcgcccgcaagacacccagcggacccggagaagcccaacagggccctagggtgtccagctctggttacgggcctctgttagtcctacaaggtgcccgttccccccaacaagggattgcgcccgcaagacacccagtggacctggagaagtacaacagggtcctggggtttccagctctaattacgggcctctatcagttctacggagtgtccatcacccccaacaaggtcatcaggccccctactaatcgagctttcatcaagaggtattgcgcccccaggtag

SEQ ID NO: 59902 - DNA, 536 bp, Glycine max
  Peptide Sequence Number=SeqID_151587
atgacactgctgctcagcaatgtcttgcctagcgatcataactccgatctccctctgcctaagtgccagttggtgtatgccatcttgacacggatgagcgtccacgtggcccaggtgattgctgacgtcatctatttgtttgcaggtatgccacccaccaggcaccctctggacccagataagtctaatagggccctcgagtttccggcgctgatcacgggcctctgccagtcattcggggttcccgtcacccccagtaaagtgatccgaccgcccatcactcgggccttcatcgagaagtactgcacgcctaggcaggcgcagggtgatgcacatcaggccgcagacgcaccaccaccacctcggcaggccgatcccactggatcactaggcatggagcattatctacagcacttggttcgccagcaggcggccaaccaccgtgggcaggtgcagatacataagtgtctctaccggttcagcctcagtcagcaggggcagggttccgctccttttgcatgccctactccggagca

SEQ ID NO: 59903 - DNA, 380 bp, Glycine max
  Peptide Sequence Number=SeqID_151588
gaaacagctatgaccatgattacgaattcgagctcggtaccagcaacgctgatcagttagtgcatgactttgtccagcagttgcatctccggtctcatttacagaacttattgacttgttctccgacaaggggaattgctgcttcttcaattctgcagcctgttgatattgattctgagtggcctgcggatggtgtgccacggaatgccgtttctcttgcacagcaagctttgtctgcctcaaagcaagcagtttcaacaactggagagatgaaattgattgaaattgatgatgatgatccacttccttctgggggatcctctagagtcgacctgcaggcatgcaagcttggcactggccgtcgttttacaacgtcgtga

SEQ ID NO: 59904 - DNA, 339 bp, Glycine max
  Peptide Sequence Number=SeqID_151589
atggattttacaaagatagtggaaatctcaagtgggttgcttgagtactggacggaggcacgggttgtggccgaaccacctatccctcttaagattattgaggccacaaggtccaacatggagtggatactacctacacctactccatatcgactagtggagccagttcaagtgatagaggtgtcatcctctgaagaggatcctgaagaggacccagaggagttacctcctgaacctgttgtggatgcccttgacttatctaaggatgatgaagacccactccttgatgttgattttccagaggatatcatgtcagcatctgaggtagactccacatag

SEQ ID NO: 59905 - DNA, 650 bp, Glycine max
  Peptide Sequence Number=SeqID_151590
tcgacaaggacactatcgatgacactatatgcgaaaagtatgacattagcaaggagaagtgggctcaattttgtcagagtcgtagatacccttcatggaaggatgtacgaaaaaagacacaggccattcagaaacaaaatagtgccccttacgtgttgtctcatggggattccttggaggagcaagcctcacagggttcctttgtcgcccatggacgtcaagatgtactgactgctggcattgggcgaccaaaacaccctggtcatgtgcgtgttgctggagccagtgtcgcgatcaaacaatactttggactggctccaaggacctcccactcatcttcgtccatggctctcgaagacctggagcaactaacacaaaaaatcagggatcagttggaggagtcgatcaaagaaaaaatgcaatcagagggactcacactgcctcttaagcctgaggttggtcctttagctgctagtgtcagcacaaaggagagttatgttgatccctcagtgaacgatccaaacatgggtgactcagagaaatgcgggttgtacgtcgaagaaaatcctccctgcctggttaccctaggaagactttatgaggggtcgaaaaccgttcacaacatccctttgcgacatgatcaagtcaag

SEQ ID NO: 59906 - DNA, 534 bp, Glycine max
  Peptide Sequence Number=SeqID_151591
atggcctccaggaagcgtaagagcataggggcaaggccaactgctcagtatgatactagacggttccatccccttgatgcttggaatcgttatacaaataacattttgggaaagagcattttgccagagagaaaggttgagatataccacacaaagttcgatgacttcaaggcagagttggaggggcgtaatcttcacaaatgcctcactaacttagctgatgggattattgatgttgctttggaagaatttgactaccttggcagaggtgtggagtgttctctcttactccaacctggcccctacatctcatacgtcaaaccttactgtggacagagccaggttgatctttggcctagtctctcatatggacatgaacatcgtgaggaagcaacttccaagattattttgatgatgccaaagaatcaagagttaagcaaattccaaagattcaagaatcaagtttcaagaatcaagattcaagaacaatcaagatcaagattcaagaatcaagagaagactcaatcaagataa

SEQ ID NO: 59907 - DNA, 324 bp, Glycine max
  Peptide Sequence Number=SeqID_151592
atgacggagaagattcatctcttctttcaaagattttggataggtttgatggtcttcaaacctttgttggtgaaagaagttgtcatcatcaaaaaaggggagattgtagaagcaaagcttcatgatgaatcaagattgattcaaatatgttttgatgataacaaagatgatgacaaaaagctcaaaggtcaatcaaagaatgagttcaagatgttcaagatagaatcaagaacacttcaagatattagaggaaagttgatttcaagaatcaagagaagtcttaatcaagataagtatgaaaaggttttttcaaaaactaagtag

SEQ ID NO: 59908 - DNA, 77 bp, Glycine max
  Peptide Sequence Number=SeqID_151593
atggccctctacagggcgacgcgagactcgcgggatgcgtgttccacgaaaggaatacgcgcggagtcgccaccaac

SEQ ID NO: 59909 - DNA, 231 bp, Glycine max
  Peptide Sequence Number=SeqID_151594
atggagtcaggtgacatgtgggggtatcgtatggttacccgcacctttcgtcaaccaggggcaaacgagcccgttgatgcgcaaagacaaacatcgtcttctgtagcttttgtcatccagggacagcgagtcatgtggcaggcggagataccttatggtcatctgcacctttcgtcaaccgaggggaacgaattcgacagtattaggatgatgttggtcattcgattctga

SEQ ID NO: 59910 - DNA, 228 bp, Glycine max
  Peptide Sequence Number=SeqID_151595
atgagaggtgctaataccttcctcaaatgtaaagataactcccgaatctggaatattcttcatgatcggtttcctttggttttttctaacgttttcctttcaataaacgttggtggcgactccgcacattttcctcccatggaagacgcacccgtgagcctcgccttgctcgcccgcaaaagggtaggttgcgatagttggcgactccactggggattgtttttgtga

SEQ ID NO: 59911 - DNA, 321 bp, Glycine max
  Peptide Sequence Number=SeqID_151596
gaacttttagatgatgccactgttcggaggtcttttccagatttccccctttgcataaagcacgaagacctctccgaaatcgcacatggtggtcaattctcagatatcagtttacagttgtggattttgcatccagaaacatgcatacgagcggggaattccagtgcatatctgtggattcctcgagccacagtcctaggatttagaggtctgggcaatcgcagtttgagtcttgaaagttacataaagacttggatgcaaattcaaaacgtgatgtcatttgtgattgctactctaaatggtggaataactggcagatag

SEQ ID NO: 59912 - DNA, 489 bp, Glycine max
  Peptide Sequence Number=SeqID_151597
atgactgagacaagtgtgagagcggggaattccgatgtgtatggattcctcgacccacagtccgtccagagatctgggcaatcacaatttgaatcagaaagttacatgaagaactggatgcagaattcaaaacgggatgtctacctaggagtctacctgaatggtgcacattggcaaatggtcgtcattttgcctaaggaaaatcttatcgtctggttttgttccttgcataataggccagacaactacctgaaaggaataattaacagtgctttgaaaggacttgacgatactccacaacctaaatccaaggttggtgctaggtggattattgttaaatgtaatagacaaaaaggaagcactgagtgtggctattacgtgatgcactggatgtcaactataatcttaggaagtttcaagaataattgggaaataaccattggaatcagagatattaaggcgctttgcatcctgtgggggatcctctag

SEQ ID NO: 59913 - DNA, 279 bp, Glycine max
  Peptide Sequence Number=SeqID_151598
atggctaagtttgacccagatatagtcctagagttttacgctaatgcttggcccacggagaagcgcgtgcgggacatgcggccatgggtaaggggtgtcgcaatgtgcccttcgcgggcaaggctcacgggtgcgcttcccaaaggaggaaagatgcgcggagtcgccaccaacgtttatttgtggaaaacatcgggaaaaccgaaggaaaccggtcaacaaaagcagggctcttgctcctacgtaccctcctttggagaggaaatcagacctacgtag

SEQ ID NO: 59914 - DNA, 753 bp, Glycine max
  Peptide Sequence Number=SeqID_151599
atgccctcaccttcaaaggattggacgtcctcaccttcagaggactacacgtcctcgccttcaaaggactgcacgtccttgccttcagagggctacacaccctcaccttcagaggatgacacatcctcaccttcagaggactgcataggactacatgtcctcgccttcagagggctacacgccatcaccttcagaggactacacgtcctctccttcaaaggactgcacatcctcacctttagaggattgcacgtcctcgccttaagagggttgcacgtccttgaattcagaggacttcacgtcctcccctttagagggctacacgccctaacctttagaggactgcacatcctcgccatcagagggcttcacgtcctcgccttcagagggctgcatgccctcgccttcagaggactacacgtcatcgtcttaagacggcttcacgtcctcaccttcaaagggctgcacgtcctcgccttcagaggactacacgtcctcgcctttagagggctccacatcctcgcctttacaggttgcacgtcctcgccatcaaagggctacacgccctcgcctttagaagactgcacgtccttgccttcagaggactgcatgtcctttccttcagagggctgcacgcccttgcctttagagggctacacgccctctccttcagagggctacatgtccttgcctttggaggactacacgtcctcgccttcaaaggacttcacgtcctcgccttcagagggttaa

SEQ ID NO: 59915 - DNA, 46 bp, Glycine max
  Peptide Sequence Number=SeqID_151600
atgggtaccgagctcgaattcgtaatcatggtcatagctgtttcct

SEQ ID NO: 59916 - DNA, 225 bp, Glycine max
  Peptide Sequence Number=SeqID_151601
atgaaactacttcttcttgcgaccggcgtgctctcctcttggctaaatagtttggtcagatcccttccccttagtgaaaggggtcgcccttcgcaaaattccccctgccgccttttgcctctgctccttcttatggaaggattcgcccttcttcccgctagacttatctcttttggaccttgtcacagcctaaaaaccccctcctctttttcagattcggattag

SEQ ID NO: 59917 - DNA, 519 bp, Glycine max
  Peptide Sequence Number=SeqID_151602
atgcgtagtgattgcttagtgcaattctccattcttaacctttttcggagccccatgaattgcgttttcgttcatgtgtcctccaccttcgagtttggagccatgcgtagtgattgcttagttcaattctccattctcaaactttttcggagccccatgaattccgttttcgttcatgtgtcctcctcctttgaggttggagctttgcgtagtgattgcttagttcaattctccatcctcaaccctttttcaaagcccatgaattgcgttttcattcatgtgtcctccaccttcgagtttggagctatgcgtagtgattgcttagtgcaattctccattcttaacctatttcggagccccatgaatttcattttcgttcatgtgtcctccacctacgagtttggagctatgcgtagtgattgcttagtgcaattctccattctcaatcctttttcggagccccatgaattgcgttttcgttcatgtgtcctccaccttcgagtttggagctatgcgtag

SEQ ID NO: 59918 - DNA, 279 bp, Glycine max
  Peptide Sequence Number=SeqID_151603
atggaaacactcggcgtcgacaaaatcgaggccgtggcggaccggggctacttcaagatcgaggacatcgaagcctgcgatgttggctggaggcgatatatcccggacatgaatggatcacacagctttaaagaaaagcaggatgaccgcttctatccggtttgcccttgctgcaagctcaccaacgaaggcaatggtcaaacaataggcctcgagcgttcccatcgagattggcactcccactcccgtttcggactttcctgccgtcgcatcacctga

SEQ ID NO: 59919 - DNA, 1122 bp, Glycine max
  Peptide Sequence Number=SeqID_151604
atggctccgaaaaagctttcctcaaagagatctaggagggacgctgcggctgaagggaccagtgccacccccgaatttgatagccaccgtttaaggagcgccaagcaccagcagcgcttcgaggccatcaaaggatggtcattccacaaagagagacgcgtccagctcatggacgatgagtacacagattttcaggaggagatagctcgccgacattggacatcgctggtcactcccatggctaagtttgaccctgatatagtcttggagttttatgctaatgcttggcccacagaagagggagtgcgggacatgcggtcatgggtgaggggtcagtggattccctttgacgtagacgccctcagccagttcttgggtgacccgctagtgttagaggaaggccaggagtgcgagtttagtcagaggaggaacagggacgatgggttcgacgaggaggccattgctcagctattatgcataccgggtcaggattttgcccggaccgctgcagggaggcgggtgcggatcatgcgcaccagcatgattaccttgacccagatgtggataacattgctgctcagcaatgtcttgcctagtgatcataactccgaccttcctctgccgaagtgtcagctggtgtatgccatactaacacggatgagcgtctatgtggctcagttgattgctgacgccatctatttatttgcaggtatgccacccaccaggcaccctctagacccggataattctaacagggctctggggtttcaagcattgatcacgggcctcttcctgtcattcagggttcccgtcacacctagtaaggtgatccgaccgccgatcacccgggccttcattgagaagtattgcacgcctaggcaggcacagggtgatgcaccacaggccgcaaatgcaccgccaccacctcatcaggctgatcaagttgggtcattaggcatggagcggtatttaaagcacttggttcgccagcaggaggccaaccaccgggggcaggtgcagatacatgagtgtctctaccagctcagcatcagtcagcagggccagggttttgctccatttgtgtgccctactccagatcagtttagggctgaggtcgcatag

SEQ ID NO: 59920 - DNA, 267 bp, Glycine max
  Peptide Sequence Number=SeqID_151605
atggccaatgagcccgttgacacgtggagatttacgtcgtcatctgcgctttctgtcatcctaacccgtgaagttaggcggagatacccaagtggttatccgtataaacactctttcgctatccctcagactcagagtccgatagcatgcagagacaaatgtcgtcttctgcaccctttgtcaatcgcagccaacgagctcgttgacacgtggagatttacgtcatcttctgtgctttctgtcatcctgacccgtgaagtcaggtga

SEQ ID NO: 59921 - DNA, 261 bp, Glycine max
  Peptide Sequence Number=SeqID_151606
atggtgggtaagacactcggcgcctcccgccatgtctgctatgatcgctatgtattaaaacatacacaaatgttgaaaataagaaatgttgctctgggtgattccacactcactactgttgctggaactggaaatgttgaattgaagtttacctctggaaagactttgattctcaaagatgtaaaactgtttccagagaacactggtgaaggtttaccagtagacctagtaaggagcattggcacgctattgaaagggtaa

SEQ ID NO: 59922 - DNA, 224 bp, Glycine max
  Peptide Sequence Number=SeqID_151607
gaccgcctataggagtaatccagaagagacaaagtgatgaggacaaggcaaggaataagggcaaggaacctttagaaggacttggaggacctatggcaagggctagaacaaagaaggccaaggaagctcttcaacaagtgttaaccatgctatttgaatttaggcctaagttacaagtggagaagcttcggattgttaattgcaccatgttccaagaagagtag

SEQ ID NO: 59923 - DNA, 411 bp, Glycine max
  Peptide Sequence Number=SeqID_151608
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtgtacaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 59924 - DNA, 486 bp, Glycine max
  Peptide Sequence Number=SeqID_151609
atgaatatcttgacagcacacgatcaagggtggaatcaggagttaagtccttacaatcaatatgaagaagagagaactcctaatcttgaaagtgtgtttgaggaattcatagcataccatgccaactcaaaagctaatcaaaattcaatgaaaaatcatgaaattcattttgagcatgagtcaagagaaaaagatgaggagaaagaagaggaacaagcacaacaacaatgggataagtactcaacagtagaaaaccaacaagaaaatattctccaaatcaataaccttcctcatcaactaattatcaagaaaggaaggcaaggagaacttgaggaaaccttaagtgccattctttctttaatcacgagcatctttcttgaaatgatttggaatgtacttccagactatatgaagttcatggaatttctagctaaaaggcgaaacttcaaggaagatgtgttctatgtgactttcatgccaccttga

SEQ ID NO: 59925 - DNA, 423 bp, Glycine max
  Peptide Sequence Number=SeqID_151610
atgagtgatggattttgcggtactcatttgcatatcatggttaggactagaggattaggtcgtgccttaggtctggtcactggcagaggtgtgggcaaaggagatcgtgatgattccgatgatactctgcagcatcgacggcctactgcacctgcacggaggcagcgagtcgctgtgactacggatcacgttgatgagccagtcatccctgcgctagatgttcaggatgacccgatggaggcaccagctactgtggaggacattcctgcggacattcctgtggacgcaggcgtaaaggtagctaaggatcagcatcagggattttcgggtggtccaagcgacccattcgtgttgacagcgtatgcggatcacgttgcttgcagcgtatggacgggagaggagcgtcctgaattgaagctataa

SEQ ID NO: 59926 - DNA, 216 bp, Glycine max
  Peptide Sequence Number=SeqID_151611
atggcattagcgcgtgatttttatagggaaacaacccgtggggccttttggtattggaaataccagaatgtgcacgtatgcaattttgatagccaaagtgctttgagtaagcatgtatgtaaatttagaaaaggaaatgcgtgtgatgtaggaaatggccccaaggaagcttgcctcaaagaggtccaggaaggacaaggcggccgaaggaactag

SEQ ID NO: 59927 - DNA, 234 bp, Glycine max
  Peptide Sequence Number=SeqID_151612
atgggtgaagtagaggatgtgcaagagcagatgaaggccaacatggaggccatgaaagagcaaatggccacaatgatggaggccatgatgagcatgaagaagataatggaagccaatgcggttacgatcgtcgctaccagcactgttgctaaggtgaacccgatgcccccatctggcctcaaccaaatgaatcatccgaccttagatatggtaggcaaagatttggggaagtag

SEQ ID NO: 59928 - DNA, 314 bp, Glycine max
  Peptide Sequence Number=SeqID_151613
agggctttttccggaggagccctggtgcttaccaacatggatggcgaagagctaccttcacccggatttcctgtctgttgtatctctcgttacaatctttcaaagaaatgaacgtggatttgaagcttttagtcctcacgggcaggatcaccttgggctaccttctggagtgaagacaaaacatgaatggcagaaaccagtcaaggtacttaaggatgaacgcaagcggggatggggtcacgaccgaccgatcgttgctcttctctgtgcaaaacaaacagggaatgtcgctgcaaggcagctccgtatccttt

SEQ ID NO: 59929 - DNA, 423 bp, Glycine max
  Peptide Sequence Number=SeqID_151614
atgggagattcagctaaagacaaacagagatgtgcagaatccctgacaggtgttgcaacgtgtctgccatatttgggtgctgacgcgaaagcacccacagcagattgttgcagtggtctcacacaagccatgaagaccaacaataagtgtgtctgccttattctcaaagacagggatgatcctgaccttggcttaaagattaacatgacaattgctgttggtctcccttctctttgcaaaacacctgataatctctcacagtgttctgttgatggaagttcccagaatggtagaaagcaggggacagatgaaacggccacagctaagaatagtgcatcttatatcgggaagagattgttagttgatagtgtaaaaaatatttatactcttgagtgtactaaatctctgacagactcacaatag

SEQ ID NO: 59930 - DNA, 435 bp, Glycine max
  Peptide Sequence Number=SeqID_151615
ccgtgaagtttggtgacatgcgggggtaccgtatggttatccgcaccattcgtcaaccaggggcaaacgagactgttgatgcgcagagactaacgtcgtcttctgtaccctttgtcaatcaggggcaagcaaactcgcggaggtaccgtatggttatcctcatctttcgtcaacaaggggcaaacgagcccgttgatgcgcagagactaacgtcgtcttctgcacgttttgtcatccagggacagggagtcaggtggcaggcggagataccttatggtcgtctgcacctttcgtcaaccaaggcgaacgagttcgacggtatcaggatgatgtcttttactctcatcgtctggagacattcaagcccgatgacgcatgagattcttctctgctgggcggggacaatcaagtttgattgcgtgtggaaacgttgtg

SEQ ID NO: 59931 - DNA, 405 bp, Glycine max
  Peptide Sequence Number=SeqID_151616
atgcctgcaggtcgactcctagaggatccccgctgccaggtgtgcgacaagcgttttaccacctatgaaaccgcagagttacacctgccgcaggtggtcaagcaaaacggtacgcgggaagagttcaaacgtgagaagctgcgcgtatcatttacccgcgcactacacaaacgtcccgtgcctactgaatatgtcgacaaagccatggatcgtatcatccagaaagtgctcgggttaggggtgcgtgaagtgccagcccggctgctgggtgaaaccgtaatgcaagagcttaaacaaatggatcaggtggcttatatccgttttgcttcggtctaccgaagtttctctgatgtggatgatttccataatgccatccgtgatctggatgtgactgatagcgattaa

SEQ ID NO: 59932 - DNA, 405 bp, Glycine max
  Peptide Sequence Number=SeqID_151617
atgaaaagaagcatagcactcaaagcctcctcctcaatgcaagaagaagaagaagaagaatctgatgatgaagaggacttctcacgctttgtgaagaagtttcataaattcgtcaaaaatagaagaatggagagaagccataacttcgacaatgggaagagatctcaagaaggttccccaacacttaaatgctataagtgcaatcgacccggtcacataaaggcacactgccccacaaatgaatcatgtccagaaaagaatcagaagaaaagccatgaagaaagaagatccaagaaggcgtatattgcttgggatgacaatgactcatccgatggttcggagaaggagatcaaccttctatccaagtactatgagagcgatgagaacatatcacaagaagattaa

SEQ ID NO: 59933 - DNA, 536 bp, Glycine max
  Peptide Sequence Number=SeqID_151618
gtcctcgccttgagagggcgtgcacgccctcaccttgggtactagttaccctcaacgtcagaggactacacgtcctcgccttgagaggactacacgtcctcaccatcagagggctgcacgccctcacctccagaggactacacgtcctcgccttgagaggactacacgtcctcaccatcagagggctgcacgccctcacctccagaggactacatgtcctcgccttgagagggctacacgccctcaccttgggactacacgtcctcaccatcagagggctgcacgccctcacctccagaggactacatgtcctcgccttgagagggttgcacgccctcaccttgggtactagttaccctcaacgtcagaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgcctttgtag

SEQ ID NO: 59934 - DNA, 151 bp, Glycine max
  Peptide Sequence Number=SeqID_151619
gagatttagggataaaaaagaggttgcagaacctgaggcagacccagaaagggatctgagaactgtttttgcctaccagatgccgctaaaagcaacagagacaaatgtgtatgagttcttttcaaaagctggcaaggtcagttgcttttaa

SEQ ID NO: 59935 - DNA, 231 bp, Glycine max
  Peptide Sequence Number=SeqID_151620
atgaccggccctctcgatgagtcgatctcttgctttctcataagggtggacccttgggtacttgtacctatcacctttagaggactacatgtcctcgccatcagagggctacatatcctcaccagtgagaggactacacgtcctcgccatcagagggctgcacgccctcaccttcagaggactacacgtcctcgccttgagagggctacacgccctcaccttgggtactag

SEQ ID NO: 59936 - DNA, 441 bp, Glycine max
  Peptide Sequence Number=SeqID_151621
atggtagggtacacaccttcaagctttgctgatttagttttcacttacgaaaggatcaaagtgggtctgaaaataggcaaatttaatcatcctgcttggacgaatgagaaaactggggaaaatgaagagggtgaggatgagggagaaacccatgctgtgactgccattcctatacggccaagtttcccaccaacccaacaatgtcattactcaacccttctccttacctaccacccagttatccacaacgaattcaccctaattccgatgtcctatgctgacttgctcccatatccactcgataattcaatggttgccataacccttgctaggtttcctcaacctccatttttccgaggatacgactcgaacgcaacatgtgcatattatgcaggaatttcgggacattccattgagcatcgtatgaccctgaagcgtaag

SEQ ID NO: 59937 - DNA, 621 bp, Glycine max
  Peptide Sequence Number=SeqID_151622
atgactggtagattacttgccggatcattggcatttgaatgccgcatcatgcactatctgattgtgtgtatccttcttcctctgtcatctaattttgctcaggtttctgaggaagacttggttgtcatgtgggttttacttaccagtcgtcaaatcgactgggcccaacttgtcagatatcgcatgcaaaaggcattacgatcaaaaacaccccttccttatcctcatctaattactctattcttgcgtcatttcgatgtccttcttgactctgagacatttgttcaagtcaagagatcattttctaacggggcaggagtagttacttccttcggataccgcaaagagcgtgatggctcttgggtgaagaaggacattcctgcacaagcagcaaaggaccgctctccatcaccacctcctcagagggatgactcttcatcccttatgaaaagcattctcgatagactagatggactacacacgtatgtcggtgagcgttttgacaccctggaaagtcgcattgatacacaatttgcagacatggatactcatattgatcggcttgaagaggatgtgagtttcatccgtcagtgcttcgaccttccaccaccgccttcatag

SEQ ID NO: 59938 - DNA, 186 bp, Glycine max
  Peptide Sequence Number=SeqID_151623
tgggctaagcgtgcatccatcgctaagtgcagcttcagggcacttagagcaacagaagaatctggcagagcatcaatatcaaggccacgcactaagcgcatgattaatgcgctaagtgcagcagttgtcttcagcctggctcagtgcacgactggcgctaagctcaaatccacttactcgcgctaa

SEQ ID NO: 59939 - DNA, 279 bp, Glycine max
  Peptide Sequence Number=SeqID_151624
atgacatttggttcgccagcaggcggccaaccacagggcgcacgtgcagacccatactctctctaccagcttagcgtcagcctgcagagccagggttttgcttcttttccattccctactctggatcagttcagggcagaggtcgcatggcccagagattggcctgaggcccaggcaggggaggcaccagtagaggctcccggcgaggcatatgaggcccacatggacgaggagatgaccaatttgcttgatttcttgggagggagcggagccatatga

SEQ ID NO: 59940 - DNA, 211 bp, Glycine max
  Peptide Sequence Number=SeqID_151625
gtcgactctagaggatcccccttggtctctgcttgccatcggacacaactgtgtctgcctagcaaaggggggtgcagataaccgtaaggtatctccgcaggctaccagctcttgggtcatggcaacaaaaggcggtgtggtcgacaaaagcgaggctcttgctcctacgtatcctccaatgaggaactcagacctacgtagttctggataa

SEQ ID NO: 59941 - DNA, 321 bp, Glycine max
  Peptide Sequence Number=SeqID_151626
atgaagagagtcaagagtgaggcaaacactgaaaagaagaagattactactccaaatgaaggcaaagaagtaccttatcctttggtaccttctcggaaagataaagaaagacatttggccagatttcttgatatcttcaagaaaatagacattactttgccttttggagaagcacttcaacaaattccccctctatgccaaatttttaaaatatatactaacaaagaagaaccgatgaatggcagcggaatggagaaggaagagagagaggagaagccacttcaaggagaagatgagtctagaagaagctcaccaccatag

SEQ ID NO: 59942 - DNA, 684 bp, Glycine max
  Peptide Sequence Number=SeqID_151627
atgggccccaaatctaccctaaggctcatgagaaccctagggccttctcttaaatctttggcccaatcttcctggagtcttctatccaatgcccttgcgagaatatccactgcatgtgatttgatccccattgatttggagattaaggccacttgtagaaggcataatcaagagagaattagaaattttttgcaggatttagaagcagcagcaattccaaaggaagaacctcaatctgctaaggcatattctagttttcctgttgcaggacattctcatttagatcctatcgaagaccacatcatggctgaagagcccagaagagtcaccctggaagattattcacatacttcacatgcttctgttttgcagcccagaaacaattttaatgcaggaggatcttctggattccaacatggccagcaatacaatcaacagcaggggcaatggaggaaccaccctggaaatcaattcaatagagatcaaggtgtaccatccacaaggtcacaacaacaagggcctagtctctatgatcgcacaacgaagctggaagagactctagctcagttcatgcagaaaaatcccaaggaggagtgtaaagctgtgatgactagaagtagaatggaaatccatatagatgagagtgaagctaagaagaaggtggaggaacataaacaacagtag

SEQ ID NO: 59943 - DNA, 374 bp, Glycine max
  Peptide Sequence Number=SeqID_151628
gtatgccacctaccaggcaccctctagacccgaataagtctaacagggccctgggttttgcggaattgatcatgggtctctgccagtcgttcggggttcctgtcacacctagtaaggcggccaaccacagggcgcacgtgcagacccatgactgcctctaccagctcagcctcagcctgcagagccagggtttttcctcttttccatgccctactctggatcagttcagggtagaggtcgcatggcccggagattggcctgaggcccaggcaggggaggcacccgcagaggcacccagcgaggcagatcaggcccgcatggacgaggagatgaccgatttgcttgatttcttgggagggagcggagccacatga

SEQ ID NO: 59944 - DNA, 279 bp, Glycine max
  Peptide Sequence Number=SeqID_151629
gttttggagaaggtcaataacaattcctatagattggacctccaacaagagtatggactcagcaccacttttaacacttctggtttaattccttttgcaagtggagcagatattgaggaggaggaactaacagattttaagtcaaatcatcgtcaaggggaaggggatgatgcaatcctccctaggaagggaccagtcactagagccatgagcaagaggctccaagaggattgggctagagctgctgaagaagcccctagggttctcatgaacctcagg

SEQ ID NO: 59945 - DNA, 567 bp, Glycine max
  Peptide Sequence Number=SeqID_151630
atggaacaaaaagtaattgtaggggaaatccaacaaagagaattttctggattccaacatggccaacaatacaatcaacagcagggacaatggaggaatcaccctggaaatcaattcaatagagatcaaggtggaccatccacaaggccacaacaacaagggcctagtcactatgatcgcacaacgaagctggaagggactctagctcagttcatgcaggtctctatgtccaaccagaagagcacaaagtctgctataaagaatctggaggtccaagtgggacagcttgcaaagcaattggcggatagatcatcaagcagttttacagttaatacaaagaaaaatcccaaggaagagtgtaaagctatgatgactagaagcaaaatggaaatccatgtggatgagagtgaagttgagaagaagatggaggaatataaacaacagttggcacctaagccagcacttgaacctgtttttgattttgtagaacttgaagagattaatgaggaggctaaagatgataaggaagaagagacaccaataaagaaaaagaaaaagaaagaataa

SEQ ID NO: 59946 - DNA, 186 bp, Glycine max
  Peptide Sequence Number=SeqID_151631
atgggggtgcaaatagcacccaggccgacttgggccctccagaagattcctccagaaggttgttgcttctggaggaagcaacctggctcgcctgggcgagctgggcggcaagcatctcccctatcccgccgaaggttaggtgactttagcattgggaaatgtactattgccttagaacttgattga

SEQ ID NO: 59947 - DNA, 49 bp, Glycine max
  Peptide Sequence Number=SeqID_151632
gtcgactctagaggatccccttaaagaagcgctactaggaggcaaccta

SEQ ID NO: 59948 - DNA, 501 bp, Glycine max
  Peptide Sequence Number=SeqID_151633
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctccatttcttgagagaaattctattgataggcctcttatattcaatggcgagggttatcactattggaggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 59949 - DNA, 135 bp, Glycine max
  Peptide Sequence Number=SeqID_151634
atggaaattcttcatcgttcttcgtcgttcttcaccgttcttcatccgttcttcgttcgttcttcgttcttcaacggttttcttttcttcccttttgacgtgcttaagccatttattaagtcatttctcgcttaa

SEQ ID NO: 59950 - DNA, 441 bp, Glycine max
  Peptide Sequence Number=SeqID_151635
atggttggtttcgcacctttttcgccaagaggtaaggcatgcttgcctgctagaaagtcaccgttcatgcacagagaaaggaggcgcaaattgggccaactcttagaaaacaaagaaggagtgtctatcaactggttccctcgatggaaagaagggggagtcggagttcttatttcgtgcggaggatttccgaatgttcccttgatagggacgaggggttgcatcagttacaatcccgttcttgctataagacaacttggctaccctatgagagggacaccactagaggaagagattgcacctgtcatttcaagaggtttcaataagaccaacatggagaggcttcagaaggtccgtaaggcatgggaggtgttgcgaaagaaggacaaagaactcaggggcagtaacaatgggccctcggtggctaccataagtggttga

SEQ ID NO: 59951 - DNA, 309 bp, Glycine max
  Peptide Sequence Number=SeqID_151636
atggcgaggacgtatagtcctctaaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaaggtgagggcgtgcagccctctgatggtgaggacgtgtagtcctctcaaggtgagggcgtgtagccctctgacggtgagggtaagggcgtgcagccctctgatggtgaggacgtgtagtcctctcaaggcgaggacgtgtagtcctctgacggtgagg

SEQ ID NO: 59952 - DNA, 104 bp, Glycine max
  Peptide Sequence Number=SeqID_151637
tagccgtgagactgtggtttaaactactttccttgatgtcataccctaatttcgtccggggacctttgcttgatgacatacgacttttctttggtccttgtgag

SEQ ID NO: 59953 - DNA, 120 bp, Glycine max
  Peptide Sequence Number=SeqID_151638
atggaggttgatgaaccttggctagggttatggctaccattgaattatcaaaaatgggtttatgatcccaacatggttggctcatggtgcctaacacatgcaactaagaatgtagtgtga

SEQ ID NO: 59954 - DNA, 261 bp, Glycine max
  Peptide Sequence Number=SeqID_151639
atgggtatgtttaactcgtccaaacatggcaaaaacctagcaaagatacccatcatatctcccaaaaccccatacccacgaaaatcaagagggaaagaagtccacccaaacctgaaatttcgaagtcccacacgtagagatgtgcttcacgacttcgaaaatgccctcctttcgcgatttggagcagaaatgatggccaaaggttggagctttgttgggcaacaatggtggatgagagaaaagaagaagaaggctgcgtga

SEQ ID NO: 59955 - DNA, 99 bp, Glycine max
  Peptide Sequence Number=SeqID_151640
atgacgaaaagggtcagtatgacagagattgtggggcaaccgacaaaagcgaggctcttgctcctgcgtatcctcaatgaggaactcagacctacgtag

SEQ ID NO: 59956 - DNA, 186 bp, Glycine max
  Peptide Sequence Number=SeqID_151641
atggctctgggtgaaaaagggtttgatggtcttcaaacctttgttggtgaaaggtttgataatttggagttacaagtggacatgcgattcgatgagatggagtcaaggatcaccaaggtcgaagaagatgtcttttacatccatacaagctttgatctaccaccaccaccgccaccatcatcttag

SEQ ID NO: 59957 - DNA, 270 bp, Glycine max
  Peptide Sequence Number=SeqID_151642
atgtttttacaagaggtttactctctggcatgtaatcaattacatgaggattgtaatcgattaccagcagctgaagattgtaaaagcaagcttcatgatgaatcaagattgattcaaagaagttttgatgataacaaacatgatggcaaaaagctcaaaggtcaagaacacttcatgataacaaagatgatgatctcaaagaatcaaagaatgagttcaagatgttcaagattgaatcaagaacacttcaaggttcaagaggaaatttga

SEQ ID NO: 59958 - DNA, 144 bp, Glycine max
  Peptide Sequence Number=SeqID_151643
atgagttgtacaggtttgctaagcgcaccgcttcatctcactaagcgcaccgttttcagttcattagctaagcaagaaaggcgcgctaagccaaaaatcactaatagaccagagcttgaagcattagccggtttgagagcttga

SEQ ID NO: 59959 - DNA, 291 bp, Glycine max
  Peptide Sequence Number=SeqID_151644
gtcgactctagaggatccccggttcgccagcaggcggccaaccaccgagcacatgtacggacccatgattgtctgtaccagatgagccttagcatgcagagccagggcgtcgctcctttttcatgccctactccagaccagttcaaggcagaggttgcatggcccggagattggcccgaggcccaagcaggagaggcacccccagaagctcccggcgatggagaagaagcccacgaggatgaggagatggccgatttgcttgacttcttgggagggagtggagacacgtga

SEQ ID NO: 59960 - DNA, 306 bp, Glycine max
  Peptide Sequence Number=SeqID_151645
atgttggtgcgcatgatccgcactcgtctctttgcagtggcacgggtgaaatcttgccccggtatgcatagtagctgtgtgatagcctccctttctggttgtgctcgcacagttggccctcctccaatatcaggggggcagaggaccttaaattctcttaaggtgtggatgtggagcacactgaaaatgagtacatgtagccctctaaaggtgagggcgtgcagccctctcaaggcgaggatgtgtagtcctctggaggtgagggcgtgcagccctctgatggcgaggacgtgtagtcctctcaag

SEQ ID NO: 59961 - DNA, 168 bp, Glycine max
  Peptide Sequence Number=SeqID_151646
atgactaaagcacgtcaaaagggggtacggaaagcaaatgaaataaaaataaaagcacgagaaaagagggaggtggttgctgcccagctcgcccaggcgtgctgggttgcttccaccagaaggcaccgccttctgttggaacatcctagaaggcccaagtgggtctga

SEQ ID NO: 59962 - DNA, 538 bp, Glycine max
  Peptide Sequence Number=SeqID_151647
gacagagagcttaggggaagcagtaatgggatcatcggcggctatcataagtggctgagagtccagacacaaggattggattggctcccaaatctaaagactgtgagagacaatgaggttaaagctttggaagaaagtgatgaggcacaagccctaaaggcaaagcttgaaagagcccgggtagtcaaagagaagttcaaggcagcaatagtgagctcaagctccgaagaggtgaaaggaatcatcgcgggtcaaaggcatgatcttgaaggacgagctaaagggaatatgtgggccatcattgatgagtgcaaagagaagctaaatctagcggcgactcacgagcaaaggctagaggatgagtacgccaagatatcagcagaaagggaagcaagggaaagggtaattcattcattgcaccaagaggcaacaatgaggatggacaggagtcaagaagttccccgattgctagccaaggccaaagcaatggcggacacctactccgcccccaaggagatccacggacttctcagctatt

SEQ ID NO: 59963 - DNA, 426 bp, Glycine max
  Peptide Sequence Number=SeqID_151648
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggca

SEQ ID NO: 59964 - DNA, 264 bp, Glycine max
  Peptide Sequence Number=SeqID_151649
atggtgtttttttttgtgggaattttggctttgaatgtttttggccttttccttttctgtttttgtttagtgcgaggtgaacaagtcaccgatgcacaggatttaggttggcaatcaaagggagaggaccattttaggtcgtgggcaaggtttatggtgagttgggactttggctcaaggcttgtagaacgaatggacatgatatatgtcagggtgttggtctggttcagggatgaaagggaatgtcccacattatttccatga

SEQ ID NO: 59965 - DNA, 330 bp, Glycine max
  Peptide Sequence Number=SeqID_151650
atggcgagagtgtgcgaaattgaatttcgagcaacatatccaaatttcatgaaaatccaacattttgggtttctacgggaaaggaaaaggctgcaatgcgaaaggtatttctctcagctcaaagattatatcacaattctcaacggtgagaattctcgtaattgggcttcaaacatggtgctcaaatttcatgacgatccaacggtgaacgagtccgagattgtcgtttttctgagacaggttaggtggcctacgggaaaaagaaagggttttggaagaagagaaaagaaacgaaattgtgaggcagaggaggctgagaagtcagtctga

SEQ ID NO: 59966 - DNA, 348 bp, Glycine max
  Peptide Sequence Number=SeqID_151651
gtgaccaacatcaccggcctcagtggtgtaacccgtagtggccgggtgttcgctccccctccctcggtggaatttccctccaaggggaaagcgcccatgatccaagaacccacagacatagccaccccctcaaaagaagtggatcctctgggggtaaaaggagctgaaaagaaagaaggtcttcaaggaaaggcggtgactttggaagaggcgcatgagttccttcgtctcatgccaacaaagcgatcacacgacatggaaacctgtcccgcggtggaagaaatgcttcagcggctcatggactgggggcagcttgaagtgtccaaaggagggagggaagaaccatag

SEQ ID NO: 59967 - DNA, 192 bp, Glycine max
  Peptide Sequence Number=SeqID_151652
gaaatggccctgaggaagcttgcctcaaagagatctaggaaggataaagctctgctcccgaatatgacagccaccgttttaggagtgttgagcaccagcagcgctttgaggccatcaagggatgctcatttctccgggagcgacgcgtacagctcagggacgacgagtatactgacatccaggaggagatag

SEQ ID NO: 59968 - DNA, 393 bp, Glycine max
  Peptide Sequence Number=SeqID_151653
atggaacttcaacgtctcaaccaaaatgaagagaccaaaaaaaggaaaagaagcatagcactcaaagcctcctcctcaatgcaagaagaagaagaaaaagaagaatctgatgatgaagaggacttctcactctctgtgaagaagtttcataaatttgttaaaaataaaagaatggagagaactttgacaatgggaagagatctcaagaaggcacactgccccacaaatgagtcatggccagagaagaatgagaagaaaagtcgtgaagaaagaagatccaagaaggcgtatattgcttgggatgataatgactcatccgatggttcagagaaggaaatcaaccttctatccaaggactatgagagtgttgagaacatctctcaagaagattaa

SEQ ID NO: 59969 - DNA, 252 bp, Glycine max
  Peptide Sequence Number=SeqID_151654
atggcaataacggaagctacagggctccaaatgagaacaagggtggagatgataggaaggaaagaatctgatgagaatcatgaaactggccaaatacaggctaaagacccaagtggagaaggacgaaggcccaagtggagaaggacaaagccccccgagtggagaaggatgaaggcccaagtggagaaagatgaaggcccagaggcagagacactatcaagactattaatttttgctgaaggcccaaactaa

SEQ ID NO: 59970 - DNA, 1248 bp, Glycine max
  Peptide Sequence Number=SeqID_151655
atggggacaaatcaaaccggaaaaagattctatcaagtcaagattaagggcctagatgtcaccagccttaaggagttggggcgattgatgagacctctccaaatgcaagccttccggaaggcgtacggaaagattttagatttgaccatagtggagatattcacggaggccgttgtatcactcacccaatactatgaccagcctttaagatgcttcacatttggagacttccaattggtacctactgttgaagaatttgaggagattctaggatgtcctcttgggggaagaaaaccgtatcttttctccgggtttcttccctccttgagcaagattgcaattgtggtcagggattcggcaagggagttggatcgtgtaaagcaaactcgaaatggtgtagtgggcctaccacggaagtacttggaaggcaaggcaagggatatggtgaatcaagaggagtgggtcctgtttgtggatgtattagcattgctaatctttggggttttcctctttctaaacgtggacgccatcgctcgtgtgagaagagtagattgggaccaacacttggctgggataggaggtagaacaatcaactggtttcctcgatggaaggaaggaaaggagggagttctcttctcatgtggggactacctaaacatctcgttgatagggacgaggggttgtattaactacaatctcgcgcttgctataagacagttagggtaccccatgaggggaacaccagcggaagagagcctctctcctttccttgtgagaaatttcggcacacaaagtttcaagattatacaaagagtccacaaggcgtgggaaagcccgttaaggaaagataaagaacttaggggcattcgtaaaggcatcatcggtggttatcatgaatggctgaaagttcgtacacgagggttagattggctctccaagttgaaaattatcaatgaggagaacttcgaagctccggaagaggatgaagaagtccgagctctaaaaacagaactaggaaaagcaagacttgccaaagaaaaattcaagttagtcgctacagacgtccagaaagagtgtgccgagttacgagaagaaaatgcagctaccgcaagagcccttgaacaagaaaccaagagggctcgcaaggaagagcatggccgagacaaatttcgtggagctttttggggcatcaacaatgagctcaagcttcgaagggaagagagagaccagtcacgagcacatagcatg

SEQ ID NO: 59971 - DNA, 303 bp, Glycine max
  Peptide Sequence Number=SeqID_151656
atgagaattgattgccttgcgctattcgccaattctccattctccacttttattcggagccccatgaattcattaactagcgcttttcaatcatactccaccaacgagtcgggagccgcgcgaattgattgcctagcgatattcgccaattctccattctccacttttattcggagccccatgaattcattgcctagcgcttttcatgcatcctccaccaacgagtctggcggcccgcgaattgattaccaagcactgtattcgccaattcttcattctccacttttattcggagccccatga

SEQ ID NO: 59972 - DNA, 420 bp, Glycine max
  Peptide Sequence Number=SeqID_151657
atggtagtgcgggcattcgacgatagccaccgggatctgcttattaggccaaccttggattcattcggttggggtagtcctttcaacactgcaccagaagttgaaatttgtggtggaagggcaattgattatagtctcgggagaagaagacattcttgtgagttgtcattcttctatgccttatgtggaggccatggaggagtccttggaaacatcttttcaggcattggaattggtgagcaatgcttacgtagagtctcccccggtacaaccacgctcatctggggccgcattgatgatagctcgggtgatgttgggatatggatacgagcccggaatgggtttgggatggaacggaaatggcgtagcgattttggtagagttcacaaggaaccgcggaaggttcggactgggatatga

SEQ ID NO: 59973 - DNA, 641 bp, Glycine max
  Peptide Sequence Number=SeqID_151658
ggctacacgccctcatcttcaaaggggtacacgccctcaccttcagaggactaaatgttctcgccttgagaggactacacgtcctcgccttcggagggctgcacgccctcgtcttcagaggactatatgtcctcccctttagaggactacacgtcctcgccttcggagggctatacgtcctcaccttcaaaggactacacgtcctcaccttcagaggactacacgtcctcaccttcagagggctacgcgtcctcatttttagagggccaactatgcgagcacaaccagaggaaggctatcgcgcagctactgtgcatactggggcaaggggtcgcgcccacaagacatccagtggccccggagaagtccaacagggccctggggtctccagctttggttacgggcctctgtcattcctacagggtgctcattccccccagcaaggacacccagtggacccaaagaagtccaacagggtcctggggtttccagctctgattacgggcctttgtcagttctacagagtgcccgtcacccccaacaaggtcatcaggcctcctactaaacgagctttcatcaagaagtattgcgcccccaggcaggtagagggcgagacaccacaacagcctggggatggctag

SEQ ID NO: 59974 - DNA, 516 bp, Glycine max
  Peptide Sequence Number=SeqID_151659
attcaaaggactaaccacctaagaattctttgtcttaacacattggaaggtacatcctttgtggttcaagtagagggtacatatacttgggttgttctaactgagaacaagagagggtacatctcttgtggatcagttcaagtggagggtacatccacttggttgttcaaagagaacaagggaggatacatcccttgtggatctttgcttgttaaggattttacaaggttgaaagaaatctcaagaactggtgtttgcttggggactgaatgtgatttggctgatttggacttggagattgaagttacttgcaaaagaaacaacgcagaaaggcagagaaattttttacaagaaagggcagtaccaattctagaggaacctcgatcttctgagtcgtcttccagttttctagaaagaagggaatctgaaactgcagtgcctgaagtcgacataatggctgaagagcaaccgagaagagtaacccttgaagactactcaagttctattgtgccgtag

SEQ ID NO: 59975 - DNA, 261 bp, Glycine max
  Peptide Sequence Number=SeqID_151660
atgaatcaagctctagatgatcgagaagcactactaggaggcagcgtagttattttttcgcaagaaatggctccgaagaaactctccacgaagaggtctagaagggacgccactggagaaggctccattgccgcctcagagtttgatagtcaccgttttcggagtgtcgagcaccaacaacgcttcgaggccatcaagggatggtcattccacagggagaggcgtgtccagctcagggaagacgagtaccctgacttctag

SEQ ID NO: 59976 - DNA, 195 bp, Glycine max
  Peptide Sequence Number=SeqID_151661
atgatcatgaggggtcaagacatttatagtagtcaagaggagactacttctttcccttcctctagtggaagtgaagatgatgtaaggggtgaagagtctagtgaggatgtctacccccatgaagaaggtgacctcttaatggtcagaaggctccttggagtggatcttgttgcaattgttgtagcacaagattag

SEQ ID NO: 59977 - DNA, 942 bp, Glycine max
  Peptide Sequence Number=SeqID_151662
atggctgcttccgccgcattcgacgacgccaagcacggcttttctcggccggagatgtacaaggaaaacctcgccggcaccttggacgcctacgaccgccacgtgttcctctgctacaagaaccacctcgcctggccgcctcgcctcgaggcctccgacgccgatcctcttcccaagcgcgtcgccaccgtctggagagctcgcaaaaacgacatcgccgtcaagacgaaaatcacggtgtgcgaggcgcgtgaggaggcaggtttctccgacggtgatgcgttgattttccccgacatgatcaaatacaggggtgtggaggagtcaaacgtggatgtgttttttaatgatgtgatagtgagtggtaaagagtggagtggtggaaagcaagggaagggggtgttgaagggttcgcatatatttgtatgtgctcatggaagtcgtgatgtgcggtgcggtgtttgtgggccggttctgatggacaagttcaatgaggaaattcagctgaggggattgaaggatcagatatctgttttggcctgttctcatatcggtggccataagtatgctgggaatgtaatcatattctctccaggatcagatggaaaaatcatgggtcattggggtcaaatggggccacccggtgccgaaatcaaggtagcagatgaccataaacttgctaacggagtttataataacaaggccaatctaagcaacaatgaaaatgttacaggatgctgtcagggtgttaatggggtttcttgctgcaggactgcaagttttgatgataaaaccgcagaagcatataaaaagcaagggagcaataatataagttggtgtttgcctgtattaaagaagcgtgacattcttacggctggtggtatacttggagctttggcagctgttgctgtagctttcagattttacagaagggcaagttga

SEQ ID NO: 59978 - DNA, 890 bp, Glycine max
  Peptide Sequence Number=SeqID_151663
tcgatgggagaaggcttggatctccgttggctactacgatcgccagctcaactttgtcactagcgattgctgcaaccgcatcagggcgcgtggcttttcttcttcgttgttccttagaaggctggtgggcctcatgtttggccttgaagaaggaagcatgggggagggtttttcgtttctcctcgacgtttggtgtaagcgcaaaggagggaggtgaggatgatgacaacaaagttcgaccaagacgaagaaagtccataggtttcaagttgggggagttcgaccacgatggtgccattgatgacaagtgccatagaaatcaaacaatccaaaatgacaacgatatggtagactcaaacaacagagataggtatggtgatagaagcaggggacatgggggaaatggagacaacaaagcacggtctgaaagaggtgcaagagatttggattcccctgctgacacgaaagacagagatagactcatgggaagacgcggagatgatgattacaagtggaaagatgagtgtgactccagaaaaagagatgaagacgatggctacagggggaaagatgagcaagactcaagaaaaagagatgaagatgatagctatagagaaaggcgaactagtcgagatgataggagaaacacggattctagccatttggagagaaggaatgaaggagattatagtaagagacctgaagacagtggaaagcaagatatgaagatggattatggacgaagaaaaggaagtccaggtgatgaagattacaagaatggaagggatgatgaagattacaaacatagaagggaagaacgtgggcataaaagacaagatattgtatctgatgattatcctcataggaggcatcatggtgacaggagatga

SEQ ID NO: 59979 - DNA, 1659 bp, Glycine max
  Peptide Sequence Number=SeqID_151664
atggccatgcttgtttatgaggctgtaatagttacagcagtcctctgcatgctatacttcctacatcggaaacgatgttgcagacaccctctcttccctgactaccccatcatcggcatgctaccaccagttctctgcaatttgtggcgcgcccatgatttaatatccgatgtattgaaacaacatgggggcactggtgagttcactggaccttggttcaccatcatgaactgtttgatctctagtgaccccatcaacgtgcaccacgtcatgagcaagaatttccacaactacgtcaagggacccgtcttccgtgacatttttcaagccttcggagacgggattttcaccgctgattccgaggcctggaaatacaacagggatctcttccattctctctttaaaaacagaagcttcgagttttttctggagaaaaccattcagaataaggtgcagaatagcctccttccaatgttggatcatatgcaccaacaaaggaaggtggtggatcttcaagatgtcttcggtcgcttcactttcgataacatatgttctttagttcttggatatgaccccaattgcctctccgttgatattcctgaagttgcaattgagaaggcttttaacgaagcagaagagtccatattctacagacatacagtgccaaagtgtgtttggaagctgcagaaatggcttcaaattggtcaagagaagaagatgacagaagcatgtaaaacacttgatcaattcatacatgcatgcatagcttccaagagggtagagctaagcaacgacaatgaaatgggtgaagctcatcatgttgacttgataacagctttgatgagagaaaaacaaacacacgacgatagatttatacgagacgctgtgtttaatctttttgtggctggaagagataccataacttcagctctcacgtggttcttttggcttgttgccacaaaccccttagtggaagccaagattcttgaagagatcaaagaaaagttagaaaccaatgaaaagacgcttggggttttaagtgtagagaaggttaaaaagctagtttatctgcatggtgctatatgcgaaacattgaggctctttcctcctataccttttgagcgcaagctagcaattaaagctgacatgcttcctagtggtcatcgtgttaatccaagaacaatgatattaatttctttgtatgcgatgggaagacttgaagaaacatggggaaaagattgtttggagttcaaaccagagagatggatctcagagaaaggaggtattgtctatgtgccatcttacaaattcatagcttttaatgcaggacctaggacttgcttgggcaaagacttgtccttcattcaaatgaagatggtggcagctgctattttatacaagtatcatgtccaagtggtggaagattatgttgctactccaagcctttccattgttcttctcataaaggatggtttgaagacaacaaactgggaaccacctcaaccaggtttcatcgaatgtgctaaggaaggccagtgttttgatgtgggggtgtggttctgcgtgatcacaatggaacattcattaaggcacaaactgttcttcaacctggactttaagatcccaaagaagcccagttgtggggatcggactatataa

SEQ ID NO: 59980 - DNA, 369 bp, Glycine max
  Peptide Sequence Number=SeqID_151665
atgaacaagacaaattgcatgatcgatcaaagacgacagaatagcctatcattggcattaccaacatggactatttatctgcatggtgctatatgtgaagcattgaggttctttcctcctatacgtgtcgagaccaagcaagcaattaaagctgatgatatgcttcctggtgatcatcgtgttaattccggaccccgaacttgcttggggaaagacttgtccttcattcaaatgaagctggtggcagctgctattttgcagaagtatcgtgttcaagtggtggaagatcatgttgctaccccaagtctttcaattgttcttcttacgaagaatggtttgaagttacatataccaaaaagagaaatttaa

SEQ ID NO: 59981 - DNA, 1458 bp, Glycine max
  Peptide Sequence Number=SeqID_151666
atggatttgatgtctggttataagggggttgttgggcttcttgttggcaacgagaattcctcaaatgaagatagatatgttgagcgcttgcttgaccggataagcaatggtaaactaccagaggacaggagaaatgctattactgagcttcaggctgttgtctcagaaagtcaagctttccagttagcatttggggcaatgggctttcctataatgctaagtgtcttgaaggaagaacgtgatgatgttgagatggttcgtggtgtcctggaaacacttgtaagtgcattgactcctattaatcattcaaaaggggcaagtaatgaagttcatccagctttgatgaacactgatttactttctagagaagcagattgtatctctcttctcctaagtttgttggaagaggatgatttctatgtacgatattatactctgcaactattgactgcccttctcaccaattctccacagaggttacaggaagcaatattgactatccctcgtggtataactcgactaatggacatgcttatggatcgtgaggtaataaggaatgaggcattattgcttcttactcatctgacccgtgaagctgaggagattcaaaaaattgtcgtctttgaaggtgcatttgagaagattttcagtatcataagagaggagggaaattcagatggtggtgttgtggtacaggactgccttgaactgttgaacaatttgcttcgtagcaatgcatccaatcaggtactactaagagagactgtaggacttgactcattgatattgattttgaagctgagaggaagtagtttcacttttaatcaacaaaagacaatcaatctactcagtgcattagaaaccattaaattgttactaaagggaggttctgagtctgatcctgggaaagatatgaataaacagacaaataagactactctggttcagaaaaagatattggaccatttgttaatattaggggttgaaagccaatgggtacctgttcctgttcgctgtgcggcaatgcgatgcattggtgatttgattgctggagattcaaagaatcgtgatcttcttgctagcaaagttcttggagaggagccacacgttgaacctgctctgaactctatacttagaatccttttgagaacttctagcatgcaagagttcattgctgctgattatattttcaaaagcttttgtgagaaaaatgctgatggccaatcaatgctggcgtctacgctaattccacagccatattccatgaatcatgcattcctcgaggaggatgtcaatatgtcttttggcagcttaaagattgttaactgtttctttttcagcatgctattacacagtcttactttgggtgaaaatggtgatcttgagacttgttgcagagctgctagtgttctatctcatatgttgaaggaccatctccaatgcaaggaaaggagttaa

SEQ ID NO: 59982 - DNA, 2646 bp, Glycine max
  Peptide Sequence Number=SeqID_151667
atggatggctcagcctcaaagcctggtaacacaacaagaggaattggtttggttaaagccggtgttaacttatgtggtaacaggaatattgcagatgttaatagtccttcgctgaaaaaagatttctcaacggtatattctttaggtgtccttttaattagagcacttgataacaacattgttttgttaaatattcctcagaagcactcttcaaaagcaaaagaactccacagagcaagcaatgatattgttcggtacgaagagaccaaatgggcagcagaatctgcaaaagctcaagcagaagctgagctttccaatgctaaacagacagtgaaagatcttttctctatgattggggaatctatctacaaggcaaaagccgaaatgcgagacatggcaccactaaagaagtatgtgaaaccgagcaaggatgataatgagtattcacaagttatgagagaattggaacatgctaagcgggaattgttccaacttaagcttgatgtgggttctgttttggaggagaaactgcgagcggagaaggaaatcgaagcatcgagatccaccatgctgtccttctcaagagtagcacaaaaactgaggaaggagattgaggaagccagtgaagaacaagtggtggttgaattggccagaatggacgctttgaatgaactgagagacattgaaactgttgaaaacacaaggaacaagttgaaagaggccattgaagagatagatgagacaaaagagctcgaaatgaaattggccacgacattgtctgatattgatatgttgaagaatgagttgaagtttgttaagaaaacggggaaaagggtacatgaaagaggtggtgagagcatggagcatatagaagaagatcaatcaagagatgttggtgtgttagaggctacaaaagaagaaatagaagcagcaaagaaagacttggcttccattagagaacaaggttttaagtttatggcctctatggatgtcacaagaaatgagctgaagcatgtgagtgcagccacgaatcatttaaagaacacggaatcgaaaattggtgcaaaagttcgaaacctcagttacaagctcttgagagcaaaatctaaattagaagccgtgtctgctgcagaggaaaaggccaaatcaatagtcagtaacttgtcaaaaactcttgataagctcaagtccgaaacagaagcagcaaaaaaagaaaaagagcttataataaatggagaggttgcaggcaccaaagaagagattaaaaaggccttgttggagataaaggggagtgaggaaagatttcaaggtgccatgcaggagctagaagcagtgaaatcatcagaagctttagccttggagaagctcaagattcttacggagaatgccatgaaagagagaattagtaatttaacaaagcctagttcgttaattataatatcaaagtttgaatatgagtatttgagaaaccatgcagggaaggcaaatgaaattgctgagaagaaagttgaagcggcaaaggcgtgggttgaagctgtgagggagagtgagaaggagatagtgatgaagactaagatagctgctactgagggaaaagcaaaagaaaagttggttgcaaagagagttaataatgaattggagttggagaattggtccaagtatggcactggcatttcgagaaagagcatcaagacgccttctagaggagctaattctaagtttcatcagaaggcttcttcacctcatcgtcctgtcagtcctttcattgttaagaagaaaaacaaggagtggaaccctaaagctacaggtctccttcctccgtccaccatcgcaccaagtcgcagcttcatagcagcaccgcaccgcaccgcaccagaaaatggaacatcaagtcatgttgtagaaggggctgctgatgctgatgctgatgctgagctttctccaccatcacaaaaaggagatgacgctaaagaagtttcaaagaagaaaaagaagaaatctaaaagcaagaaaaagaaagaactcttacaacagactgatccaccatcaatttctgttattaaccttttcccatctggagattttcctgaaggtgaaattcagcagtacaaagacgataacctatggagaactacttcagaggagaagagagaactggagcgcctgcagaaaccattatataattcagttcgtcgagcggcagaagttcatcgtcaggttcgcaaatatattaaaggcattttaaagcccggaatgttgatgactgacatatgtgaaacattggagaacactgttcgtaagctaatatcagaggatggccttcaagcaggcattgcattccccacaggatgctctttaaattgggttgctgctcactggaccccaaattcaggggataagactatacttcagtatgatgatgtgatgaaattggattttggtacccatgttgatggatatatagttgactgtgcttttaccgtggcattcaaccccatgtttgatccactgcttgaagcctctcgtgaagcaaccaatacgggtattaagcataaagctaaatatcagtatcattattataagaatgttgagagaaccataccacaaaagctaggcattgtagttggagagcctaaggctctataa

SEQ ID NO: 59983 - DNA, 456 bp, Glycine max
  Peptide Sequence Number=SeqID_151668
atggccttttccttcacattctgtgtcttcattcatgttgttactcggatatttaaattcaatggtgcagaacaggagagcaacaagtacgtggaagcctatgctgtggggagaaatattcgtatgtctgctaataaagctcgaagagtgattgatcagattcgtggaagtaaatatgatgaaacactaatggtattagaactcatgccttatcgagcctgtgaagccattctcaaaatagtgttttcggctggagcaaatgctagcaataatctgggtttaagcaaaggaagtttagttatcagtaaagcagaggttaatgaagggaaaacaatgaaaagggtaaaacctgtagctcgagggcgtgcccatccaattaaaaagcgcacttgtcatataaccatcacggtaaaaggcttacctagtgagtccgtcgaggaagcaaagcctgcttaa

SEQ ID NO: 59984 - DNA, 261 bp, Glycine max
  Peptide Sequence Number=SeqID_151669
atgtcaatacattacctaccaactttgtacatattccatcattgggcacctgatttgcttgagctcctgtttcataaaggatctaaacttctgattggggaacttccttctatacttgatggatcagcaatagtaaaggctcaacctcaagatgactctaaggctacattggctcccaagataaatccagatgaatcatggctatcctttgatcaagaagcatctgttctacacaataaggaactagagcaagagcgttag

SEQ ID NO: 59985 - DNA, 2232 bp, Glycine max
  Peptide Sequence Number=SeqID_151670
atgactaccaaacgggcttacaagcttcgtatccttcatctcttgtcttctttctttgtgtgtgtgtgtgacttggctggccttgacgagttatgtccagaggaatttgtagcacatgcttctactgtcaattgcctcaagattggacggaaatcatccagggttcttgtcactggaggtgaagatcacaaggtcaatctttgggctattggcaaacctaatgccatactgagcctgtcaggacattcaagtggaatagattctgtaagctttgattcctctgaagtgttggtagctgctggagctgcaagtggtactatcaaactttgggacttagaagaggcaaagattgttcgtactcttactggtcataggtccaattgtacatcagtggacttccatccttttggagagttctttgcatctggttctttagacactaatcttaagatatgggacatcagaaagaagggttgtatccatacttacaaaggccacactcgaggggtaaatgcaattaggtttaccccggatgggcgctgggttgtttcaggtggagaggacaatactgtaaagttatgggatctgactgcggggaaactcttgcatgattttaaatgtcacgagggccagatccaatgtatagattttcatcccaatgagtttctactagcaacaggctcggcagatagaacagttaaattctgggatcttgaaacctttgagcttattggttcagctggtcctgagacaactggagtgcgttctcttacttttagtcctgatgggaggaccctgctttgtggtttacatgagagtttgaaggttttctcttgggaacctataagatgccatgatatggtggatgtgggttggtctagattgtcagatcttaattttcatgaaggaaaacttcttggctgctcatacaatcaaagctgtgttggagtctgggttgtggacatctcgcgtatagaaccttatgcacttaataatgtgaaccatctaaatggccattcagaaactaaatcttcaagtggaaatatgactgtactgaatgagatcactgctaaggctaggctatctgtttcacaaaatccagatcaattactaaaagaaacaagatctcttggaaggttgtccgtttctcaagattcagaccccttaaaggagggaaaatgtctagcatccacaggaagtgcaccaagtactcctcaaaggatcaatttgaattctggacccaaaacagtacccggtggttcaacaacagtgcttaatacaacagctcagaaaaagagttctttgaaatctcatacaacgtccagtgctccacttatcaataaatcagatattatacccgtaattgtccccagaactagcatgaggtcagagcctgtggctgattctagaaaagaagttggtgtttctggaagaacgatgccattcccctcacagtcaaaggcagcagatgtacgtaaatttccgaacaacagagatgatgtggataagcccctctctcctgtaatcgaatctgcagcttctaagggtagtgaattaagtggttttgcagataaaaataatttccctgcttctgtaagctcaacgcaagttaaacagagagcacattctatatccactgagaaggctacagtttctgctaccgatgaagattccattgctgatgtgatggaacagcatgacgaatttcttagttcaatgctggctcgttcagctaagttacagcaagggtctttgaatgttattaaaatgtcaacaggacacggttgtaggaagatggtcttcagatgttgggaaagaaatgatgttaaggaggtcattggcataatggcaaggatggatgatcatgctgtgattgctgatgttgttagcattataatggaaaaaattgatatcattacacttgagatatgtgctggtcttctgccacttctaactgatcttctacaaagtgaaatggaaagacatctaggaatatccttggaaatgctattgaaactggtcagaatatttggttcagtaatctattcaaccgtatcagctacacaacctgttggtgtcgatatcgaggcagagaacaggctagagcgttgcaacctctgcttcacagagcttgaaaaagtcaaacgttttttgccttctctttcaagaagaggaggatcaattgcaaaatctgcacaagagttgaatctggctttgcaggatgtttcgtga

SEQ ID NO: 59986 - DNA, 609 bp, Glycine max
  Peptide Sequence Number=SeqID_151671
atgaaggtagggaccgctattgaggtcaaaatggtatggtatcaactattgaacaatgaatgtcctaatgagtttaaagaacaagctcacaaagttctccacctgaaacttaaggtcatggacgagattgataaggctgattcttccccagcaatgcttgctatgttggcaaaggtaggaattcacgctcctgcattctcagaccctcagtttttgtgtgatgctaattctcttacttatgtgcttgggcagcctaaatatatcttgtattctgcgaagaagaagctgagagagggaggagatgattttgattggaatactgatgatgagcttgaaattgagaactataactcttcatcttcgtgtttaacccttcctaatggggatgctggagaggcaagctcgtctgcagttttggctaattccaaggtacttgaccacttcgtcaacatgggattttctagagaaatggtttctaaagtaattcaggaatatggtgaagaaaatgaagataaactacttgaagaacttctctcatacaagctgattggtggaactgagtggccatggactgcaatgggattcaaattgcagaatggtttttattag

SEQ ID NO: 59987 - DNA, 435 bp, Glycine max
  Peptide Sequence Number=SeqID_151672
atgcctactttctgggtggtttcttcccttgtaccagtagtaggtggagtggcactggcatcaatgactgaagtctctttcaattggattggattcactactgctatggcatctaacgttactaatcaatcgcggaacgttttgagcaaaaaactgatgactaatgaagaggcaagtcaagggctgaatgtcagagagctatgtgtcagatcagttcttgctgctttttgcttccatgcataccagcagatggtgtcacctgtgacccactctgttggaaactgtgtgaagcgtgtggttgtcattgtttcttcagttatattcttccaaattcctgtctcacccgttaacacacttggaactgggcttgcacttgttggagttttcttgtactcaagggcaaagaggatcaagtcagtccaaaagacaaattga

SEQ ID NO: 59988 - DNA, 507 bp, Glycine max
  Peptide Sequence Number=SeqID_151673
atggcctcttctagctactccaattctccatgtgcagcctgcaagtttttgagaaggaagtgcatgccagattgcatttttgccccatatttcccaccagaagagccacataagtttgcaaatgttcacaagatatttggtgcaagcaacgttagcaaactcctcaacgaggttcaaccccatcaaagagaggatgctgtgaactctctggcctatgaagccgaagcaaggatcaaggatccagtgtatggttgtgttggggccatttcagtgctccaaaaacaagtccttaggctccaaaaggaacttgatgccacaaacgctgatttgatccgctatagtgcttgcaatgaaatgccaaatcttggagggagatcaaggatgtgtagtgatgatggaggaggtggtggttcctcatcacttgctcactcccatggtttctattatcctaattggaacaatgatccttgtggaaataataatggctaccccagaggggatatataa

SEQ ID NO: 59989 - DNA, 7368 bp, Glycine max
  Peptide Sequence Number=SeqID_151674
atggagtcttacggtcctctcctagagaagacccaagtcccccaaccggcgctccaaaaactcgccgtcgattccattttctcgaagctccgatcagcacccagccacctcgacccagaatccgaacccggaagacgcgccatttcccaatgcctcgcctccccttcccctcacgtcgtcgaccactccgtccgccacctctgccgcctcgccgccgactccgccgtcgccgtcccccgcgcctccctcgagctcctctccgcgctccaaggatccgacccgaaactcgtccccatcttcgtcaagggactcggtttcctcgctcgccacgatttccgccacaaaaatagcgcctcgcaacaatttacttcttccactctcactcaccctttcgttagggaagttcaatccgaactcctacatcaggtgttgctgtttatgttgcagaataaggatgtgggaatggttcgagtttgtgaatttttaaggcccttgttgaatgtctcaatcataagattgtcggtttcggaatcctccttgtcctcgtcgtttgcaatgcaactggtgtcctctatggcggcgttctgttgctcgtttccgcacgagactgtgcctgtttttaagcttctaattgagtgccttaagtttcttccgcatgagagctctgaagactacaggaaattagtgtttgttgtagagcatatggtggaggcatatatagtggtgctgaaatctttggctggaaagaaatcaaatgatcttgggttaccatggctgcctggtttggcatcaactattgcatcattattcacaatcatcgttcaatcagaacttgaacacgaacaaatttctatattgaaactcctcctcttgatcctgaagtggaaatatgataatgatgctgctatcagtgaacctaaattctctttatttgaagaaactttgtttcttcttcccgttgttagtctcatgtcatctccttccaaatctgtgaaaggactggctactgatttgcttctcctcttggagaagctccttgtcaagatgtttgttgcaccaaaagataaaccaattgtcaaagggggagatcattatcttagcacgccaggagttatagttttgagacttttgcgacatctgtggtatcagaggatgcaagagattgatgttatctcaatgtattcccttgcagagatgcccttgttactcagtgctgttctcaatgttttattgatacatcaatcaatggcggctgctgctgttgattgtttgtcttccattgccattatggatcccaaactgggagttcctttgttgctaacaattatgttttacagtaatatattcataagaaatgatatcaatcaccatgatatgctgggtgttttactccctaaaggattcaccaatttcacttcggagagagatatctgcatcagcatggctgcttccattcgagatgtttgccataaaagccctgataggggtgttgatctcattttgtctgtttcgtcttgcattgagagccaagatcctgtaattaaagctattggcttgcaaagccttgccttcctttgtgaagcagatgtgattgatttctacactgcatgggatgtcattgcaaagcatgtgcaaggttaccaagatgatcctattcttgctcatagcctatgccttctgcttaggtggggtgcaatggacgcagaagcatatccagaagcatcaaagagtgtgctgcaaattttgtgggatgtagttacctatggtcagggtagacagtggggaaaagcaagaatttcagccctggaggcacttgctcaatatgaagtgccacagcttgagaatagtattccagatttcaagaaaatgaatttggagctgttcttttctgagacaaatcccaaagtactcaaggctatggaggagtttcatgtcaagttaataacatatgagcacataaatcgtcggagagtagtcaaggaaaaaagagttacaggaagcaagatcgaaaaattgatggatgtatttccacaggttatattctcttcaggagtgataaataaagctagagagttacctggtgcttctttattatgtttttctttccctcctaaagatatgaatgaacatctagcatccaaaaggttaagagatgtacatgctgggtatgaaaatgctctagtggaagtagctgcttctcagctctcaagaaatatcttgcttgcgctgatggcactgcaatcatggaaaggcttcatgcgacgttggatgaaggcttacactctgtcctatgatgctaaggcacaatcgagtgtcctagataaaacttctaaagctgctagtgatattttaaagagtatgatagcaatagcggatgaggctatacctagagctgctgaaaatattgcactggctattggtgcactttgtgtggttttgcctccatctgttcacatggttaagtctgctgcttcaaagttccttttggaatggttgttccaacatgagcatgaacaccgccaatggtctgctgcaatttctcttggattaatctctagttgccttcatgtaacagatcataaagagagatatcataacatcacaggacttcttgaggttctttctgatagcaaaagttcccttgtaaaaggtgcatgtggtgttggattgggtttttcatgccaagatcttcttaccagagttgaaacttctgatacctctactgtgatgaaggaaacagagtatgttccagaatctgtattactaggaagaattattagggccttagctacaatgatacaacagagaactcgatgttcttctgatgttttggacagtctatgttcatgctttccactgggttcatatgacatgagcgctaaaggatatgaacagttatctgagaacagtgaagacttggaagaagatatctggggtgttgctggacttgttcttggtctagctaactccattagcgcaatatacagagctggagagttagagactgttatcaagataaagaacttgttaatgtcatggcttccatatttgcattcactagttgaaagcagtactttccagtggaaagaatctgagcatgtcttagctctaggatcctgtattgcacttcctacagtagtggctttttgccagagaatggaattgataaatgatgttgagttggaccgcattgtggttggctttaaagagttaatttctgagttaattgctgtgaaaaagtctggcattttgcaccatagtttgctgatggcatcatgtgttggagctgggacagtactttcttgtatactgaatgaaggtgtttactctattgaggttgaacgtgttaaatgtttactggaactgttcaggaaatgttacttgaatcctttcccttttcttgtccatcttggtggcatgctaggagttgttaatgctgttggagcaggtgcaggaattttggtcaacatgaattttccaaattactctaggcaatctggctatcagaaggagtcttcttctgtcatgggccctctcctctcaagttctgattttgaaccatacttgacatcattggtgcaagagatgtttcttgtggcacagaattcggataatcatcagctacaacagtttgcttcctgggtacttgccttccttcgacatcatttatggtccaaggaacttttgggggttgatagtgataggagcgtggccgcaactaattcaaaatctgtttctcagagtttttcggaggacaatattgttttgaagcttagtttgtggcttacgagtttcaaatatactgagccaggtactattgtacatattagcagagtcattgctgtattaaggtgcctttctacagctcccaggttgccaagcttggattgggggtcaattattaggcgttgtatgagatatgaggccaaagttgctgagttgttaccaaaagattctgcttctaagaatggaactctaagggaggaatgcataatgtttgcaatggcccatgcaaatcaatttgattcactgctaacatttcttgatgagctatctgacttttccagattcaggacacttgaaataaatttgcagtcatgtctgctaaatcatctagcagaccttgtaaaagtatattcaaactccaggcttgagaaactatttggagatgtgagtaatcacttgtcttcctttacttcatacaaagagtctagcacctaccccaaaagcttgttatgtatttcgtgctggaaaggtctctacgagtgcctagatgaagtttctgtggactcatctggttacatatcccatattgaaaggtgtatggaggttctatttactctattgccagtggttcaatcttctggaagtgtatcatctgcggatgtaagttctgtagaggaatggtctgaagctgtaagatgcttagggaaggctccgcagatttggctattggattttcttaaggtttcacatgaggagtttgttcagagtgctggcaaatctattgaagtccaaaaaaaggtttgtgctaagatcaaactagtgaagactggttctctttcactgactgaacttggaaaaatgaaatcttacatattgaactccaaatcacaaggactctgggatatactctttgaagttgtggcagctttgtaccatgcggagggaagtgtaaaaaaacagtggcttattgatgctgttgaaattagctgtgtatccagttttccttccacggcactgcagtttcttggtctgttgtctgctgcctgctgcaaatatatgccctttatgattgtggaccaacaaatggtactgaatgatctaccagtcacccttgtgtctcttctggcagaccaaaactggaatgctgttgcagaaactgttgtgtcccacttcttctcatcaacagagcgcatatatgactggtctgtacaaatagcagatggttcttatattcctgattctcaacccattgatgggagtgagaatcatatggctgtttttctattgcaagtgatgcatcatacgtgtgtattacttaagagctacttgccattagataagcagcttaggctcgccagcatgttctcagacgttgtaactttgtcttctctctcagtctcgttgaaccctaacccacaacccatctccggtattcttgccctcggcttcccttttggcactggtcagaagggatctttctcatctctcacaccaacattctcaggggtggtggctcttctccttctccctatccttgccaagaacacctacatttccgagaatgccctcatgccaggttctgcaaacaacatgctctctactcaccatgtatctgatgcaaataaactcatcaaggacttaactgatttggagttcagatctggggcctcaccaattgatagtcaaaaacttattgcacattatatgtcagccttggatgctgaagttacttttcacaagttttaccctcaatttgatcagttccatccactgcacttctttaccagtcccaattcaggtataatctcagaaaatgcaacttgttcttcgtttggaatcaacactgttggaattatcagggcaccatgcggggatggcaaggaagctagtgtcttggtaacgccttacaatccaaataaagttggtctgggtgaggctttttccttgggcattgcttactcagtgttctcactgctttcacgtgttacttggctggcaaaagatattgtatggcttgtggctgattcacaatatggagaatattctggagtggctgcttggctaagagcatatcaggccccttctatccagagacttgacatagttaatagtgaaacatgtaatgggagcagcatttttaatgaacttggacagggtctttatttggatggaaagttatatggtggttttagacatgcaggaactatggctgcagctcttgtaattaaagttgcagagcaaggtaaccagtatgaagacagtcttaatatttatgcggaggcatccaatggccagatgccaaacctcgaccttatcaatattgtaaattatctggcagtacataaacaagggttgcggataaaagtgaagaagatgtggtctctgcttggctccaggtggctctataccttgggtgttatatttgaatccttgggaaaaatttctagaagcttaaatcctcagtggaagtttggtattcctgctactgagtatgttgagggtgctgctacactggcaagttcattgtattaccagggcttaggtgttcccactggtcctcatggtgccttccgtgattatcaagttgatgcaatcacactggaaatttcaccaaaagtttctcttactaaaatgatcaggcgtaatgaattcattctccgtggtggaaggttaattgaaggagtcatacgctcaataaacaaccttcttgagaagtttcatcagtcattttttttgtacctcttgacatcccctagcaagtttgtgtcagttggagtttacatgattccatttgcattacttgttgcaccacttccaatagttgcggcatatctccatgtcaatgctagtgattccactccccaaaccacatctgccttagaagttaatgccagcccaaaatcttggaaatggttgaattcggccaggaaggttttggtcattcatttatggggtgctgtcatctccttactcccatttttcctatgtcaagtacccaataccacaccaacaatgaactttgtattgtggggtttgctatcagcttttagcttgctaattttatacatgatattgggttcaccaatttttgaagctgctgcatctcgacctgagaaaaacaagtgggctagcttaaagtctgtaactatatcaactgcattcatcggtttgtctctcatgtccgtcattaactttgctacagcagagattggggctttacatattgtcccaatttgtctgatggctagaccattgaagcttgattttcaagctaggagttggagaaccttactaagggcctcttgtaatattgctttaggttttattgtgtttcctccagttgcatttgttttactgaaaggtgcatttgaagatttttatggtatgaattttggtgactattggaactgggtggaatccctttgggtttggaacagtgcaacttacctctatatcagccaagataaaatcgtgttatggaacccggctactcgggaactcgagctcattcctcctgcccttaagtataaaatgttgcattggcgtatggtacatggattttgttatgaccgtgttaaccatgactacaaggaaccacttagtggcactaaatggctccttggctttgatatcgaattctaa

SEQ ID NO: 59990 - DNA, 573 bp, Glycine max
  Peptide Sequence Number=SeqID_151675
atggcaatccaggcttatccggtttgggaggagttatgcatgacagttgtggagcttggattacggcaaggctttaaaaagatcatctgcaaatctgattcacagttagctattgatctcattcttggggataaccaacgcggcaagatctgcgacctcacgcatcaggcagccagcactgcgagttgccgcaccacggcaggcttcggcagagggccgattcagcggtcgcagattccggcaaattcgctgatcttaatcaacagcaccgcccagtccaccacagacggaggactaaatgctgaagccgatgaggttgacgaggcgggggctggggatttgggagaggatcttgatctcattttcggtggggctggtgcagttgccgcagtcggtgcatttggtggcgtggtttttagaggtgctggtggcgacaagtttggtcgtttggatggcggcgaggagcttgacggcgtccagggtggctctatagactctgccgtggctgccttggcccaggaaggtgtcggaggagaagccattggcggcggcgatgatgttggaaatggatag

SEQ ID NO: 59991 - DNA, 255 bp, Glycine max
  Peptide Sequence Number=SeqID_151676
atggcggttagtggcggcgattggacggaggaggaggaggagctgagagtgagagcgagagcgtggtgcgtgcgcctctcttgtgcgttggtggagacttttatttattgtaatattacgcttagcactctcacggattccgtagatgaacaaggttctattgcaatgtctttttgcaataatgttattggtagaccacctttggctcgtgaagagaaaaaggatctctttgcttgcaatctcctaaaagtgtaa

SEQ ID NO: 59992 - DNA, 408 bp, Glycine max
  Peptide Sequence Number=SeqID_151677
atgtcggtgctgattgtgacgagcttaggggaccttgtcgtcgatttgcacaccaacaaatgccccttgacctgcaaaaatttcttgaagctttgcaagattaagtactataatgggtgtctatttcacactgttcaaaaggattttactgcccaaactggtgatccaactggcacgggaactggtggtgattctgtttacaagtttctttatggtgatcaagctcggtttttcagtgatgaaattcatattgatttgaagcattccaagactggaacagttgccatggcaagtgctggagagaatctgaatgcttcacagttctatatcactctgcgtgatgaccttgattaccttgacggaaaacacacgaaaagaacagtaaaagtaaaatctgggcaaggctaa

SEQ ID NO: 59993 - DNA, 351 bp, Glycine max
  Peptide Sequence Number=SeqID_151678
atgaagtcaggtgacatgcggagatacccaggggcaagcaaacccgttgacacgcagagacttacgtcgtcttctgcaccttttgtcacccagggacagcgagtcaggtggcaggcagagataccttatggttatccgcacctttcgttgaccaaggcgaacgagttcgatggtatcgggatgatgttggttttacttttgtcgtccagagacaacgagaccggtgacatgcggcgaataccttatggttatccgcaccttttgtcaaccaaggcgaacgagttcgatggttttactttcttcatccagagacattcaagtccgacgatgcgcaagattcttctctgctag

SEQ ID NO: 59994 - DNA, 346 bp, Glycine max
  Peptide Sequence Number=SeqID_151679
atgactaggggcaatccaggcaatttacaaccctttgatcttgaaatagatagaacctttcatagattagttaggcatagtgtgcatcctgatcattctgtgcattttgagcattctgagtattcagttgctagtgattctgaatattctgattttaagcatttcactactaatttttatactgagaacatggctcaacctccacctcgtgagaggactcttagagagatggctgcacctgatttcacttgtgaaagcttgtgcattcaatatcctgatgagggtgttccatatgttctcaagactggactaatacatttgatgcccaagtttcatggtcttgcag

SEQ ID NO: 59995 - DNA, 225 bp, Glycine max
  Peptide Sequence Number=SeqID_151680
atgatgacaaaggtgatgaacaaaaagctcaaaagatcaaagaacaactcaagtgaatcaaagaacatctcaagtgaatcaagaacaagtcaagagttcaagactcaagaagaaagcctacaaacaagaatcaagattcaagattcaagatctcaagaatcaagatcaagattcaagactcaagattcaagaataaagaaaggactcaatcaagataagtattaa

SEQ ID NO: 59996 - DNA, 493 bp, Glycine max
  Peptide Sequence Number=SeqID_151681
gcttgaaaacgaggtcaggaagctaggagagcttctggtaatcgattaccaagggatcgtgatggaggcgcagctaatccatgatcgagtggagatggagtgcctagagggagcttgggacaccctcgaaggcaacgcgaggttccgatttcggggcacgattcgattcacggctacttcgttggtgcatccagatgaaccggcgcgtacgcttcagcgcactgtggagtggatactacccacgcctacaccatatcgtctagtggagccagtccaagtgatcgaggtaacgtcatccgaggaagacccagaggaggatctcgaggagctacctcccgagcctgctgtggatgctcttgactttctagagggtgatgaggacccacttcctgaggtggattctcccgaggaagtcatgtcggcatctgaggcagactctacggaggatagtggcccgagagagatggcgaccagtggaggctcttcatcatag

SEQ ID NO: 59997 - DNA, 351 bp, Glycine max
  Peptide Sequence Number=SeqID_151682
atgagtctggaaatcaaccagattgccttgcaccagcttatcaagcgtgatgagcaaacccttgaagtggtgctgcgcgattcgttactggaacccacggcgaccgttgtggagatgatggcagagctgcatcgcgtctacagcgccaaaaataaagcctacggtctgttcagcgaagagagtgaactggctgatagcctgcgtctgcagcgtcagggcgaagaggatttcctggcgtttagccgcgccgcaaccgggcgtctgcgcgacgaactggcgaaatatcccttcgccgacggcgggatcgtgctgttctgccactaccgctacctggcggttgagtatctgctg

SEQ ID NO: 59998 - DNA, 160 bp, Glycine max
  Peptide Sequence Number=SeqID_151683
atggcagagccatcgaagaagagaccgggatcatcctccaccggtgctgctgctgcccatcgccgccacgggccatccggagcaccacaagacctattcctccttctttgtcatctccaagatcatcaacattgttttcttccgatgatcagtgtctacg

SEQ ID NO: 59999 - DNA, 225 bp, Glycine max
  Peptide Sequence Number=SeqID_151684
atgccccaccaagaaaaccatgattatgagggccaagacatttatagtagccaagatgaggctactacttcaccttcctcgagtcaaattgaagaagcaaaagggaaagaatctagtgaagaaatttacccccaagaagaaggacaatctttaatggttaaggaggagtgtaaggagacacttgttagcactgtcacacctcttgggcttgaggttattcctcaa

SEQ ID NO: 60000 - DNA, 213 bp, Glycine max
  Peptide Sequence Number=SeqID_151685
atgacaaaggtgatgaacaaaaagctcaaaagatcaaagaacaactcaagtgaatcaaagaacaagtcaagagttcaagaatcaagaagaattcaagactcaagaagaaagtctacaatcaagagtcaagattcaagattcaagatctcaagattcatgatcaagattcaagactcaagattcaaaaatgaagaaaagactcaatcaagataa

SEQ ID NO: 60001 - DNA, 456 bp, Glycine max
  Peptide Sequence Number=SeqID_151686
atgacttctccacatgcctcccatcctcctcctcctcctctttctcctcccccttctccttctactccttcggacgcattggcttctccgtctgccgtgaagcagacacgcaaattctcacgtctacgatcgttgtctagtagaccacttggtgctgagagaccagtggtccatgttgatcctgctaccggcaaggccgatggtccccacaggaagaaattaagaacatatttggggattgtgacacgtgataaggtggacatcacctacgagaactggaaggagacggaatttgaaatcccagaggcttctgacagtaagacgaaaaggaagttacttcagaccgtgggggagagggggaggcagtttaaatcagacctcacgaggaaatgggcccttgcagctgatcaagacggtgtggaggacactgtttgtgagaaatacgacattagctag

SEQ ID NO: 60002 - DNA, 402 bp, Glycine max
  Peptide Sequence Number=SeqID_151687
atgtcgaattacaaaagcactgagtcagcattgaagaaccttgagacccagaatcccaaagaagaatgtaatgttgtgatgacaagaaacaagaagcctgtggcagttgaggatgagggtattgtggccttgaaagaacaaactgttgtaaaggacagtactgggaaaacgaacgaggaggtaacagatgcaataagtcaaaggagggaaaaacaaataatggtcgtagagaaagaaataaaagacaaagaaaaagaaatagaggtaggaaaagacaaagagaaaaaagaaaaacaaaaagttgagaaaaataaagatgaagaaaagtgtaggagtgaaaaagcaagagaaaagaggaaagaaaaagcttcagaggagggtacggaagtgccatatcccgtg

SEQ ID NO: 60003 - DNA, 693 bp, Glycine max
  Peptide Sequence Number=SeqID_151688
ggaacatcttctacccccgctgctactggccatcgccaccacggaccatctgaagcacccacaacacctattcatccttccttatcatctccacaatcatctactatattttcttcagatgaccaacgtctacggtacaactctcaattttcttctaggatcatcttagaccctaagtacctagacacaaatttctttaatgatgagacatttgactgttatcaagtgtttcaaaactctggattggttgattttatgtccttaaaattgccttactatcctgaacttgttaaagtcttttatagcaatttaaaaattcaggatggtattatttcttttgaggtgcatggtatttctatgatcattgatcaatctctgttcttttcattgactaaattacccagtcaaggtgcaccttttgagggcaccattgttgatgactggaaattcgactattctagtcatgatgctcgccgtatggtttgtaatgaccaggctgaaatgactggtagattgctggccggatcattaacctttcattatcgcatcatgcactatattatcgttagaattttgctggacttgattttgatgtgggctttccttaccagtcgtcagatcgactgggctcacttgtttaggtaccaaatgcataaggcattacgggccaatgcacctcttccatatccttaa

SEQ ID NO: 60004 - DNA, 762 bp, Glycine max
  Peptide Sequence Number=SeqID_151689
atgattcttgatgcattctctcttcaggggaaagtcgcggtagtgaccggctgcgacaccggtttaggccagggcatggcggttgggctggcggaagcgggctgcgatatcgtcggtattaatatcgttgagccgacggaaaccatcgagcgcgttaccgcgctggggcgtcgttttttgagcctcaccgctgacctgcgtaaaattgacgccattcccgatctgctggcgcgcgcggtggcggaattcggtcatattgacatcctggtgaacaatgccgggctgattcgccgcgaagatgcgattaacttcagcgagcgcgactgggacgacgtgatggatttgaacatcaagagcgtatttttcatgtcccaggcggcggcaaaacattttattgcgcaggggaacggcggcaagatcgttaatatcgcctctatgctctcgttccagggcggcattcgcgtaccgtcttacactgcgtccaaaagtgccgtgatgggtgtgacccgcctgctggcaaacgaatgggcgaagcataatatcaatgtgaatgcgattgcaccgggttacatggcaaccaacaacacgcagcagttgcgcgccgacgagcagcgtagcgcggaaattctcgaccgcattccggcggggcgctggggacttccgggcgatctgatggggccggtcgtgtttctggcctcgtcggcatcggactatatcaacggctacaccgtggcggtggatggcggctggctggcgcgataa

SEQ ID NO: 60005 - DNA, 166 bp, Glycine max
  Peptide Sequence Number=SeqID_151690
cataagcttcaggctgctcaattgctccaggttgctgcatggaagggcaaagatttctgattcaaggtgtcgcaacctacccttcggcgggagggcgacgcgagactcgcgggatgcgtgttccacgaaaggaatacgcgcggattcgccaccaacgtttatttga

SEQ ID NO: 60006 - DNA, 667 bp, Glycine max
  Peptide Sequence Number=SeqID_151691
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccggaacacctttaaagagttggaatcatctgtttatgtgagttttgggagtattgcagcaataagcaagactgagttcttggagatagcttgggggttagccaacagcaagcagctgtttttgtgggtgattcgacctgggttaatccatggctcagaatggcttgaaccattgccaagtggattcctagagaatttgggaggaagaggctacattgtcaaatgggaccaaaaggtcaatgccaaatatgcaagcagtgtttggaaggttgggggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 60007 - DNA, 414 bp, Glycine max
  Peptide Sequence Number=SeqID_151692
atgggtgaagtagaggaggtgcaagagcagatgaaggccgacatggaggccatgaaagagaaaatggccaccatggtggaggccatgatgagcatgaagaagataatggaagccaatacggttgcaattgccgctaccagcactgttgttaaggtgaacccgatgcacccatctgatctcaaccaaatgaatcatccaacctcagatatggtgggcaaagatttgggaagtacggacgaccccatgatgtggaaattcaaaacaagaacgccttcccgccatatggcttgcctcctaaggaggatgtcaataactcctctcccatactcattgaaagccaacaacctcaatctgatcatgcacatgtctctcaacccatgggggagacacatggaatgccccaccacaatctag

SEQ ID NO: 60008 - DNA, 460 bp, Glycine max
  Peptide Sequence Number=SeqID_151693
gtcgactctagaggatccccctacggtggaaagaaggaggggtaggagtgttatgctcaagcgaaggattcccaaatgtccccttgatagggatgagggaaaagataaggagcttaggggaagtagcaatgacatcatcagtggctatcacaagtggttgaagtctagaacgcaagggataacttggctcccaaagctaaaaagtctaagtgggaaggaggttgaaatttttgaggaaagtgaagaagtgaaagctttgaaagtagagctcgaaaagacaagagtggtgaaagagaagctgaaggtggcaatcactaagggcccgaaaggaagaatggagcaggaacaaggtccgaggggctctgtggacaatagtaacgagctcaagcttagaaaggccaagagggatgaatcaaggatggaaagcttggtgttagaggataagttaaaggcttgttag

SEQ ID NO: 60009 - DNA, 441 bp, Glycine max
  Peptide Sequence Number=SeqID_151694
atggacccagataagtccaaccgggccctgggatttcccgcactgatcacaggactctgccagtcgttcggagtccccgtggcacctaccaaggccgcaggcgcaccaccaccacctcatcgggctggcccggctgggtcttttgatatggagcagtatttacggcatttggttcgccagcaggcggccaaccaccgggcacatgtacagacccatgattgtctgtaccagctgagcctcagcatgcagagccagggcttcgcttctttttcatgccctactccagaccagttcagggcaggggtcgcatggcccggggattggcccgaggcccaagcaggagaggcacccccagaggttcccgacgatggagaggaggcccacgaggacgaggagatggccgatttgcttgacttcttgggagggagtggagctacatga

SEQ ID NO: 60010 - DNA, 258 bp, Glycine max
  Peptide Sequence Number=SeqID_151695
atggaggtggaagtgatggttccaccggtggacttcaacttcgacagcaactgctcctcccccttcatcaccgccccttcaagcccccaattctttgctgcctccaacaaaccaaacttcggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 60011 - DNA, 409 bp, Glycine max
  Peptide Sequence Number=SeqID_151696
agggctgcacgccctcgctatcggaggactacacgtcctcaccttcaggggactacacatcctttccatcagagggctacacgcccttaccttcagaggactacacatcctcgccttcagaggactgcacatccttaccttcagaggactgcatgtcctcaccttcgaagggctgcacgccttcgccttcagaggactacacgtcctcaccttcggagggctgcacgccctcgccttcagagggctgcacaccctcgccttcagagggttgcgcgcccttgccttcaaagggcgacacgtcctcaacttcagagggctgcacaccctcacctttagagggctacgcgtcctcacttttagtggactccatatccacaccttaagagaatttaaggtcctctgcccttaa

SEQ ID NO: 60012 - DNA, 105 bp, Glycine max
  Peptide Sequence Number=SeqID_151697
atggagattcttcaccgttcttcatcgttcttcgttcgttcttcgtcgttcttcggtcttcaacagcaaaatctaaccgatcgttcacattataaccacggttaa

SEQ ID NO: 60013 - DNA, 171 bp, Glycine max
  Peptide Sequence Number=SeqID_151698
atgcagtgccttatactaggtgtcctatttgtccacagttcaaaagatgtctttggaactgccttactaggaaccctattcaacaaatacatgacagttttcaaggcatacatccacaaagatacagcaaatggacctgggtgttgcccagtttcatcatatcttccgtaa

SEQ ID NO: 60014 - DNA, 318 bp, Glycine max
  Peptide Sequence Number=SeqID_151699
atggacgtgttatcccccacattgtttgcaaagaaagtgaatgatccggcagttaaacaggcgacagtgaatggccccggtacaaggaaggaagtaggccaatccaatgggactagcaagaattctgatcatgacgagattctgaaactgatccagaagagtgagtataaagtagctgaatccccagccctgctgccaaaaacctttccacagaacaccccctctcacagatacctccctggtatgcgatatctcaaagcggtcccttacaagtatagtgccacgatgttggaaggtgggccaggaggtgccatttaa

SEQ ID NO: 60015 - DNA, 201 bp, Glycine max
  Peptide Sequence Number=SeqID_151700
atgcaccctaagttcccggatgaagacatcatggccctattcgaagagaagcggacgcacgaggatatagacaaatggattgtttgcttcgacggggcatctaatgctttgggccatcgagtaggggcagtccttgtatccccagatgatcagtgtattcctttcacggccaggcaaagttcgtcaagtataggaatgtag

SEQ ID NO: 60016 - DNA, 249 bp, Glycine max
  Peptide Sequence Number=SeqID_151701
atggaacagaatgttcctgccaaaaacagcactggagaccacatgtccaacatccctttcgacatcatggaacgcagcaccagaaaaggtcagatggaaaagcccagtcacagcaaaggaattcaatgccatgatgtgaaggtatggacacatcaaagccctttgtctaatgctcccactcatctcaagaagcaggaggaaaggactttctgtatgtcggtcgatgatacaaaggacacaagaaagtga

SEQ ID NO: 60017 - DNA, 282 bp, Glycine max
  Peptide Sequence Number=SeqID_151702
atgccttccaaggttattttgatgatgccaaagaatcaagagttaagcaaattccaaagattcaataatcaagtttcaagaatcaagaatcaagattcaagattcaaagaatcaagtttcaagaatcaagattcaagaataatcaagatcaagattcaagaatcaagagaagacttaatcaagatagagtcacagctgttgatgtgtaatcgattagaccttgatggtaatcgattagaccttgatggtaatcgattaccagtgactgattttgaaaaataa

SEQ ID NO: 60018 - DNA, 432 bp, Glycine max
  Peptide Sequence Number=SeqID_151703
atggtagacactttgccagtgttctactatgagaagctagtaggttacatgtcgtccagcttcgtggacttagtgttcgccggggaaagaatcgaggtaggattgaaaagaggaaagttcgattacgtttcctccacgagtgcgaatgccaaaagaatcgggacaacgggggcaaaagggaaggaaggagatgcccatgccgtctcttcaacgcccgcatgggtcaaacccccgcagacacctcatggtacccatcagtacgcacaacatcacccgagcttctcggctcacaccgggaacgcctctagttcagcacctgtgcaacctaaggcacccacccagagggaagctccccaagctccaactccgaacacaactcgcccggccggcaattccaacgcaataaggaacttccctccgaggccattttaa

SEQ ID NO: 60019 - DNA, 560 bp, Glycine max
  Peptide Sequence Number=SeqID_151704
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccagagccggaggcttcgaaggaagtgttggagacagaaagaagagagtggtcatggtcatgtttgtgaaagacagaagaggaagtggaagtgaggttaagaaaagaagaatcagagacagagtggttgttgttgaagtctatgtcaacaggggaattggagagagagtcgagtttgatgtcgttccagacatgctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 60020 - DNA, 206 bp, Glycine max
  Peptide Sequence Number=SeqID_151705
gtttgattgtgattatttgggtcgatgacccttctgttttgggtttttgggtagatgacccagcctggattggtgacccagaggttgtggaagaactctttttgacagttggctctggtagggccaacttgaatcctttgcatgtgctctgtcctccccttagggaggcgcctgatgccttaggtgacattagaatttgtctgtaa

SEQ ID NO: 60021 - DNA, 741 bp, Glycine max
  Peptide Sequence Number=SeqID_151706
atgtcctcacctttagaaggctacacgtcctcgccatcacaggggactagacgtgctcaccttcagaggactacacggccttaccttcagatggtacatgccctcaccttaaaaggactacaagtcctcgcctttagaggactacatgtcctcacctttagagtactacacgtcctgaccttcagagggcaacacgtcctcaccttaaaaggcccacacgccctcgccttcagagggctacacaccctcaccttcagaggactactcgtccctgccttcaaaggactacacgtcctcactttcagaggactacacgtcctcaccttaagagtgctacacacccttaccatcagaggactacacgtccccgacttcagagggctacacgtcctctccttcaggactacacgtcctcactttcagaaggctacacgtcctcgccttcacaggggtaaatgccctcaccttcagagtactacacgtcctcgctttccgaggactccacgtcctcgctttcgtggggctacacgccctccccttaggacaacatgccctcaccttcagaggactacacgtccccgccttcagagggctacacgttctcaccttcagatgatacatgtgctcacctttagatggctacacgcccccgccttcacagggcttgatgccctcaccctcaggggactacatgtcctcgctttcgtagggctagacgccctccccttcagaggactacac

SEQ ID NO: 60022 - DNA, 367 bp, Glycine max
  Peptide Sequence Number=SeqID_151707
tgtagtttacaaaagcaaaggtgaaaggaaaaatattgagctggtagaggaggaagaggcacggattggtgctgattcttctagtgcaacctctattaaatctgagattataaggaggaagcagggaatgcagcatagaagcataaagcaaagaggttcagattgctctatgcattctgaagctgaagcactggaacatatgaagaaaagagatacaggacatcaaagtgtgtcattgaagaataagacaagagattcaactgtgctgaaggtaggagatttggctaaagttgtgataaaacaagacatgaagggaagaaagcataaatatgagtttgacaacaataaacgtgagaagccagagaag

SEQ ID NO: 60023 - DNA, 834 bp, Glycine max
  Peptide Sequence Number=SeqID_151708
atgaggggcaccgtgcataagcctcaagcgaacctaggggacaaacccagggatttcaatggattgattaaacgtcaaacggctccattaccgtcactccaaaatggtcaagcgactaaatcaaacagaatatacactctgagggagttcccagaggggtttgcaaaagataagataagatttcctaaatctagcgtccaatcttctgaatttgtgatgaccgcccctctcaatgagtcaatctcttgctttctcctaagggtggacccttgggtactagtacctattgcctttagagggctgcatgccctcgccttcagatgtcttcacgccctcgccttcagagggctacgtgtcctcgacttcagagggttgtacgtcctcgccttcagagggctgtacgtcctcgcctctagagcgctgcatgtcctcgccttcagaaggcaacacacccttgacttcagagggctacgcgtccttgacttcagagggttgtacgtcctcgcctccagagggctgcacgtcctcccctccagagggctgcacgtcctcgcctccagagggctgcacgtcctcacctctagaggactatacgtcctcgtcttcataggactacacgtcctcgcctgcagaggactacacgtcctcaccttccgagggctacatgccctcgccttcaaagggctacgcgtcctcaccttcagagggctacgcgtcctcgcctctagagggctgcacgtcctcacctctagaggactacacgtcctcgcctccaaaggactacaggtcctcgccttcagagggctgcacatcctcgactccagaggactacat

SEQ ID NO: 60024 - DNA, 276 bp, Glycine max
  Peptide Sequence Number=SeqID_151709
atgactatgccgatgttggatcaatttcatctgtgcattcatgattccattgaaaatattgtcgatgtaaaagttgacggtagctgtggatatcgtgcaattgttgtcttattaggtatgggtgaagattcatggtctttggtgcacaaccatttgcttaaagaacttgtcaaatggtctgatgagtatatcaacctccttggtggcatagacaaacttgaggaactaaagcggtccctacttgttgatggattatccatggtaaatgcatcataa

SEQ ID NO: 60025 - DNA, 129 bp, Glycine max
  Peptide Sequence Number=SeqID_151710
atgcaggaaatggctccgaaaaagctttccgcgaagagatctaggagagcgccgcgactgaagggaccagtgccgcccccgagtttgatagtcaccgtttctagagcgctgtgcaccagcagcgcttag

SEQ ID NO: 60026 - DNA, 357 bp, Glycine max
  Peptide Sequence Number=SeqID_151711
atgagcacgagggggtttcttcattttgaggacttgtcggatcagcagaaagacaaagtgctaaacgcacaagtcaaaatcgaaaaggccattgagaaagctctgccctctgacgggtattcccgggatgagctttctcaaaggaacaaaagggatgagattaggggctttttggtctactgtaatgggaaacttctttcgatgaaaacatatgactcatatgtaaaagaagtcgaattagggacccaccggagccaaccctataaggggtatcctcaaataataacgaggcccgtcccagaaatggggcggggaaggagaagtgagcatgtgggtctccttcacttgactatttag

SEQ ID NO: 60027 - DNA, 306 bp, Glycine max
  Peptide Sequence Number=SeqID_151712
atgggagggttggggattagagatcttccaagtcttaacaaggctctgttgttcaaatggaagtggctgatgttccaccaaccagaccagctttggaccagaattctgatctctatgtacaatggctggaggggattggagtatggtcctcgaaagcagtatttctctacttggtgggctgatttaagggccatctttcaacagcaaaatgtggtcagtgctgataatcaaatcaggtggaagctggggagaggtgacaaattcctcttttgggaagatccttggggtgatgaaggagtcctctaa

SEQ ID NO: 60028 - DNA, 339 bp, Glycine max
  Peptide Sequence Number=SeqID_151713
atgaatgttttgagtggtgcaaccctcttttgtaaaatcactcgtgcacctaacatcttcatggtgtgtgtacatagggacccattaggtagtgatcaaggggttcccacgaatcctaagagaataaaggtcattcccgattggcccactccaccaagtgtcgagggaaggagcctagagtatgaagaacctcgggatttgaggtcaaatccttttcaaggtggaggggatgatgcaatcctacccccaagggtattggatagaagactccaagaggcttgggctagagctactaaggaaggtcctagggttctcatgaaccttagggtagatttttga

SEQ ID NO: 60029 - DNA, 672 bp, Glycine max
  Peptide Sequence Number=SeqID_151714
gcaaaagcgagaatcttggcaggtaaaggcgaatgggccccgttaatagacattctcgcactgttgatcttcggaggagtcttatttccgaatgtggatggtttggtggacctagcagcgattgacgcttttctcgccgatcataacgacaaggaaagcccggttgtcgctatgctagccgacctatatgacaccttcgaccgaaggcatgcttgctcgctagaaagtcaccgttcatgcacagagaatggaggtgcaaattgggatcaactcttagcaaacaaagaaggagcgtctatcaactggttccctcgatggaaagaagggagaaccggagttcttatttcgtgcggaggatttccgaatgttcccttgatggggacgaggggttgcataagttacaatctcgttcttgctataaggcaacttggctaccctatgagaggggcatcactagaggaagagatcgcacctgtcatttcaagaggtttcaataagaccaacatggagacacttcagaaggtccgcaaggcatgggaggtggtgcgaaagaaggacaaaaaaactcaggggcaaaccgctaaaaggaaggaagttgaggcaccagaggaagatgaagaggtgcaggcccttaggacagaatttgagcaagctcaaacggggatcctctag

SEQ ID NO: 60030 - DNA, 393 bp, Glycine max
  Peptide Sequence Number=SeqID_151715
atgtacaatcattatgagaaaggaacagctcctgatcttgaaagtgtattggcagacttcatgacatatcaagctagctctaaaggtgattgctattcaatgcaacagcagggaactcagtttggaaaggactattcttttgaagattatcaatgggaattagaatggcaaccttgttatcacaatgaagcagaaggattgtctaatctggatgacctgttaatggaattcaagggtatagtagattcaatgcaacaagcatttaaaagagctgagactcagattggtaagttggtggatgacatgactaaagttgtggtcagaagtgaagaagagagaattataagcaattgggcttggatccggaattgggctgaaccggcttggacttga

SEQ ID NO: 60031 - DNA, 210 bp, Glycine max
  Peptide Sequence Number=SeqID_151716
atgaatgacgaagaacggttgaaaatctttgcgaaatcacccacggaaacgttacggaagcgcctctgcttggattttcttcacggaaacaattttcctcacaaaataggggaggagcttgccacccagctcgcccaggcgagccaggttgcttcctccagaagcaactgccttctggaggaagaatctggaaggcccaagtgggcctga

SEQ ID NO: 60032 - DNA, 465 bp, Glycine max
  Peptide Sequence Number=SeqID_151717
atggaatcgagaaaaagagctagaatggaggacatcccttcatcatccactctagctcctccgtcagtaaccgtaggacaagatgtccaaggctcacaaactttagtccctatgctgcaaagcttatttcgaggacagtttattatcatgcacagcctggaagagttggctcataacaggccaatcataactatggagcattttcttgagcaagtagcctggcttgaagctcaacttgcattggtgagacccagcgaggctgctccacctgagcccacacctatgcaggtcgatccaaaactagcttacccacaatctccagtggtgaatccactgtcttttcctgagcatgaagtagttcccccatctctacctctgattatcatctccgatgcatcattagatgaagcggctacccctcctcattcaccagcaggaaaaacagctgaccttcctacttcccta

SEQ ID NO: 60033 - DNA, 222 bp, Glycine max
  Peptide Sequence Number=SeqID_151718
atggatgcatttgtttgttcatgtcttttctttgtcctatgctcccttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60034 - DNA, 192 bp, Glycine max
  Peptide Sequence Number=SeqID_151719
cgggcaatagacgcaccaccgccacctgtagagttcacctctgctcatccacaaaaaggtttgagtattgcctacaccacatggccgaccagcaggctaccaagtccaaagccaaagataagcaaaagtgctaggtccgtgaccaacaagccatcaagcgtccagctcaagacgttaaagaagcgctactag

SEQ ID NO: 60035 - DNA, 362 bp, Glycine max
  Peptide Sequence Number=SeqID_151720
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatcccggaacatcttgggagatggatgaaaagcttgagcatgtcaaacattgcatggtctatacttttgaactttgatgtgaggcccaacattggacatgaaagtgagcttattgcagtggtgttcagactctgcagttag

SEQ ID NO: 60036 - DNA, 393 bp, Glycine max
  Peptide Sequence Number=SeqID_151721
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggggaagtattgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 60037 - DNA, 510 bp, Glycine max
  Peptide Sequence Number=SeqID_151722
atgaatatcaccgagcagcgacgcaagagcattgattttacccagccgatttaccgcattccgtcgcagctggtcggcaaggccggtacggcggtagaagcgaccccagaagggctcaaggggaaaaccattggcgtgctgcagggctcaattcaggaaacctatgcgaaagagcactgggaaaagcagggtgtcaccgtggtgtcttataaagatcagaatatggcctggggcgacctgcttaatggccgtatcgacgcctcgctggtgatgtccgcggccgggcaggcaggtttcctcagcaagccgcaggggaaagggtttggcttcatcggcaaaccggtgtctgacgacactatcctcgggagtgggatcggttttgggttgcgtaaaggtgacgaggccaccaaaaagcagcttgatgccgcgattgataaagtgcgtgccgacggcacgatcgctaaactcgctgataagtactttccgggtatcgatgtcagcgtaaaataa

SEQ ID NO: 60038 - DNA, 438 bp, Glycine max
  Peptide Sequence Number=SeqID_151723
atgcaaaccaaacacatcctaaattctccggattccgatattgacacttttctcgaacaaccaaaccctcaattgttgccctctctgcctcactacggatccaaccccaagagaggaattgaccccaccgccgttgattatttcgacgccgccatatccttcaagcgtggtagaattaacaatgccacccacgacgttgatgatggtcaacacgccacctttgaacttcaaaaccctacttctctctccctggatcctggaggacccagcgctattaataatgataatcacagaggagaagaaaagcaagggaaacggccactgtttcaaattgattttatatctaaggctcttcttgaagctgaattaggtttagcgcagaattctgacgataaggccgacatggagcctgagaacgagaatgttgatatgcgctat

SEQ ID NO: 60039 - DNA, 303 bp, Glycine max
  Peptide Sequence Number=SeqID_151724
atggctccggaaaagctttcctcgaagaggtctaggagaggcgccgcggcagaagggtccagtgccgcccccgagtttgatagccaccgtttccggagcgccgagcaccagcagtgctttgaggccatcaaaggatggtcgttccacagagagaggtgcatccaacttagggaggatgagtatacaaattttcaggaggagatagctcgcaaacattggacgtcgcgggtgactcccatggctaagtttgaccttgagatagtcctggagttctatgccaatgcttggcctatagaggaggga

SEQ ID NO: 60040 - DNA, 228 bp, Glycine max
  Peptide Sequence Number=SeqID_151725
gatcggaatggtcaacaactgaagaaagatgcactccctcctcaagatgagcgtactccttctcctcctcctcagcgagatgattcagccctcatgactgaagttctttccgcgttacggggtctttgttcttatgttggtgaacgtttcgactcgttggatactcgctttgccggaatggatattcgtctcacacagcttgaagaagatgtgggttacattcgttag

SEQ ID NO: 60041 - DNA, 732 bp, Glycine max
  Peptide Sequence Number=SeqID_151726
atgaccagccctctcaatgagtcaatctcttgctttcacaaaagggtggacccttgggtactagtaccctcaccttccaaggactacatgtcctcaccttcagagggctgcacgccctcgccttcagaggactacacatcctcgccttcagaggactacacgtcctcgccatcagaggacaacacgtcctcgccttcagaggactacacatcctcgccatcagagaactacacgtcctcgccatcagagggctgcatgccctcgcctttagagggctacgtgtcctcaccttcagagggctacatgcacgccctcagaggactacgcgtcctcaccttcagagggctacatgccctcgctttcaaagggctacacaccctcaccttcagaatactacacgtcctcacctttagaggactacacgtcctcgccttcagagggctacatgccctcaccttcagaggactacacgtcctcacctttagaggggttcgtgcccacaagacacccagtggacccgaagaagtccaacagggccctggggtttccagatcgggttatgggcctccgtcagtcctacaggatgcccgtccccccccccagcaagggatcgcacccacaagacaactagtggacacggagaagtccaacagggtcttggtgtttctagctctgattacgggcctttgtcagttctatgaagcacctgtcgccccccaacaaggtcattag

SEQ ID NO: 60042 - DNA, 159 bp, Glycine max
  Peptide Sequence Number=SeqID_151727
ccgaagctctgataccagatgatgcgaacctgactaggaacggatcacttgatacaggctacgaaggctacggaggtttttggatgacgccacttccggtgaaggaagataagtcgggtaccgagctcgaattcgtaatcatggtcatagctgtttcct

SEQ ID NO: 60043 - DNA, 495 bp, Glycine max
  Peptide Sequence Number=SeqID_151728
atggtcaataccctcgtcttcagagggctgctcgccctcgtcttcaaaggactacacgttctcaccatcaaagggctgcatgcccacgccatcagaggactacccatcctcaccatcagagggctacacgccctcaccttcatagggttacacgccctcaccttccgaggactacatgtcctcaccttcagagggctacacgacctcgccttcagaggacaacacgtcctcgccttcgccttcgtagggctacacgcccatacctttagaggactacacgtcttcgccttcagaggactacacgtcctcacattcaaagggctacacaccctcaccttcagaggactgcacgtcctcaccttcagaggaccaaacatcctcatcttcagaggactacacgtcctcatcttcagaggactacacgtcctcaccttcagagggctacacgccctcaccttcagaggactacacgtccttgccttaagagggctacac

SEQ ID NO: 60044 - DNA, 414 bp, Glycine max
  Peptide Sequence Number=SeqID_151729
atggtgaaagttggaacttcttacgtgccgatcaacgtctcatattcgccaaaagttggcccagggcttggcggtatcaacagggacaccaggatttatttattctgggaatggattctgtttctatcagctgtccctcctgttcagctactgacggggtggtgcgtaacggcaaaagcaccgccggacatcagcgctggcaagtgtagcgggcgcgtcccattcgccattcaggttgcgcaactgttgggaagggcgatcggtgcgggcctcttcgctattacgccagctggcgaaagggggatgtgctgcaaggcgattaagttgggtaacgccagggttttcccaatcgcacagactcaccatggtaaagaagaagggggaacaagcacacttggagagcgcagtacaacg

SEQ ID NO: 60045 - DNA, 381 bp, Glycine max
  Peptide Sequence Number=SeqID_151730
ctggtgaatttgtgttgtttctggaaggatggtgatcttgatttgaatgcttcccctcaagcacttgacaaattcttgggtcatgtgcttgcttttaaggtcaggattcaatcaaaattcaaaaatgcagttgtactaagatactcaaaagacctggatttgatcaatgctattctcgagatgctgcctgatagtgaggcatgttccaaaatagatccttccaatgttgattgcaatgatgctgcacatgctgaatgtcaatctctgtctgtcatagctgaccatgatccggttgcgggattgcctttaacacccaaaaagcggatgtcatctgatgaagccgatgatgagttagggagctctcaaatttcgccagcctaa

SEQ ID NO: 60046 - DNA, 366 bp, Glycine max
  Peptide Sequence Number=SeqID_151731
atgaggcttagagctcatgagcagttccaaaagagagaccctggccggggtcttgttgacctgctcaatgaccttgaactcgctttgttgaataatccatcctatttctccgaaagacctttcaccgaaatattctcattcgcagcggggatcgttttggggtgcgaacacgcgaccgctgtgggtcacgccgctcagccccgtgatattggttaccttggccgacaacgaactgatgtcggtggcttcttccttcctttcgcttggaggcgcatacctccacggaactgcgtggctgttttggtatggaaatggaacaggtttaactaccgaggggttcagggcgtttggggagctgcgtctttg

SEQ ID NO: 60047 - DNA, 271 bp, Glycine max
  Peptide Sequence Number=SeqID_151732
acctactaaaccaaggccaaatgattttggtaggaaactcataggtatcagcaaacactcaggcaagattgattccactagttcagccgaattcaggcaaagcaggctttgcaagtccaaccaaatttcactcaacatgttccgcatagccattcttagcccaatcaagttcgtccgccaataccaatcaattgcctgcttgaatagttgttttgaggttgggagagcgagaacacctgttcgcggtacaggctgtttttgggttttttaa

SEQ ID NO: 60048 - DNA, 255 bp, Glycine max
  Peptide Sequence Number=SeqID_151733
atgtataatagtataataacctatattggtctccactacagggcacattggcaaatagtcttcattttgcctaaggaaaatgttgtcatccggttttgttcattgtataataggccagacaactacctcaaaggaataattaacagtgctttgaaaggacttggcaatactccacaaagtaaattcaaggctggtgctaggtggattgttgttaaatgtaatagacaaaaaggaagcactgagtgtggatattag

SEQ ID NO: 60049 - DNA, 186 bp, Glycine max
  Peptide Sequence Number=SeqID_151734
atgttttccacaaataaaggttggtggcgactccgcgcatctttcctcctttggaaagcgcaccccgcaaaaagcgcgctaagtgcaattccaacccaagagggaattgcgctgagcgagaaggggcgccctaagtgcaattccaacccgagagggaattgcgctgagcgagaattggcccgttga

SEQ ID NO: 60050 - DNA, 429 bp, Glycine max
  Peptide Sequence Number=SeqID_151735
gctgaatttgatatccctgaagtatatgatcagaggacaaaaaggaaaatacttcagattgtgggggagcgatggagacaattcaagtctgatttgacttcgaaatgggcacttgcagacgacaaggaaagtgtcgacgacactgtatgccaaaagtacgacattaacaaggagaaatgggcccaattttgtcagagccgcagagacccttcgtgggaggcagcaaagcaaattgctgacaagattgcgtcacagggttcctttgttgcccatggacgtcaggatgtactgattgctgccattgggcaacctgaacaccccagtcgtgtgtgtgctgctggagccagtgtgacgatcaagcaatactttggactggatccaaggacctcccgcacatcttcctccatggctcctgaagacctagagtag

SEQ ID NO: 60051 - DNA, 687 bp, Glycine max
  Peptide Sequence Number=SeqID_151736
atggaaccaaaatactgggataagaatcctttcaaggccaccgccaaaaaattttctgcaccttttgaccctgcaggatataattattgggattacattgacgcctggaccaatgtattctggcatcaaaatagtaaattcaagcattcatggctgatttacttcaaaaataacaccgtgtacaattttccaaattggttcctccaatggtggaactacttcggaccaataccacagatatttccagaagaagtccaacagggattccaacagttcaacaaactcttcaatagcaaagaatcaagaattccagcagatttgaagtacttttccagctttgctttgtcatggattttttcatggcaatacaaatatggaaaaactgaaaattgcaagcagtatccgccattacaaagacatgcctttgtaaaatggtggtcacaattcgatacctcaaaggctgctccagatcaggtcaagaattggtttcagagcaaccctgagtttctcaaacctgctgatccagagacatccttatttctgaatcagaagtctcaacttgcagcattcttggcaagctcaaaatctaaagagagtcttgcccagaatctcaaggaagttctccaactacttcaacaagaagaagatgaagacccccaaaaaaggaggccgaatcatcagaaataa

SEQ ID NO: 60052 - DNA, 113 bp, Glycine max
  Peptide Sequence Number=SeqID_151737
agagaggagctggaagtggaatctgtgtggatgttggaggaatccttgggatttctgtggaggaagagggaggaagtgtagaagaagaaggacctcctgtctctggtgcttaa

SEQ ID NO: 60053 - DNA, 642 bp, Glycine max
  Peptide Sequence Number=SeqID_151738
atgataaatgatggaacatacgaatttggggatcccacggtcatgtggctccgcatgcccccggactcttgggtcacggtaacaaaaagtggggtggtcgacaaaagcaggacttttgctcctatgtatcctcaatttgtgatgagggaactcaggacctacgtagttcttgatagctgtgagactaaaaatagtctcggtgttttcttcaccaaaatgcgaacatgctttagtaaagagacaaaacttccaactgatcagagcaacatatgcttttggatgaaaaacaatgtgtctatcggggaaggagacattttcatttctaaacgaccatttagaggaaacactgggtccaacaaagataggagaaaatcactcaaagtgtatcaatctcacacagtgcgtggcgagaaagtcactagcgcacaggattttgtcggcaatcaaagggagaggaccactttaggtcctgggcaaggattgacattctcaccctgggtcaaggtttatgataagttgggattttggctcaaggcttgtagaacggctggtcatgattatatgccagggtttggccagcggttcggggataaaggggatgtcctacattatttccatgatacatgcaacaatgatgattag

SEQ ID NO: 60054 - DNA, 300 bp, Glycine max
  Peptide Sequence Number=SeqID_151739
atgtatatgatgaggttgtcggctctcaatgagtatgggatcggagttattgacatcctcattgggagtgtatgccacattgggtggtgtatagttgggaagcaagccatatggtgggaagacatgcttgttttgaatttgcgcataatgggggccgcccatggggacattgggttcaggctcatcatggcctccatcattgtggccatttgctctttcatggctttcatgtcggccttcatctatttttgcacctcctctacttcacccattactttagctctagcacgggttcggtaa

SEQ ID NO: 60055 - DNA, 654 bp, Glycine max
  Peptide Sequence Number=SeqID_151740
atgaaactgcgcatgcttaacggcagtcactcatttctggcctacctgggctatctggcgggctaccagcatatcaacgactgtatggaagatgaacattaccgcatcgccgcgcacgcgctgatgcttaacgagcaggcgcctacgctgaaggtcaaaggcgtcgatttaggacgctatgccgatctcctgattgcccgctacagcaacccggccctgcgccatcggacctggcaaattgcgatggacggcagccagaagcttccgcagcgcatgctggattccgtgcgctggcacctggtgcatcagaagcctttcccgctgctggcgctgggcgtggcagggtggatgcgctatgtcggcggcgtggacgagcagggtaatgcgattgacgtgagcgatccgcagctggcagtgattcaggcggcggttaaaggcagtgcggaaggggaaagccgggtcaaggcgctgctcggcatcgaggccatcttcggcaaggaattaccgcgtgaagccgtctttgttgatgcggtgatgaagtgcgtaccagacgctgctgcaaaagggtgcgaaagcgaccgtggcacagtacgtgtctcaacggtaattcagcacatgccgccgttcgcggcggcatgtctgcgcaccgtttag

SEQ ID NO: 60056 - DNA, 273 bp, Glycine max
  Peptide Sequence Number=SeqID_151741
atggatatctttgaagatactgacatccctgtaatattgggaaggccattcatgttgaccgcaagttgcatagttgatatggggaagaggaagctggagctaggttttgaagatcagaaaattgattttgatttgtttgttgaagacaagcctgctccagaacacaatgtttgcttacaggtaatggaaggaggtcaagaggttctgaaacctcgcactaagcgcatctttggtcatgcgctaagccacgagtctcaagcgcttagcgcctaa

SEQ ID NO: 60057 - DNA, 198 bp, Glycine max
  Peptide Sequence Number=SeqID_151742
atggcatcttcatcatcatcttcatcacatgttaacattaagtctggccccatcgatgctgatgtattatggatgcaacctaagcatgtttcagaatatgtttggaatggggaagaagataggaaattacatatcagacgagttgtccccacgtataagtgtggatggtttaccattaatcggtccaacaaatcttga

SEQ ID NO: 60058 - DNA, 582 bp, Glycine max
  Peptide Sequence Number=SeqID_151743
atggatgaagtagaggagttacaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggatgaccccatgaggtgcaaattcaaaacgagcacgccttcccatcatatggcttgcctcccaactatacaccacccaatgtggcatacactctcaatgaaaatctcaataactccactccggtactcattgagaaccaataacctcatcagggcacatatctctcaaaccatgggaaagacacatgaaattccccacctcaatctagctgacttcgagccttggctcggatatgccactgaagggcaagcagttggtggtgtaccctttgaaaacactttggagagccctcagtttcgcccacaaccacaaccattgcatttttgcggtgggaagagcccctcatga

SEQ ID NO: 60059 - DNA, 535 bp, Glycine max
  Peptide Sequence Number=SeqID_151744
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatcggatggggatcctctagagtcgacctgcaggcatgcggagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60060 - DNA, 327 bp, Glycine max
  Peptide Sequence Number=SeqID_151745
atgtggatggatcggtttgctcttaccttgaacgggagtcaagaacttccccgcttgttagccaaggccaaggcgatggcagacacctactccgcccccgaagagattcatgggcttctcggctattggaaaaacaccataactaaacgcgccacaaggcatccctatcgcactagatccaaatctagaacgatgggtgatcaagaggagacacaggaacagatgaaagccgacatgtcggctctgaaagaacaaatggcctccatgatggaggccatgttaagtatgaaacaactcatagagaagaacgcggccaccgctgccgct

SEQ ID NO: 60061 - DNA, 408 bp, Glycine max
  Peptide Sequence Number=SeqID_151746
atggcttctccacctacctcccctcctcctcctcctgctccttccaacgaattagcttcgtcgtctgccgtgaagcggacacgcaaagcctcacatctacgatcattgtctactagaccacctggtgctgagagaccagtggtccatgttgatcctgctaccgacaagaccgacggtccccacaggaagaaattaagaacatatttggggattgtggtgcgtgataaggtggacgtcacctacgagaattggaaggatgtccctactgctcagaaggacctgatttgggaggacattcaggcggaatttgaaatcctagaggcttctgatagtaggatgaaaaagaagttatttcagaccgtgggcaagagaaggaggaagtttaaatcagacctcacgaggaaatag

SEQ ID NO: 60062 - DNA, 319 bp, Glycine max
  Peptide Sequence Number=SeqID_151747
atggccgcaatgatggaggccacgatgagcgtgaagaagatgatggaagccaatgaggttgcaattgccgctaccagtgttcttgctaaggtgaacctgatgtccccatccggcatcaaccaaatgaatcatccaacctcagatatggtaggcaaagatttgggaattggtggtataccccttgaaaacacttcggaaggccctcagtatcacccacaactacacctcttgcattccacaacaagtaaaaaccctcatgctatggcagaaatgggaaagttggatcatttagaggaaaggctcagggccattgaaggag

SEQ ID NO: 60063 - DNA, 357 bp, Glycine max
  Peptide Sequence Number=SeqID_151748
gtcgactctagaggaccccctgcgctcggtcgttcggctgcggcgagcggtatcagctcactcaaaggcggtaatacggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 60064 - DNA, 243 bp, Glycine max
  Peptide Sequence Number=SeqID_151749
atgggtgccaagcacctcaaaatgaccaaatacaagttgcatgccaccaagccaaggtccccggacgaaattaggatagcaaaaaggaatgtttatacggataaccactcgggtatttccgcctgtcagcgtgactcaaaagtcagtatgacagatcttgtgagcgcggaagatgacgtaaatctccgcgtgtcaacgggcttgtcggccgcgactgacgaagggcgcagaagacgacgttag

SEQ ID NO: 60065 - DNA, 675 bp, Glycine max
  Peptide Sequence Number=SeqID_151750
atgtggatggatcggtttgctcttaccttgaacgggagtcaagaacttccccgcttgttagccaaggccaaggcgatggcagacacctactccgcctccgaagagattcatgggcttctcgggaaaaacaccataactaaacgcgccataaggcatccctatcgcaccagatccaaatctagaacgatgggtgatcaagaggagacacaggaacagatgaaagccgacatgtcggctctgaaagaacaaatggcctccatgatggaggccatgttaagtatgaggcagctcatagagaagaacgcggccaccgctgccgctgtcagttcggctgccgaagcagacccgactctcttggcaactgcgcaccatcctccctcaaacatagtaggacggggaagggacacactggggcacgatggcagccctcacctgggatacaaccgagtggcttacccttatggattgccgcccaactactcaccacccgtcttgcaagaagatgcgggccacattgcttctcccgtccttgaaagagagcctcctcaacagcccgacgaagtccacaaagaccctcaagactatgctcgaagggatgtcgagttctatcccccgatccccgaagggccggcaccaggaacattgcctcaacccaacatcgcggcaccaccaata

SEQ ID NO: 60066 - DNA, 312 bp, Glycine max
  Peptide Sequence Number=SeqID_151751
atggcttccatgatggatgccatgctaggaatgagacagctaatggagaataacgcggccaccgccgccactgttagttcggctgccaaagcagacccaactctctcagctaccgtgcaccaccctatcccaaacgtggtaggacaagaaagaagcacactgaggcacatcaacaacccccatccgggatacaaccgagtggcttacccctatggattaccacctaattacacaccaccagtcatacgtgatgacgcgggtcatgtccctgcccccatccttgaaggagagcctcctcgacagttggacgag

SEQ ID NO: 60067 - DNA, 258 bp, Glycine max
  Peptide Sequence Number=SeqID_151752
atgaaatatgccataaagcactgtgtaatcgattacacatgcctggagctcgcctgcttaggtacatcacaggttctccctgaccgactatgcccgggttgggtcgggattggtcaagcttggttttgggcaatagcaccccacctgacgtccccaaggtctcctgacccccgcgacatatctccaggtaccactctgtggtcaacaataaaagcaggaagtttcacccttcgacacttcctcatctcaagcttgtag

SEQ ID NO: 60068 - DNA, 312 bp, Glycine max
  Peptide Sequence Number=SeqID_151753
atggataagagcttgaaggtaggagaagatgagtggagggaggagagaaggagcacaaaattttatgcctcaaaagagcaatggttcagcctactaatccaagatcaggtccaagattctccactaagtgtgcttaggtgtcatgaggcatcccatgggcccaaaatctatcctaaggctcatgagaaccctagggccttctcttgcatctctggcctaatcttcttggagtcttctttccaatgcccttatggggtaggattgcatcagatcattagtctgaggcatacgaactggttcgccaaggattga

SEQ ID NO: 60069 - DNA, 284 bp, Glycine max
  Peptide Sequence Number=SeqID_151754
atggcacgcaacgtgtttgcttcgtgcccctattttagggacctacatgggagggagctaaaagggcttttagtgataattcccaaggtggtcatatctctcttgatggtctctagagtggagtcgccaactgttgcaacctacccttcggcgggagggcgacgcgagactcacgggtgcatcttccaaggaaggaaaacgcgcggcatcgccaccaacgtttattcgaggaaaacgttggaaaaaccggaaaaggcggggtctacgaactttaagtgtgaaag

SEQ ID NO: 60070 - DNA, 599 bp, Glycine max
  Peptide Sequence Number=SeqID_151755
gccaccattgccacggaacctccggagacccaccaacaccaattcctcattctctttcatctccccggtcatccaccttattttcctccattgatcagcgtcagaggtaccactctcaattttgtaatcgcattattcttgatcctaagtacctagaccttgaattctttgatggtgaaacatttgattatttccaagtgtttcaaaactctaaattggttgaattcatgtctctcaaattgccttattttcctgaattagttagagtcttctataacaatttgaaaattcaggatggtgttctttattttgaggtgcacaaaattcctatcattgttgatcagtccttattttattcattgactaaactgcccagtcaaggtgttccttttgagggcactcttgttgatgattggaaacatgattattcaagtcatgatgctcaaaaaatggtctgcaatgaccatgctgacatgtccggcaaattgcttgctgggtcatttacttttgactatcgcatcatgtactgtattatttgtcgcattttgcttcctaggtccactaacctttcccaagcctctgaggaggggatcctctag

SEQ ID NO: 60071 - DNA, 187 bp, Glycine max
  Peptide Sequence Number=SeqID_151756
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgtgaaagctgaggcggacaaagacagagattga

SEQ ID NO: 60072 - DNA, 285 bp, Glycine max
  Peptide Sequence Number=SeqID_151757
atggacacctatgttagtccttggaccgctcaaatcactgagacaaaggtcaccaaagctagtgaaacgaaagatattgagctggtagaggaggaacaggcacggattggtgctgatccttctagtgggacctccaataaatctgagaattataaggaggaagcacggaagaaaacacagaagcataaaccaaagagggtggagagtgtcaacgctgatgcaaaagcctttggtgatgactggaaaattctgattgctctatgcattgtgaagctgaagcagtag

SEQ ID NO: 60073 - DNA, 447 bp, Glycine max
  Peptide Sequence Number=SeqID_151758
atggccacccatttgggtatcgagctacagctaagaacctgcgtcaaattgcttctttacttctctttaattttcgaaggcctctcggcagtcactattccacaggacagcctagttcttaccttacacagattgacaaggttacgtcctcagttcgagactggcaatcagtcattacgttcagacctctatttcggcttatgcatcatcgatcatggacaatcgccccatggtcacgtgatagggccccggcatttttcaggcctcaaagaatcgaccctcactatctatccagcagcaacgtcccccaaaatagggggtatagaattgtctttaggactggctcggttcacagtcccggtagtctacacacattcgaaccttgccgtcctttttcgggactgggacaatattggccacccattttgggtatcgagctacagctaa

SEQ ID NO: 60074 - DNA, 264 bp, Glycine max
  Peptide Sequence Number=SeqID_151759
atgaacctcttcggtggcattaagagatttgaacaattaaagttgtccctacttgttgatgggttctcgaaggttagtgtggacaagtggatggatataacggagatgggatatgtgattgcatcatggtataacgtaatccttgtatcgttgtcccgacaacaaagcatgacattttttcctcttagaagtcaaccaccacctgattcttctgggcaccacatgatatgtgtcggtcacgtgtttggaaatcattttgttcag

SEQ ID NO: 60075 - DNA, 591 bp, Glycine max
  Peptide Sequence Number=SeqID_151760
atgacacgcggagacaaaatttggtcattccgcaccctttgccattcagacacagccgtgtccgatggcgcgcagagacaaaatttggtcattcggcaccctttgtcatccagaggcggcgagtccgatgacacgcggagacaaaatttggtcattccgcacccctttgccattcagacacagttgtgtccgatggcgcgcagagacaaaatttggtcattctgcaccctttgtcatccagaggcggcgggcccgatgacacgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcaccccttttccattcagacacagttgtaggcagcgggcccgatggcaagcaaaggccaatgtggtcattctgcacccttcgtcaatcgcggccgacaagcccgttgacacgcggagatttacatcatcttccgcacttacaagatctgtcatactgacttttgagtcatgctga

SEQ ID NO: 60076 - DNA, 789 bp, Glycine max
  Peptide Sequence Number=SeqID_151761
caacatcccgacgttatgcgctttgtggcggaagaccgccccgtcgcggacatccgcgccgcgtttgaagcccgcctgacgccctggacgccgggcagcgcgcactggctgtgtctcgtcgtccgtgatgccctcaccgggttccgctgggcgtcaccggctatattcatcgggaggaggattgcgcagaagtcggttttcttttcgcacccgaggcgcagggaaaaggctacggcttcgaatccctgcaggcgctctgccgctatgcctttgaagaaggcggcatacgccgactcaccgccaccgttaccgccgggaatgtcgcctcaagacgtctgctggaaaaagttcggtttcgcctcgaaggcgaattacgcgagagctattacctggcggggcgctggcagaatgactggttatttggggctttctctggagaaatatcgtgacgaacacggattatgggttatcggctacggccacgttatccgcgatcgggagcagtttcacggtcctgtcactccgctggaggccgacgcgctgcttcacgaggacattcgcttgtgcgaggcgctgctgcgggaaaatgtgacacgtccattaacccaacagcagcatgacacgctggtgatgatgatgttcagcttcggagagataccttcgctgccggaagcgatttttcaggccgtcgcccggccgccggaaaagcgcctccagatgcgcttttaccgtggccgcactgatgttgaggttgcgcccaatctctttgtttcactcgggatcctctag

SEQ ID NO: 60077 - DNA, 79 bp, Glycine max
  Peptide Sequence Number=SeqID_151762
taaggctaagctcaccctgtgcgctaagcctgagtgttattcggttgaggctgagctaagcgccagcatgctgcgctaa

SEQ ID NO: 60078 - DNA, 329 bp, Glycine max
  Peptide Sequence Number=SeqID_151763
atgtcagatggggacgtcgggttcactttagcaacagcgctggtagcggcaactgcaaccgcattggcttccattatcttcttcatgctcatcatggcctccatcattgtggtcatttgctctttcatggcatccatgtcggcctctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaag

SEQ ID NO: 60079 - DNA, 578 bp, Glycine max
  misc_feature (538)..(538): n is a, c, g, or t
  Peptide Sequence Number=SeqID_151764
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatcccggtaactatcgtcttgagtccaacccggtaagacacgacttatcgncactggcagcagccactggtaacaggattagcagagcgag

SEQ ID NO: 60080 - DNA, 586 bp, Glycine max
  Peptide Sequence Number=SeqID_151765
agggtacatctacttgggttgttgtaactgagaacaagagagggtacatttcttgtggatcagttcaagtggaggatacatccacttggttgttacaaagagaacaagggagggtacatcccttgtggatctttaaaggattttacaaggttgaaaagaaatctcaaggaccacaggttgcttggggactagatgtaggcacggggacggtcttgaagcaacagtcttgtttggccattgttgattcaatggagttttttgagttgaatcctatcttccaaaaccccaaatccatgtcttattctgtgcttcccctccaacttggtgtgggattggcgtttggagggctgatttgtaaggacaagtctgagagtggtaatagtatggttttttctttggtgggggtgctggtgagtggtagacatagggagggtgtgggtgtggatgaggatgggggtgagggtgagggtacactggagagggctggcttggctatgagcatctatatggatggtcatgatttggccagtgttcaaccatgggttgttggggatgttttagatttacttttccgaaaatccatgag

SEQ ID NO: 60081 - DNA, 186 bp, Glycine max
  Peptide Sequence Number=SeqID_151766
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggattgcatcaagaaagttatgggacgaggggattga

SEQ ID NO: 60082 - DNA, 145 bp, Glycine max
  Peptide Sequence Number=SeqID_151767
ggcgaggctcacgggtgcgctttccaaaggaggaaaggtgcgcggagtcgccaccaacgtcgacaaaagcggggcttttgctcctacgtaccctcctttggagaggaaatcagacctacgtagttcttccttaagcgtgaatcga

SEQ ID NO: 60083 - DNA, 318 bp, Glycine max
  Peptide Sequence Number=SeqID_151768
atggctaggttccttagtgtgcttaatatggaattgaggtacaaggacactacttcttccccttcttctagtggaagtaaagatggagtaaggggtgaagagtctagtgaggccctaatggagaaggataaagcccccgagtggagaaggatgaaggcccagagttccttgttgaaccaatctcagacttatcaaggtaatccttatggcgtctaccctgacttatctaccttcactggaagtggcatcatccaaatctccatagcctgtatcaaacgatccgctcctactcaagttcacatcaagaaggctccttga

SEQ ID NO: 60084 - DNA, 330 bp, Glycine max
  Peptide Sequence Number=SeqID_151769
atgcaaaagaggttcacacacatagttaatcatcttgcatctctaggaaaaacttttcaaaatgaagatctagtaaataaagtcttaagatgtcttaatagagaatggcaaccaaaggagcatgaaatggaattactaagattaaatcagcatgaagaaactgataagaagaagaagggaatcgctcttaaagcctcatctgcaatccatgaagacagtgataaagaagattcaattgacttggataatgatgaagatattagtcttttttgtaaaaagattcaacaagttcctgagagtcagaggaaatcaaaagcgacccaattttaa

SEQ ID NO: 60085 - DNA, 261 bp, Glycine max
  Peptide Sequence Number=SeqID_151770
atggggaagagaaagctggagttaggttttgaagaccaaaaaattgatttcgacttgtttgtggaagacaagcctactctagaacacaatgtttgcttacaggtaatgggagaagcttatccatggctaagcgggacctattgtcgccaagtgcaattccttatggccttaattgaggtccatgacgttaagcgccagtcatggcaactaagcgagattcattgcggcaatatgagcgctaagcgagtccctctcagctaa

SEQ ID NO: 60086 - DNA, 691 bp, Glycine max
  Peptide Sequence Number=SeqID_151771
tgtcctcgcctttagagggctgcacgccctcaccttcggaggactacacgtcctcccctttagaggactacacgtcctcgccatcatagggctgcatacccttcccttcaaagggctacacgcccttgccatcagagggctgcacgccctcaccttcaaaggacaacatgtcctcgccttcagagcactacatgtcctcatcttcagaggactacacgtcctcgccttcagaggactacacatcctcggcttcagaagaatacacgttctcgccttcagaggactacacattcacgccgtcagaggactacacgtcctcgccttcagaggactatacgtcctagcctttacggaggactacacgtcctcgcctacagagggctacacgtcctctgccttcagaggaatacacatcctcaccttcagaggctgccatcctcgccttcagagggctacacgccctccccttcagaggacaacacgtcctcgccttcagaggagctacatgcaccctcaccttcagaggactacacttcctcgtttagaagactacacgttctcgccttcagaggactacacatcctacgccgttagaggactacacgtccttgccttcagagggtacaccccctcaccttctatacgtgtcctacctttagaggactacacgccctcgctttcagaggactga

SEQ ID NO: 60087 - DNA, 606 bp, Glycine max
  Peptide Sequence Number=SeqID_151772
atgaaggcccaagtggagaaagatgaaggcccagaggcaaaggcactatcaagacaattaatgttgctgaaggcccaaactaatttgaaggcccaaacttatcaaggtaatccttgtggcgtctaccctgacttatcttccttcactggaagtggcgtctacccagacttatcttccttcactggaagtggcgtctacccagacttatcttccttcactggaagtggcgtctaccctgacttatcttccttcactggaagtggcgtcatccaaaccttcgtagcctgtatcaaacgatccactcctactcagattgactgggctcatttggttcggtaccgaatgcttaaggcattacgggccaatgcacctctaccttacccacaattgataactttgtttctgcgtcattttcaaattccgtttgatgatgaaccatttgttcaagtcaagcgttcctttgcaattggtgctggtgcagtgacttcctttggttaccgtaaggatcggaatgttcaatggctgaagaaggacgcactccctcctcaagatgagcgtactccttcacctccttctcagcgagaagattcaacactcatgaatgaa

SEQ ID NO: 60088 - DNA, 246 bp, Glycine max
  Peptide Sequence Number=SeqID_151773
atgaagaaggattgttataaccagaaacaaggccagacttgttgctcaaggctacactcattgaaggctcaagaagcagaactgtgtgtccctatctatgcagaagcagagtatattgcagcaggagcagctgttcacaagagcgtttggatgaaagtacagagttgcttatccaggagtataggaaggggaggaattgacaagactctctttgtcgaacaagatgtcatgacattgtcactgtga

SEQ ID NO: 60089 - DNA, 243 bp, Glycine max
  Peptide Sequence Number=SeqID_151774
atggcatcaaagaagagaaagacacctactacaccttcccaggttcgatatgaccgatccaagttcacttctcttgaggcttgggaaaggtacactgatattgtggtacctaggaagatactccccgagtggaatatggtaatctaccacactgagtttgatgagttcaaggaagaactggatagaagaaaatgggatgaggagttgaccagttttgatgaaggcatcattgatgttgctatt

SEQ ID NO: 60090 - DNA, 147 bp, Glycine max
  Peptide Sequence Number=SeqID_151775
atggtgaaaaagaggctaagttttgaaatgccaaaagtgccttcagccagactcagcgcaagactggcgctaagcccaattccacttacttacgctaagcgtgagggtggcgctaagcgtaaggtcgcaaattctaagcctatttaa

SEQ ID NO: 60091 - DNA, 63 bp, Glycine max
  Peptide Sequence Number=SeqID_151776
atgggtatggcctcgatcaaatttggcatcgttgccggggagcagtgggccaaaggttcataa

SEQ ID NO: 60092 - DNA, 723 bp, Glycine max
  Peptide Sequence Number=SeqID_151777
atgggatcaagtcaaacaccttcgcttaaaaagaggttctatcaagtcaagttcaagagcctaggaatcaccagtttaaaagagctagggcagttgatgggtcagctccagcggcaagcttttcgcaaagcttacggtaaaatctgggacctagccatggtagaagtctccacagaggccattgcctccctcgcccagtattatgatcagccattgaggtgcttcacctttggggacttccagctatcacccatggtagaagaatttgaagagatcctaggatgccctcttgggggaagaagaccatacctcttctcagggttctatccctcattagctagaatttctaagatagtccaaatctcggtgcaggaattagaccacagaaagcaagtcgaaaatggggtggttggaataccgagaaaatatttagaggcaaaagcaagaatcttggcaggtaaaggcgaatgggccccgttcatagacattctcgcactgttaatcttcagaggagtcctctttccgaatgtggatgggttggtggacctagcagcgatcgacgcttttctcgcctatcatgaccacaaggaaagcccggttgtcgctatgctaaccgacctatatgacaccttcgaccgaaggtgtgagaagagtagtacgaggattgtttgttgtactccagctctttatgtatggttggttttgcacctttttcaccaagag

SEQ ID NO: 60093 - DNA, 441 bp, Glycine max
  Peptide Sequence Number=SeqID_151778
atgaccgaccctctcgatgagtcgatctcttgctttctcataagggtgaacccttggagggctgcatgccctcaccttgaaaggactacacgtcctcgccaacagagggctgcacaccctcaccttgaaaggactacacgtcctcgccaacagagggctgcacgccctcacctccagaggactacatgtcctcgccttgagagggctacacgccctcaccttggaggactacacgtcctcgccttcaaagggtcatgtaccttcaacttcagaggactacacgtcctcgccgtcaaagggtcatgtgccttcacctttgtagggctacacgccctcaccttcagaggactacacgtcctcacctttagaggactacacgtcctcgccatcagaggactacatgttccccattttcaaagggggacatgccctcacctttag

SEQ ID NO: 60094 - DNA, 354 bp, Glycine max
  Peptide Sequence Number=SeqID_151779
atgccagaacgacaacatgtaatgtattacacactgccgacattcacccaagaaccgtctcagatgccgccgatgtattcatacccacatgattttcaaccagggtatagttttgcaggcatatttgggtcctctcctccttcaacgggaactccttcatttacccaaagtggtcaactatcgaccccaaatgccccacttgctggggtcaatttacgtcatgatttctctgccgaggctgaccaagtggatgaaagggcgaatcgtaaaagaaaaaatcctgatagggtagctagaaattgggaccggccatgtgggacttcgtcgcggcatcacaaacatagtgatgattga

SEQ ID NO: 60095 - DNA, 660 bp, Glycine max
  Peptide Sequence Number=SeqID_151780
atggcaagagtagcaaaagtagttaaaatctcggtgcaagagttagaccatgtgaagcaaagtaggaacgggataattgagatacccagcaaacatttggagggaaaggcgaaggcattggccgatcaaggtgaatgggcttcgtttattgacgtcttggcactgttgatatttggagttgccctctttccaaatatggaagggctagtgaacctagcaacaattgatgctttccttgcctatcaccatagcaaggaaagcccggtcgtcactatcttggttgatctctatgacacgttcgaccgaagatgcgaaaagagcggtgcaaaaattgtttgttgtatgccaactctctatgtgtggcttgtctcacaccttttccgccaagaaagtaggcccacttgtccactacgaggggctgaagccctggaagaaagtaaggaggtacaagccctaaaggcggagcttgaaagagcccgagcagtcaaggagaagttcaactcaacagccattaaattcaggaaagagtacgatgaactaagagacatcaatatggccaccaccaaagccttggaacaagaaaccaagagggcccgaaaaggaagaacatggccagaacaagttccgaggagctttatggggcaacaacaacgagcttaa

SEQ ID NO: 60096 - DNA, 417 bp, Glycine max
  Peptide Sequence Number=SeqID_151781
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtaggcccgtctatccgctacaaagtcaccgctcgtgcgtcgaaaagggaaagggtaattgattcattgcaccaagagacaacaatgtggatggaccgatttgctcttactttgaacaggagtcaagaacttcccccattgctagccaaggccaaagcagtggcgaacacctactccgcccccgaggagatccacggacttctcagctattgtcagcatatgatagacttaatggaccatataattggaaaccactag

SEQ ID NO: 60097 - DNA, 915 bp, Glycine max
  misc_feature (87)..(87): n is a, c, g, or t
  Peptide Sequence Number=SeqID_151782
atggaagggctgcaaccctaccgttccgccatccagcagctgctgttcggcgcgcagcacccgatgctgcagcaggggcgcatcgcncccattcagaccgtcggcggttccggcgcgctgaaagtgggcgccgatttcctgaaaagctacttcccggattcgcaggtgtgggtcagcgatcccacctgggaaaaccacgtcgccatcttcagcggcgccggtttcaaggtgaatacctacccgtatttcgacagcgaaagcctgggcgtgaagttcgacgccatgctcgctgcgctgaaacagctgccgaagcacagcatcgcgctgctgcacccgtgctgccacaacccgaccggttccgacctgactcctgcccagtgggatgaggtggtcaaggtgatcgccgagcgtgaaatcattccgttcctcgacatcgcctatcagggcttcggcggcggcatggagcaggatgcctacgccattcgcgccatcgcggcggccggcctgccgtgctgcgaagaggcggccgggcgcgtgctgggccagctgaaggccaccgtgcgccgcaactactcgagcccgccgaacttcggcgcgcagctggtggccaaggtgctgaacgacgcccagctgaaaacccagtggctggacgaagtggagagcatgcgcacccgcattctcgagatgcgccacgcgctggtggacaccctgaagagcgcgctgccgcagcgcaactttgattacctgctggcgcagcgcggcatgttcagctacaccggcttcagcgcggcgcaggtcgatcgcctgcgtgaagagttcggcgtctacctgatccacagtggccgcatgtgcgtggccggcctgaaccacaacaacgtgcgtcaggtggccgaggcgtttgccgcggtgcagtaa

SEQ ID NO: 60098 - DNA, 51 bp, Glycine max
  Peptide Sequence Number=SeqID_151783
atggccattgagggctttacaatgagaaggaaggtgaaagacagaaaggga

SEQ ID NO: 60099 - DNA, 726 bp, Glycine max
  Peptide Sequence Number=SeqID_151784
atggatatgaacatcggcgccctgatcttaggtcaaatctcttctattgctcagagtaactcctctaagctcggattttcagccttgatcactaccttctgcagaggtagaggagttacctctgacagtctgacttatgagagcttgagcccagccattaactttgcctacattaagaaaaactgttggaatgtggatgatctgacaattaacttcagaggggtaaggaaggcaagggctcgaccagctagtgttccttcttcttctactccacctgcttcttccacttttgctactcctacaccagctccttcaggcccatctgcccaggactctcagcgctttaagtccatgcttcagagaaccatcttgacagttgagcagttcatggagaaggtagcctggccaggaactcaaccttctcttgtgaggaaaggtggagctcccagtgctcaggtaccacaacaggtagatcatgcatctttagaggccacaatccctgagccatttgtttttaaggaaggagggacacagcagctagcagaccctcctacaccagtgcatgagatgccagcagacccttctactccattattggagattctagaggacctttccacactagtcttgggactgactaccactcctccagccactcctatgctacattttatagatgaggagggcactcaggatcaggatacccagcaggatgaccagtcatag

SEQ ID NO: 60100 - DNA, 486 bp, Glycine max
  Peptide Sequence Number=SeqID_151785
atgattggtactagtaccctcatcttcagagggctgcacgccctcgcctttagaggattacacgtcctcgccgtcagaggactacacgtcctcacctttagaggactacacgtcctcgccatcagagggctacacgtcctcgccatcagaggactacacatcctcgccatcagagggctaaacgccctcgccttcgtagggctacacgcccttacctttcgaggactacatgtcctcaccttcagaggactacacgtcctcaccttcagagggctacacgccctcaccttcagaggactgcacgtcctctacttcagaggactacactccctcgccttcatagggctacacgccctcaccttccgaggactacttgtcctcaccttcagaggactacacgtcctcacctacagagggctacacgccctcaccttcagaggactgcacgtcctccacttcagaggactacacgtcctcgccttctaa

SEQ ID NO: 60101 - DNA, 246 bp, Glycine max
  Peptide Sequence Number=SeqID_151786
aaaagaggagaagattcatcttctgttccaaagtgttatgaaagtaatcaaccaggacatctgagagttgattgcctgagtttcaagaaaagaatggaaagatctgaaaggaaaaccttcaatgctaagaaagcaaagaaatcttacatcacttgggaagataacgatatggattcatgcgaagactcaaaaaatgaagtcgtgaatctaagtcttatggccaaaaattatgaaagcgatgaagag

SEQ ID NO: 60102 - DNA, 336 bp, Glycine max
  Peptide Sequence Number=SeqID_151787
atgaccatgattacgaattcgagctcggtacccgaagacaggccgtccgagattaatgtcggaggcgatgacgtggaggggctggcgcgtgaggtggaagggtacatgaaggacgtgataaggttgtcgaataggttgggagggaagaagggggagaataaggagattgggaacttgcgacggaatctttttccgacgccgttttcgttctttgtcggaagcacgttcgagggtgctccgagggagcaacaagcgcttctggagttggggggatcctctagagtcgacctgcaggcatgcaagcttggcactggccgtcgttttacaacgtcgtga

SEQ ID NO: 60103 - DNA, 268 bp, Glycine max
  Peptide Sequence Number=SeqID_151788
gttgcatgatgtacaatttgtggcgaagctcatgaatctggatgttgtatccctaatgaagagcaaattgcacatgaagtcaattatatggggaatcaacccagaggcaatctcaatacaagtggattttcaggatttcagaacaaccagcagtatctacggcagagacagtggtaaaatcaccctggtaaccaattcaagagagaccaggcaagttcatctacaaggccactacaacagatgccaagtctctatgaccgaaccataa

SEQ ID NO: 60104 - DNA, 519 bp, Glycine max
  Peptide Sequence Number=SeqID_151789
atgcaaagaagatctactgcaggtggtttgatccctattgatttggagattaacgctacttgtaggaggcgcaacacagatagaattagaaaaattttgcaggacttagaagcagcaacaactccagaagaagaacctcgatctttcgaggtgtcttctagctttcctattccagggaaatctcatacagatttaattgaagaagttattatagctgaagagtcaaggagagtgaccctagaagattactcaagttcaagtgtgccgcaatttttcaccagcattccacaaccagagacttgggatgaagtagttgagaaattactgaagaagtatttcccgaagtctaagactgcagaaggaaaagtagccatctcttcttttcaccaatttccagatgaatccctaagtgaggccttagaaagattttgtggtctgttgagaaagacacccactcacggattctcagaaccgatccagctcaacatttttattgatgggttaaggccacaatcttga

SEQ ID NO: 60105 - DNA, 288 bp, Glycine max
  Peptide Sequence Number=SeqID_151790
gtcgactctagaggatccccagcctatgagaattccaaaatctacaaagagaagaccaagaagttccatgacagcttgatagctaagaaggacttcgtggttggacagaaagttttatcgtataactttaggctcggactcatgagtgttgagatcaaaagtgaatccacagataagggcttcaaggtcaatggacaccggctgaaaccattcctcacaaatccctccttagtggatgtagtggtggaggagacctccttacttcaccctacttctcttccgccatga

SEQ ID NO: 60106 - DNA, 174 bp, Glycine max
  Peptide Sequence Number=SeqID_151791
atgccttatgtggaagccgcagaggagtcattagaaaccgctttccagtcttttgaagtgccttgcttgtccgatgcaacaataatgatggcccgagttatgttggggaacggttacggacccggaatgggtttaggcaaagataacggcggcataactaacctgataaattga

SEQ ID NO: 60107 - DNA, 210 bp, Glycine max
  Peptide Sequence Number=SeqID_151792
atggcctgtgattccttagaggagcaggcctcacagggttcctttgtcgcccgtggacgtcaggatgtactagttgctgccattgagcgaccagaacaccatggtcgtgtgcgtgttgctggagtcagtgtcatgatcaaacaatactttggactcgctcgtcattttgccattgagtgcacattggcaaatggtcatcattttgcctaa

SEQ ID NO: 60108 - DNA, 291 bp, Glycine max
  Peptide Sequence Number=SeqID_151793
atggctccgagaaagctttccgcaaagagatctaggaaggacatcgcggctgaagggactagtgccgctcccaagttcgacaaccatcgtttcaggagcgctaagcaccagcagcgtttcgaggccatcaagctggatgtagtcatcctgaccggagagcgtccatgtatgccacccaccaggcaccctctagacccggataagtctaatagggccctgggatttccggcattgatcacgggccgtctgccatcattcgggcaagttgcccaggtcactcctagaaggtga

SEQ ID NO: 60109 - DNA, 243 bp, Glycine max
  Peptide Sequence Number=SeqID_151794
atggcagaaatcgaccaaggtaagacgatgaccggtcacgattggtcgcatatcatttggttcttacttgcaggttcaagaaggcaaacgctagcccgtaagggagcaggggacatggttagctcgcttgggcgagctgagctcgcctgggcgagcaacccctgcacccaaattctaaaaaacgagggaggggaacattttggcatccaaaaactccccccccccccctcattcaaaagataa

SEQ ID NO: 60110 - DNA, 558 bp, Glycine max
  Peptide Sequence Number=SeqID_151795
atgcctacaacatccacacataggcaacaggaagttgcccctgttgctgaggatgatcttgtgcttactaaagatgtacatgcacatgctgaagaagctattgatgatgctgagggatttccaggtgggccgcgtgacctatcagtgttgactgactatggtgaccatgttgcagtcatcgtatggaatgatgaggaacgtcctgaattgaagttatcctcccatggaaggaaggttctgaaatttgggaggcctgctccagaaattgaagggctagtcgctatcacaggattaagtcctttgatcgcatgttcagtagacactggcgatcgaggacttatatccacttttgtcgagaggtggcataaggaaactagcagttttcatcttcctgttggagagctgaccatcaccctagatgatgtggtgtctctgcttcatcttccaattattggcgcattccacagttttgagcccctgcatgtcgacgaagcggtcttgatgttggtggagttacttgaagtctctagagaggaagctagagctgagacaacataa

SEQ ID NO: 60111 - DNA, 261 bp, Glycine max
  Peptide Sequence Number=SeqID_151796
atggccatccttggtccactaagaagctccattggagcttgtaggcctaggatcttcttcatcaatggattcctttgcttcttggaagatgaatggcagcggaatggagaaaggaagagagagaggagatgccacttcaaggagaagatgagtctagaagaagctcaccaccataggaggtcacagataagagcttggaggaagaaggagatgaatgaagggagagggagagaagaacacgaaattttgtgctctaaatga

SEQ ID NO: 60112 - DNA, 333 bp, Glycine max
  Peptide Sequence Number=SeqID_151797
atgccgagtgagctagacttaagcccgttcagggcgctcactgccgcgagcgattgtacggagagtcattgcggtgtgaatgcgtattggagaaaataccgctcttcggcgccattcctcgctcactgctcaggctgcgcaatcggtcgttcgggaactgcggcgatgcggtgcgggcctcacttcaaaggcggtaattacggtaccagctggcagaatcagggggatgtgaacgcaagggataagaacatgtgggtcaaaacgccagcaaaaggtttcccagcgaaccgtaaaagaggccagccaagttgcatgcgcaggtttttcgactga

SEQ ID NO: 60113 - DNA, 156 bp, Glycine max
  Peptide Sequence Number=SeqID_151798
atgggtaaaagagcgttgtgtcccgacgtccttcagcacaatattcctaaaagcagttcacctagtcatctgctcccccgaacacaaagttcaagatcatcacaggatccaaacacaaacagcaaactaggagtgagttatcacattcctaactaa

SEQ ID NO: 60114 - DNA, 255 bp, Glycine max
  Peptide Sequence Number=SeqID_151799
atgaaatggaaatgctgcaaggatttggtgctagcaaagtttgatatcgcagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggaggttagttga

SEQ ID NO: 60115 - DNA, 360 bp, Glycine max
  Peptide Sequence Number=SeqID_151800
atggggctccgaaaaaggggtagagaatggagaattgcactaagcaatcactacgcatggctccaaactcgtgtaggtggaggatgcatgaacgaaaacgcaattcatggggactcagaaaaaggggtgagaatggagaattgcaataagcaatcactacgcatgactccaaactcgtgggtggaggatgcatcgaacgaaaacgcaattcatggggctccgaaaaaagtagagaatggagaattgctactaagcaatcactacgcatggctccaaactcgtgggtggaggatgcatgaacgaaaacgcagttcatggggctccgaaaagagaggggttgagaatggagaattgcactaa

SEQ ID NO: 60116 - DNA, 280 bp, Glycine max
  Peptide Sequence Number=SeqID_151801
atggccaagttcgatccagacatagtcctcgaattttatgccaatgcttggcctacagaggagggcgtgcgagatatgaggtcctgggtgaggggtcagtggatctcgtttgatgcagatgctataagccagttcctgggataccctctagtgctggaagagggtctggagtgcgagtatggccagaggaggaaccggtccgacgggttcgatgaggaggccatcgcccatttgctatgtataccagggcaggattttgcacggactgtgccgggagacg

SEQ ID NO: 60117 - DNA, 549 bp, Glycine max
  Peptide Sequence Number=SeqID_151802
atgattgatgtaggtgttcattcagttatttctttgattcttgctttcattttggaccgtgttgctcatcatcacagcacaaaggagaattgtgttgctcccacagggaacgatccagggacgggtgacttagacaaatgcgggctatacattgaagaaaatccttcccgcctggttggtgttgaggaggttaaagatgcagaggctctcgttcctgtacccactgacgaggttaccttagtggggcagacacttaacaccttccttgcttggccaacacatcttgggaagcgtttatcagaacaggcagctgtgtctccagcaaaacctccagaaagcccggatgaagaggtcgatgatcctctgtacctgatgacattgaccatcccacaactgtttttgaagcctctccaagttatgtgggatgctaccatattcaaggtgtttaatcaaaacttcccgttgtatataaagcacgaagatctctctgaaattgcacatggtggtcaatgtctcagcatatctgttatacagttgtggattctataa

SEQ ID NO: 60118 - DNA, 336 bp, Glycine max
  Peptide Sequence Number=SeqID_151803
atgcctaggcaagcgcagggtgatgcacatcaggccgcaggcgcactgccaccacctcggcaggccgatccagttgggccactgggagtggagcgctatctacaacattgggttcgccagcaggctgtcaaccaccgtgggcaggggcagggttccgccccttttgtatgccctaccctagagcagtttggggcagaggtcgcatggtctggagactggcccaatgcccaggcagggaaggagcctgcaggatcccccggtgagacagatgaatcccgtatggatgaagatatgattgacctgctcgatttcttgagagggagcggagccgcatga

SEQ ID NO: 60119 - DNA, 231 bp, Glycine max
  Peptide Sequence Number=SeqID_151804
atggcagcggaatggagaaggaagagagagaggagacgccacttcaaggagaagatgagtctagaagaagctcaccaccataggaggccatggataagagcttggaggaagaaggagatgaatgaagggagagggagggaagagcacaaaattttgtgctctaaaagagctctgaaatctgaacccactaatccaagatcaattccaagattctccactaagtgtgcttag

SEQ ID NO: 60120 - DNA, 515 bp, Glycine max
  Peptide Sequence Number=SeqID_151805
atggggataaatcaaaccggaaaaagattctatccagtcaagattaagggcctagatgtcatcagccttaaggagttggggcgattgatgggacctctccaaatgcaagacttccaattagtaccgactattaaagaatttgaggagattctaagatgtcctcttgggggaagaaaactgtatcttttctccgagtttcttccctccttgagcaagattgcagttgtggtcagggattcgacaagagagttggatcgtgtaaagcaaactcaaaacggcatagtgggcctaccacggaagtacttagaaggcaaggcgagggatatggcaaatcaagaggagtgggttccgtttatggatgtattagcattgctaatctttcgggttgtcctatttccaaacgtggatggtttggtggacctagccacaattgatgctttccttgcatatcaccatagcaaagaaagcccggtggtagctgtcttggcgaacttatttgacccatttgaccgaag

SEQ ID NO: 60121 - DNA, 363 bp, Glycine max
  Peptide Sequence Number=SeqID_151806
atgccaatctcccctgcaaagtatcagttggtctgtgtcgtcccgacatggggatcgcaccccaagagacacccagtggacccggaaaagtccaacagggccctggggtttccagctttggttacgggcctctatcagtcctacaggggatcgcgcctgcaaggcacccagtggacccgaagaagtccaacagggtcttggagttgtcaagctctaatcacgggtctctgtcagttctacggagtacctgtcacctccagcaagggcatcaggccccctactaatcgagctttcatcaagaagtactgcgtctccaggcaggcgcagggcgaaacaccacagcagcctggggatggtcggtag

SEQ ID NO: 60122 - DNA, 967 bp, Glycine max
  Peptide Sequence Number=SeqID_151807
gtcgactctagaggatcccacagcgaaagctttggcggatcaaggtgaatgggtttcattcattgatatcttggcgttattggtatttggagtcatcctttttccatatgtggagggatttgtagatctagcggcgatcgatgccttccttgcttaccaccatagcaaagaaagcccggttgttgctgtgttagccaacgcctacgacacatttgaccgaagatgcgagaagagcggtgcaaggattgtatgttgcacgcccgctctttatgtatggctggcctcacacctctttcgtcatgaaagtagactcgtctatcccctgcaaggtcaccgcatgtgcgccgagaaatggaaggcaatttgggagcagctcttggctagtatggtaggggcatccattaattggttcccccaatggaaggaaggaagagttggggttttgtccttatatgaggggttctcaaacatccccttgatgggagcgaggggttgtatcaattataatcccgtccttgccataagacaacttggctaccctatgagaggagcgttgtcggaagaaagtaccacgcccttcatcgcacggggtttcggtgaccccaatgcaaggatatttcaaagggtccaaaaggcatggagtgcagtgcaaatgaaagataaggagcttaggggaagcagcaatggtatcatcggtggctatcataagtggttgagggctcagatgcaagagttagattggctcccgaagctaaagacctcaagtgaggaagaggctgaaacccctgaggagagcgaggaggtggaagccctaaaagtggaacttgatagggcacaagcagtcaaggaaaagttcaaaatgacagccatcaaggtctggaaagagtgcgacgaactgaaagacataaatgtggccaacgccgaagcattggaacgggaaaccaagagggcccggaaggaagaataa

SEQ ID NO: 60123 - DNA, 954 bp, Glycine max
  Peptide Sequence Number=SeqID_151808
atgcaatcacaggaacttgcactacctccaaagccagaggttggtctctcagatccttgtgtcagcacaaaggagagttgtgttgctccctcagggaacgatccagggacgggtgactcagacaaatgtgggctatacattgaagaaaatccttcccgcttggtttccctaggaagaatttatgagggatccacaacagttcacaacatccctttgttgcatggccaagtcaagattggtgttgaggaggttaaagttgcagaggctctcgttcctttacccactgacgaggttaccttagtggggcagatacttaacaccttccttgcttggccaacacatcttgtgaagcgtttatcagaacaaacaattgtgtcaccagcaaaacctccagaaatcccggatgaagaggtcgatgatcccctgtacctgatgacattgaccatcccacaactgtttttgaagcctctccaggttatgtgggatgctaccatattcggggtgtttaatcaaaacttcccgttgtatataaagtacgaagatctctctgaaattgcacacggtggtcaatgtctcagcgtatctgttatacagttgtggattatccatctgactgagacaagtgttcgagcggggaattctgatgtgtatggattcctcgagtcacaatccattcagagatctggacaatcacaatttgaatccgaaagttacatcaagagttggataaagagttcaaaacgagatgtataccttggagcctacctgaaagggccagacaactaccttaagggaataattagtagttcagtattgttttcattacattttcattggcataactcaacaacatcaataatgttcctcgtattcaacactagtgctttgaaaggacttgatgatactccacaacctaaatccaaggctactgcttggtggattgttgttaagtaa

SEQ ID NO: 60124 - DNA, 181 bp, Glycine max
  Peptide Sequence Number=SeqID_151809
atggaggagttgattaacaaaacacaactctctcccaaaataatcccaacgtcatcacgtcggcttgatggctccacaaaagaatctcacttcttgtcctctactgctgtcattctgcttccaagaatgaaggttcacaatcatcacaagtaccaactacacggtacaaaaattgtgaggg

SEQ ID NO: 60125 - DNA, 180 bp, Glycine max
  Peptide Sequence Number=SeqID_151810
atgatgcagatgcacaaaagcgcaacagggggatgtggtcatatctctcttgatgtctctagaggtatcatccccttcgaagaacatattgcggcagtagggactgctagcaacaatatgttatcaaagagaaaaactctagatgagggttcactgttatcaagcaagtcggagacctag

SEQ ID NO: 60126 - DNA, 234 bp, Glycine max
  Peptide Sequence Number=SeqID_151811
atgatgcaattatgtattacaacgggaagtggaacataccacatcaagaaactcaaggatttaatcaagcaagttgcacctacaagggttccccctaatggaattcacggatcacaattggttagacgattgttctttcgacaaccaggtcattctaagtattctgaaaatttgattgaatatgacataacagaattgaaaaatgatgaagacgtgctaaaggtgttagcataa

SEQ ID NO: 60127 - DNA, 87 bp, Glycine max
  Peptide Sequence Number=SeqID_151812
atgaacgaggtagatggcgatgaggaaacagtggcaaagctaaacggaaacaacgggcaaagtgtggggccctgctccataagttag

SEQ ID NO: 60128 - DNA, 165 bp, Glycine max
  Peptide Sequence Number=SeqID_151813
atggggaccaccacgggattatgggaattttacggaagcattacgggtgtcccggaagccccgaaatcccatttttcaacaaaacgggggtgtggtggccacctagctcgtccaggcgagctaggttgcttcaaccttaagcaagaaattgccaagaacctctag

SEQ ID NO: 60129 - DNA, 1062 bp, Glycine max
  Peptide Sequence Number=SeqID_151814
ccccctccatctcttcccccattccgggtatgcctgacggcaaaccggccaatacccgctgcgttcagctcgacgaacagcagcgctgcaaaatttttggctcgccgctgcgtccggcggtgtgtgccggtttacagccacaggcggagatcacgctcgtcacaggcgccgcgttacagcaacgcgtcagcgcgcccgctgtgaaaaatcctaaatccgccgcgaagtgtgcggagcatcaaaaatctgctacgccgattgcgcattttcttgcctgtaatcgggctgaaacgattcactttcagcaagcgaggagaaatatgttccagctcgaagttcaggccattcacaccggcgccagcgcgtccgataaagaacaggccattcgtcaggttgccgctgcgcttactgcggccggaaatgtggccgaaggctacgtcgacggcatgctggcgcgcgaacagcaaaccaccacctttctcggcaacggcatcgccattccgcacggcaccaccgatacccgcgatctggtgctgaaaaccggcgtgcaggtttatcagttcccgcagggcgtggactggggtgatggccagacagcgtacgtcgccatcggcattgccgctaaatctgacgagcacctcgcgctgctgcgccagctgacccacgtattaagcgatgacagcatcgcggagcagctgaaatctgcctctgctgaagagctgcgcgcgctgctgatgggtgaaaagcaggccgctgaattccagttcgatacgtcgctgatcgccactgacgtggccgccagcgatctgatgacgctgcaggcgctgaacgccggtcgtctgcaggcggccggtgccgtcgacgccagctttgtcgcggacgttgtctcgcacgcgccgctcggcctcggtcagggcatctggctgagcgacagcacgcacggcaaccttaacagcgcggtggcagtgagccgcagcgcgacgccgctgacacatcagggcgaaccggtagcgctgctgctgacggtcgccgccaccgatcagcgtccgcttgaggtgctgg

SEQ ID NO: 60130 - DNA, 141 bp, Glycine max
  Peptide Sequence Number=SeqID_151815
atgacgggagattcatcaaagttcacacatatctctcccaagaaaagtgggcatgttacttacggtgacaacaacaaaggtagaattctgggagttggaaaaataggtacaaattcttggagttggaaaaataggccttaa

SEQ ID NO: 60131 - DNA, 708 bp, Glycine max
  Peptide Sequence Number=SeqID_151816
atggtcatggaccaatccctattctatgacttaacccaattatctagtgaaggtgtaccatttgaaggtacactgaatcatgattggaaatttgatttctctgtgcatgatgcccaccggttggtttgcacctaccaagcggatatgaccggaagacttcttgccggatcattggcttttgaaagccgcatcctttactatctcattatcttattgttatgtgggcttttcatatcggccgaaaaacttgattgggcacacttagtccgatatcgtatgcataaggcattgcgattaaatgctcctttgccatatccacacctagtcacacttttccttcaacactttaacatccctcttgattctgaaccttgtgttccaatgaagagatccttcttaatcggtgccactgtgattgcatcttttggttactgtaaagagcatgatggctcttgggtaaaaaagggtgctcaacccattgatgaagaaggacacttaccagttggagaagattcctctcttcttcaaaggattttggacaggttcgatggtcttcaaacctatgttggtgaaaggtttgatcctttggaattacaagtggacatgcgattcgatgagatggactccaggatcaccacggttgaaggagatgtcacttacatccgcacatgctttgatctaccaccaccaccaccaccatcgtcttag

SEQ ID NO: 60132 - DNA, 299 bp, Glycine max
  Peptide Sequence Number=SeqID_151817
cggccagcgggcgtcgaattcgtgcgttgggcgatagcggaatccgaacgcacatagcgcgacaacatgcattagcagaaggccagcagctggctggccagcagcgtttcatcgacgataaagcctttgccttcgcgcaattttcgctatttcagcacctgtcgcagctgcgcctcgatgcgttagaacagctggttgatgaggccctgcaggcgatcctgttcaaacatcagcgcgtggccggtcatgatgcgcgtcagccccgggttgcgttccgcaaagcccagaatcagcagtaa

SEQ ID NO: 60133 - DNA, 708 bp, Glycine max
  Peptide Sequence Number=SeqID_151818
atggacctcatcaaggctgctggactgctgaaaactgttaccaagttgggagattgttatgaaagtctagtcagggaattcattgtcaacattccctctgacataacaaacagaaagagtgatgagtatcagaaagtgtttgtcagaggaaaatgtattagattctcccttgctataatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagtcaacatcccaatatggggggggtacactgactctgtgatgaagagagaatctcctctatccctgcattacaaattgtttgaggggacacatgtcccagacattgtctcgacatcagggaaagctgctgcctcaggtgctgtgtccaaggatgctctgattgctgaactcaaggacacatgcaaggtgctggaagcaaccatcaaagccaccacagagaagaagatggagctggaacggctgatcaaaaggctctcagaaagcggcattgatgatggagaagcagctgagcaagaagatgaagcagctgaggaagag

SEQ ID NO: 60134 - DNA, 306 bp, Glycine max
  Peptide Sequence Number=SeqID_151819
atgctggccgtgagcctgctcgccgtggcgctgctgacgctggcgatgccgtggttccacggcgtcctggcctggagcctgctgcggctggcggcggggtacggcagcgccagcgccttcatctgcgtggccgcttcacgcgccgtcggaccgggcgatccccgcgcgccggcggtgtcggccattacctacgcgggcgtcggcgccaggcatcgcgctgaccgggctggcgtgcctggtattgatggccgcgggcgcggacgccaatgccaactggaccgcgctgggcgcgctgggatcctctag

SEQ ID NO: 60135 - DNA, 210 bp, Glycine max
  Peptide Sequence Number=SeqID_151820
atgtcagaattcacaagcaattgtcctcctcaaattttagccaacctgcatcaattagactttgcaccttatgtttcagggtcatacaatgctcaatggaatgctccggaactcctccatgataagcacatgttgcattttagttgtatccttgggaaaatggaggttgaggaatctttgctgggattatggctaccattgtattattga

SEQ ID NO: 60136 - DNA, 727 bp, Glycine max
  Peptide Sequence Number=SeqID_151821
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttgttaaagaagaaggccagtcaagcatagaaggtccaagttatggcaagaaggtcattgaagaaggtgtgaaactaacggccaatgttgatttgcaaagagaagatgaatgtgggatttgcttagagccttgcaccaaaatggttttacctggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccacccg

SEQ ID NO: 60137 - DNA, 789 bp, Glycine max
  Peptide Sequence Number=SeqID_151822
atgaccggccctctcgatgagtcgatctcttgctttctcataagggtggacccttggggctacacgacctcaccttgggtactagttaccctcaccgttagaggactacacgtcctcgccttgagaggactacacgtcctcgccatcagaggactgcatgtcctcaccttcgtagggctacacaccctcacctttagaggactacacgtcctcagagggctacccgccctcgccttgggtactagttaccctcaccttcagaggactacacgtcctcaccttcagagggctacacgccctcgccatcagaggactgcatgtcctcaccttcgtaagctacacgccctcacctttagaggaccacacgtcctcaccttcagagggctacacgccctcgccatcagaggactgcatgtcctcaccttcgtagggctacacgccctcgccatcagaggactgcatgtcctcaccttcgtagggctacacgccctaaccttcagagggctacacgccctcgccatcagaggactgcatgtcctcaccttcagagggctacatgccctcaccttgagaggactacacgtcctcgccaacagagggctgcacgccctcaccttgggaggactacacgtcctcgccatcagagggctgcacgccctcacctccaaaggactacacatcctcgccttgagagtgttgcacgtcctcacctttagagggctacgtgtcctcattttcagtgtgctccacatccacaccttaagaggatttaaggtcctctgcccttaa

SEQ ID NO: 60138 - DNA, 186 bp, Glycine max
  Peptide Sequence Number=SeqID_151823
atggagaattcgtccctaacagttaaccacttaatccaaccctatttcaatttactaagcgaaaatcaacttagggttggaaaactgccaggaagccacattataaacgaaacctcaaagagagttgagcttcgtcctcaaaaggaaacaacaccagaatatttagccttccatagattcaaatag

SEQ ID NO: 60139 - DNA, 708 bp, Glycine max
  Peptide Sequence Number=SeqID_151824
atggttaggaccagaggattaggtcgtgccttaggtcaggttactggcaaaggtgtgggcagaggagatcatgatgattctgatgatgctccgcagcgtcggcggcctactgcatcagcacggaggcagcgagtcgctgtgactgcggatcacgtcgatgagccagtcatcccttcgccagatgttcaggatgacccgatggaggcaccagttgctgtagaggacattcctgcggacacaggcgcagaggctgctgaggacgcgcatgagggatttccgggtggtccgagcgacccatccgtgttgaccttgtatgcggatcacgttgcttgcagcgagcgtcctgaattgaagctatcctctcatgggaagaaggtccacagtttaggcaggcatgtccttgccattgagggacttgttgctggtacaggactaagtcctctgatcatgtgttcggtagacaccggcgatcggggacttttgtccgtgtttatggagcggtggcaccgggagacatctaatttccatctcccagtgggagagctcaccatcacattggacgacgtctcctcgcttctccatcttcccgtgattggcgacttacacgcttttgagcccttgcacgtggacgatgcgattcacatgctggtgaacttgttgatggtctctccaaagtttgctagggctgagacagtggggatcctctag

SEQ ID NO: 60140 - DNA, 426 bp, Glycine max
  Peptide Sequence Number=SeqID_151825
atgggttcgatgaagaggccattgcccagctattatgcataccgggtcaggatttcacctggaccgctgcagggaggtatgccacccaccaggcactctctagacccggataagtctaacagggccctagggtttccagcattgatcacgggcctcaaccagtcattcggggttcccgtcacacctagtaaggtgatccgaccgccgatcacccgggccttcattgagaagtattgcacgcctaggcaggcgcagggtgatgcacctcaggccgcaaacgcaccgccaccaccccatcaggttgatcccgctgggtcattaggcatggagcggtatctacagcacttggtttgccagcaggcggccaaccaccgggggcaggtgcagatacatgagtgtctctaccagcttagcctcagtcagtag

SEQ ID NO: 60141 - DNA, 216 bp, Glycine max
  Peptide Sequence Number=SeqID_151826
atgagggttcaaatagcaaccagacccacttgggccttccagaatattcctccagaaggcgattgcttctggaggaagcaacctagctcgcctgggcgagctggggggagaagtgaagggaaaaaaggtttagccctcctggtaattcgagatcatttgaaattagtgaaaaaaatcgtttccatgaagaaaatccaagccgaagcgcttccgtaa

SEQ ID NO: 60142 - DNA, 378 bp, Glycine max
  Peptide Sequence Number=SeqID_151827
atggaggccatgaaagagcaaatggccacaataatggaggccatgatgagcatgaagaagataatggaagccaatgcggttgcagttgccgctaccggcgttgttgctaaggcaaagatttggaaagtatggacggcccccattatgcgcaaattcaaaacaagcatgccttcccaccatatggctggcctcccaaccttacactacccaatgtggcatacactcccagtgaggatgtcaataactccactcctatacccattgagagccaacaaccccaaactgatcatgcacaagtctcttaaaccatgggggagacacatgaattccccaccacaatctagccgacttcaagcattgcctcagatatgccactaa

SEQ ID NO: 60143 - DNA, 134 bp, Glycine max
  Peptide Sequence Number=SeqID_151828
tgtgtgttgtgttgatgatgttgcataagaagaagaatggcagtgaaaacggcaacaacaaggagaacgaagacaccaccatcactgatgtcttgaaggtcgaagcgcactacgaaggttgcgctcccgtatag

SEQ ID NO: 60144 - DNA, 171 bp, Glycine max
  Peptide Sequence Number=SeqID_151829
ccttttggtactagtacctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 60145 - DNA, 216 bp, Glycine max
  Peptide Sequence Number=SeqID_151830
atggtcgttcaactactcatgtcagcacaaaggaaaatgttgtcatctggttttgacgatactccacaaagtaaatccaaggctactgctaggtggattgttgttaaatgtaatagacaaaaaggaagtgctgcgtgcgggtattacgtcatgcatcggatgtcaactataatcttaggaagtttcaagaataattggaaaacgataattgcttaa

SEQ ID NO: 60146 - DNA, 246 bp, Glycine max
  Peptide Sequence Number=SeqID_151831
atggaggccatgaaagagcaaatgacgacaatgatggaagccataataagtatgagaaaaatgatggaggctgactcacccatctggcctcaatcaagtaaatcgtccagtcttggatatggtaggtcagggagcaagcattccttcctaccatatggcttgcctcctgactatacaccacccaatgttgcacatgctctcgatgagaatgtcgataactctactcttatacctattgagagctaa

SEQ ID NO: 60147 - DNA, 252 bp, Glycine max
  Peptide Sequence Number=SeqID_151832
atggcagcgcagttgatccatgatcgtgttgtgatggagtgcctagaggtacatccgaaggaacccgcacgcacacttcagcagcctgtggagtggatactacctacacctactccatatcgactagttgagccggttcaagtgatagaggtgtcatcctctgaagaagatcttgaagatgacccagaggagttacctcctgaacctgctgtggatgctgatgcaatcctaccccgcaagggcattgggtag

SEQ ID NO: 60148 - DNA, 396 bp, Glycine max
  Peptide Sequence Number=SeqID_151833
atgacattgctacttagcaacattcctcgcccagcgaccgtcaatgccaatctcagagggctacacgccctcgccaaaggatcgcacccacaaagatacccagtggacctgaagaagtccaacagggccctggggtttccagctctggttacgggcctctgtcagccctatagggcgcccgtccccccagcaagttcatgtcgtcgcggcatagggattgtgcccgcaagacacctagtggacccgaagaaggccaacaggggagtgcctgtcgcccctagcaaggtcatcaggccccccctaccaatcgagctttcatcaagaagtactgcgcccccaggcaggcgcagggcgaaacactacatcagcattgggatggccggtagcgggcaatag

SEQ ID NO: 60149 - DNA, 1101 bp, Glycine max
  Peptide Sequence Number=SeqID_151834
atgaaaagagaaatacatgcctcttatagtagtcataactcttgcaagagcctaagtgaagaacttcacgactattatgaaggaaggcataggtcacatcttagacctcactcccataggagagaaaaggaaagaaatcctcaagaggctaacattaacctcccatacttccatgggaaggacaatgcagaggctaacttcgattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagagaatagaaaagacacattacttctcaatgccccatcacaaaaaccatgattatgaggggcaagaaatttatagtagccaagatgaggctactacttcaccttcctctagtgaaagtgaagaagcaaaaggggaaaaatctagtgaagaaatctacgcccaagttaaaggacaaccatcagtggttaaacagaagtgtaaggaggtaaatgtctcctccaagagtttagctaagaaggaaactcattttacaataaatacaaatattaaagaaagtttccctcttagacaacctccacattttctcttttgtaaaaagacacttgccagtattgccacacctcttgggcttgagtttattcctcaagtaaagaagttgttggatgagggtttggttagcaagagcttatatccttgtgctttgttgtggctcaaaataggtattattaggcaccaagtccctaaaattggtggtatgatgaatgttttgaatggtgcaaccctcttttgtaaaatcactcgtgcacccaacatcttcatggtgtgtatacatagggactcattaggtagtgatcaaggggttcccatgaaccctaagagaataaaggtcattcttgagtggcccactccaccaagtataagaaaagtttggggcttccatgacttaacaaacttttacaaaaggtatcgaggaaaggagcccagagtatgcagaacctcgagatttgaggtcaaatcctttcaaaggtggaggggataa

SEQ ID NO: 60150 - DNA, 183 bp, Glycine max
  Peptide Sequence Number=SeqID_151835
atgtggaaggtgcttccagaatacacgagtttcaaggtgtctctagctaagaggcaaaaatgcaaggaagatgattcaacacttgaaatgttgcatgacaattgtgaaagtactagtttcctggaagcaagagtcagtcaaaaagtggagcataaatcacaaagagagaaaaggctagcttga

SEQ ID NO: 60151 - DNA, 189 bp, Glycine max
  Peptide Sequence Number=SeqID_151836
atgacatggagcaacttcccggctcgaacttccaagttcatgaacaaattagtttgcatcaaggagtggcagtttgtcaacaaggacattggagtcaagaaaccagggaacatatttgaacaacaactgatacatacttcactgggctgcaaacgggtcaatgtgtatccgtcgattttatctgcttga

SEQ ID NO: 60152 - DNA, 135 bp, Glycine max
  Peptide Sequence Number=SeqID_151837
atgaccagcgtcaaaggtgctggtgttgttgcttcttttggataccagaaggatatggatggccaatgggtgtgcaaacaagacctaccacctcccaatcccgatgaacgcacaccctctccaccaccgcaataa

SEQ ID NO: 60153 - DNA, 417 bp, Glycine max
  Peptide Sequence Number=SeqID_151838
atggctactccacctgcctcgcctcctcctcctcctcctccagcattagcatcagcgtctctatcaaccttgaagcggacacgcaaagccacacggctacgatccttggccactagaccacctggggcagagagaccagtggtccatgtcgatcttgcgatcgggaaggccgacagtccccacaagaagaaattaagaacacatttggggattgtcactggtgataaggcggaatttgatatccctgaagcttctgatgccaacaaggacagtgtggacgacactgtttgtgaaaaatacggcattagcaaggagaaattggcccagttttgtcagacccgcagaaaccccttgtgggaggatgtgcggaaaaaggcacaggccatccagaagcaaaacatcgcccctcacgtgtag

SEQ ID NO: 60154 - DNA, 609 bp, Glycine max
  Peptide Sequence Number=SeqID_151839
atggccagaacacgaggtttaggtcgtgccataggtagacttgtaggcatagatagacctgctgaccaggatgctgctgatgttcccgagaggcgtaagcctactgcctcagcccttaggctaagcgttcatcagatgactacggagggacgtgatatggttgaggacgtttctgacatgactgacgatgttcctgagctggctgcggaggcacctgagatgcgtgcggacgcacagggtgctgatagtggtgaggggtcagatggtgatgatgctgctgagggattcccgggtggtccacgtgacccgtcagtgctcacatcatttgccgagcatcttgcacatgttgtttggagtggacatgaacgtcctgatttgaagttagtgtcacatgggaggaaggtgacactgattgggaggctagtgcttgagattgaaggcctggtggctgccacaggattaagtccactgatcgattgttcagttattactggcgatcctggactgatatctgcatttgtggagaggtggcacggtgagactagcaccttccacctttctgtaggagagctgacgatcacattggatgatgtctcgaacccatcctaa

SEQ ID NO: 60155 - DNA, 150 bp, Glycine max
  Peptide Sequence Number=SeqID_151840
atgttggtgatgcaatcctatcccgcaagggcattgggtagaagactccaagtagattgggctagagatccaagggaaggccctaaggttctcatgagccttaggctaagctctagcttctcatctcaaggaggtgagcttagctattag

SEQ ID NO: 60156 - DNA, 279 bp, Glycine max
  Peptide Sequence Number=SeqID_151841
atgattataaggggccaagatagttatagtagccaagatgagggtactacttcaccttcctttagtgaaagtggagacgcaataggggaagaatctagtgaagcaatctacccccaagaagtaagggaccttttaatggccagaaggcttctaggaggccaatcttgtgtagaagcaaagcttcatgatgaatcaagattgattcaaagatgttttgatgataacaatgatgatagcaaaagatggatgacaaaggtgatgacaaaaagctcaagatag

SEQ ID NO: 60157 - DNA, 376 bp, Glycine max
  Peptide Sequence Number=SeqID_151842
atggaagaatcgtcaaaaaagcgaaagggatcatcctccaccaccgctactgctggccatcaccgccacggaccatctgaagcacccacaacacctattcatccttccttatcatctccacgatcatctactctattttctttagatgaacaacgtctatggtacaactctcaattttcttctaggatcatcttagaccctaagtacctagacacaaatttctttaatgatgatacatttgactgttatcaagtgtttcaaaacaatggattggttgattttatgtccttaaaattgccttactatcttgaacttgttaaattcttttacaacaatttaaaaattccggatggtattatttcttctgaggtgcatg

SEQ ID NO: 60158 - DNA, 456 bp, Glycine max
  Peptide Sequence Number=SeqID_151843
atggcggaaagggagatgatcacaattatggtagatacattgcctacattctactatgaaaagctgataggatacatgccaactaactttacggatctcgtcttcactggaggaagaattgactccggactgagaaaaggcaagtttgaatatgcctccaacggggcccccaacaacaacaaaagagccccaggggtgggcgcaaggaaaaaggaaggagatacccacacggtcaccaccgccccaacgtggatgaaagcaccccaaaatatccaaagctcataccagcccaaccccccgaacttttcaatccgaaccgggagttccctcccaactcaagtgaataatatgatggcctggaatttctttttcaaatgcaagtatgtgcatgatgtagtttgtgatagcaaaatatttaggatgtggttaagtgtaaattttgacacaatgccttga

SEQ ID NO: 60159 - DNA, 331 bp, Glycine max
  Peptide Sequence Number=SeqID_151844
catactgggcagtgaagacttgcaacttctctatggatcaagctggcgaggaaagaagttgcaactgagtgagttagatgaaatccgcctagacgcctacgagaatgccaagcttggactcatgagtggtaagttgaggtctaagtggattggtccttttgttgttactaatgtttttccttatggtacagttgagatcaaaagcgactccacaaacaagagcttcaaggtcaacggacatcgacctaagccattcctcacgaacccttctttagtggacgtagtggtggaagagacttccttactccaccctactcttcctccaccatga

SEQ ID NO: 60160 - DNA, 315 bp, Glycine max
  Peptide Sequence Number=SeqID_151845
atgacccaagagctggtagcccgcggagacaccttacagttatccacacctcgtcattcagtgaccccaagtgtgattgatgagcagaggccaatgtggtcatctgcaccctttccggagatgtcagcatcttccggtggagactttttcaagtctcacaaaggcggcgggcccgatgacatgcggaagacaaaattatggtcattccgcacacctttttcgccattcagacacaggttgtgtccgatggcacgcagagacaaattatggtcatttctgcgccctttcgtcaatcgcggccgacaagcccgttga

SEQ ID NO: 60161 - DNA, 591 bp, Glycine max
  Peptide Sequence Number=SeqID_151846
atgactttgctgctcagcaacatccagcccagcgaccataattccgacctccccttgccgaagtgtcagctggtgtacgccatcctgacgcagatgagcattcacgtggctcagttaatcgctgatgtcatctatctattcgcaggtatggcgcctaccaggcaccctctggacccggataagtccaatagggccctgggatttcccgccttgatcacaagactctgccactcgttcggagtcccggtcgcacctagtaaggtgattcggccgcccatcacccgagcttttattgagaagtattgcacacagagacaggcccaggggatgctccgtaggccgcagatgcgccgccacctcatcaggctggtccagccggatcatttgatacggagcagtatttgcggcatttggttcgccagcaggcggccaaccaccgggcacatggcagaggtcgcatggcctggagattggcctaaggcccgagtaggagaggcaccagtagaggctcccgacgaggcagatgaggcccgcgaggacgaggaaatgaccgatttacttgatttcttaggaggaagcggggccacatga

SEQ ID NO: 60162 - DNA, 555 bp, Glycine max
  Peptide Sequence Number=SeqID_151847
atggggacaaatcaaaccggcaagaggttttaccaagtcaaggttaaaagcctagataccaccagcatcaaggaattagggcggttgatgggacctctccaaatgcaagccttccgcaagacttacggaaagatcttagaggtgtcctctcgggggaagaaaaccatacctttcctccgggtgtctcccctctttgagcagaattgcaactgtggtcaaggattcagcaagaggtacctagaagacaaggcgaggggtatggccaatcaaggagattgggtcccgtttatggatgtgttagctttgctaatttttggggtcgtcctctttccaaacgtggatggtttggtggtcctagcagcaatcgacactttccttgcataccaccatagcaaggaaagtccggtggtagctgtcttggtggattatttgacacatttgaccgaaggtgcgaaaagagtagcgcacagatcatctgttgcttgcccgccctctgtgtttggttggtttcgcacttgttccaacaagacacaaggcatccatgtccgctcctga

SEQ ID NO: 60163 - DNA, 991 bp, Glycine max
  Peptide Sequence Number=SeqID_151848
gagcgcgcaggtgcccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttgggggaaacgatgtgtgacacccaggcaggcgtgccctcggccctaatggcttcgggcgcaacttgcgttcaaagactcgatggttcacgggattctgcaattcacaccaagtatcgcattttcgctacgttcttcatcgatgcaagagccgagatatccgttgccgagagtcattgtatcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcg

SEQ ID NO: 60164 - DNA, 66 bp, Glycine max
  Peptide Sequence Number=SeqID_151849
cattctgtgatgctgattgggcatctgatgtggatgacaggagctcaacctcagggactgataaat

SEQ ID NO: 60165 - DNA, 342 bp, Glycine max
  Peptide Sequence Number=SeqID_151850
atgaggctcagagctcatgagcagttccaaaagagagactctagccgaggttttgttgagttgttcaatgaccttgaactcgccttgttgaataatgcggaagaactcgccggcttcctcaagcgatacctctttcttgtcacagccatctcttccctcggaaagacctttcatcggaatatccccatccggagcggggatcactttgacattttgtccttccgtcatttttgccttccctttagcgtttgcgggctgtgttgggaggtcagagggtgcgaatacgcgaccgctgcgggtcatgccgctcagccccgtgatattggttaccttggccgatag

SEQ ID NO: 60166 - DNA, 534 bp, Glycine max
  Peptide Sequence Number=SeqID_151851
atggataagagcttgaaggtaggagaagatgagaggagggagagggagagaaggagcacgaaattttgtgcctcaaaagagataagtggacccaaccttgggccatgggctcaaaaatctacccttaggttcatgaaaaccctagggccttcttcagcaactctagcccaatcctcttggagcctcttgctcatggctcttgtaactggtcccttcctagggaggattgcatcaagtgactccaacaaaaagatgccaaagaaaaattggaacagaggaagaccaagaaagacattgaagagacggtacatctcttgtggatcagttcaagtggagggtacatccacttggttgttgaaagagaacaagggagggtacatcccttgtgggtctttgcttgtaatggattttacaagattattggaaatctcaagaaccggtggttgcttggagactggatgtaggcacgggttgtggccgaaccagtatttgcatggagttgagactagactgaatagatatggaagaaattaa

SEQ ID NO: 60167 - DNA, 81 bp, Glycine max
  Peptide Sequence Number=SeqID_151852
atgactaggaaactcccagaagattggatcggagatgcaggaaaaggccctagggttgtcatgagccttagggctccatag

SEQ ID NO: 60168 - DNA, 1647 bp, Glycine max
  Peptide Sequence Number=SeqID_151853
atgatttcaatgcagatcatggttaggaccagaggattaggtcgtgccttaggtcagcgagtcgctgtgactacggatcacgtcgatgagccagtcatccctgacccagacgttcaggatgacctgatggaggcaccagctgtagtggaggacattcctacggacattcctgcggacgcaggcccagaggcagttgaggatcagcctcagggatttccgggtggtccgagcgacccatctgtgctgacagcgtatgcggatcacgttgcttgcagcgtatggacgggagaggagcgtcctgaattgaagttatcctcgcatgggaggaaggtccatagtttaggcaggcctgtccctgccattgagggactcatcgctggtacaagactaagtcctctgatcgcatgttcggtagacaccggcgatcggagacttttgtccgcgtttgtggagcgctggcaccgagagacatctagtttccatctcccggtgggtgagctggccatcacattggacgacgcctcctctcttcttcatcttcccattatagtcgactttcacgcatttgaacccttgcacgtggatgatgcggttcagatgctggtggacttgttgatggtgtctccagagtctgctagggctgagacagtccagtgttgcggaccatacgtacgcctgcaatgggcaggtcattggacaactgcggctcgtgcatatcttcttcacctgctgggttgcactctgtttgctaacaagagtgaaaccaatatccatgttgtctacttggaggcccttcgggacctcagtatgacaaataggtacgcttggggagtggctgctttggttcatatgtacgaccagctgaacgatgcatccatgacccacagtcgacaacttggtggttacatcacactgctgcagtgctggatttacgagcactttccctcaattgcggagtccaccgctgataaggactacgacgaggcttctccgcgtgcatgcaggtggattgcgacgaagaagaccgtgaagagcattcgcacgccgtcgtatagggagcgcctggaccgactccggattccgatgtctgttggatcccgtatggggagcatcgggaggtccgagacttccacgtcagatcatgctactccggtctcttgcgctggggcctattgctgtgtattaccgatcggagagggtcgtgcggcagtttggtggatgcactacgaggatcatattgtacttgcaggtgaggtgtgcgtggtgccaggggcgtgttccagtgactacatcgactggttcttccgcatctcccatcctttcatgacaccaggccacgcagtagatcctctgcctcatggtcatgccccacagccccgagtcgtccctcaggccccgcagacggatatccctcgcgtgccggagccaggagcatcgtcgacatctatggaggagcccagacatgcagtggaagtttgtgatgacattgctgagcggttagagcgccatctgagtctaggggtggtcactcgtggctcattgacacatgaggtgatcgaagaatgccttagattggccaggagtgtcacacaggaccatctagtatacgttaggtgtagacgcaggcggcacactgatcaggcttag

SEQ ID NO: 60169 - DNA, 186 bp, Glycine max
  Peptide Sequence Number=SeqID_151854
atgaggcccaaacggattcttcggagtctaggccttggagttagttataattgtaagggtagagggtgtcacagatcaagcttggaagaagaagtagcattgttgaacttctccctcaagatggaattcgtgcaaaatgaagggatgaaggctccaatagattctttttctcacaaagaccaataa

SEQ ID NO: 60170 - DNA, 300 bp, Glycine max
  Peptide Sequence Number=SeqID_151855
atgttcattaactgctgctgttgtacaacatttttggccactggtaatcgattacatcctctgaattatcgcattcagtgcaaatcccaacccgagaggaattgcactaagtgtgaaaagttgcacttagcgccaaaagtggactcccgcttagcgagacgagctcacttagtgagatttgtagattataaatacgttcttcaacgtgaaaaacacgatttttcacgatttttctctctaaacgcccacccaagccctaacgtctcctccaccacccataaccatcggtggccaccatga

SEQ ID NO: 60171 - DNA, 378 bp, Glycine max
  Peptide Sequence Number=SeqID_151856
atggtagaaactttttccggaagaactgtgaactaccggaggaagttgttccggaagaacaactgtgaaattccggaacaacttattctagaagtttcttccggaagaagttgttccgaaagcataactatgaacttccggaagaacttcttctggaagaaaattgtagaatttgttgttcaggaatttcacagttgttcttccggaacaacttcctccggtagttcacagttcttccggaaaaagtttctaccattttactgttcacattctctaaaaatctacacccgaaaacgcaagaaaaaaattataaatgcatacgttcgacaaaataggaacaacaatgacgaacacacaaacgggaccactaatatttaa

SEQ ID NO: 60172 - DNA, 346 bp, Glycine max
  Peptide Sequence Number=SeqID_151857
atgggctcagaaatctatcctgaggttcatgagaatcctaggaccttcttcagcagctctagctcaatcgtcttggagcctcttgctcatgaatctggaggtatagcccatcagtttgtggatgacacaatggtcctaggcaaaccatggaatctcacaacttccctgaaaaagagttttgagatgtgggaagcatcatccaccttgtggcatggtataaagtgtgtcatcttgctaaacctatccaccaccacaaagatagagtctacacctctttgggttttaggaagcccaaggacaaagtccatactaatgtctacccaaggtacagatgggatgggtaagg

SEQ ID NO: 60173 - DNA, 621 bp, Glycine max
  Peptide Sequence Number=SeqID_151858
atgtcgttagcgtcttttccaaagcctcattacggttctctcccctcgccctcatcatctaactccactacctacttcgtcacatgcgccacgacatccacacgctcttctttcgccacacaccaaccatgggaagaggtattcacactctactccttcacgcacccttactcgatcgaagaagcgacgatgcgtgtgaggcgcaacctcgaccacttccgcatgaactactccatgatggtgttgttcgttttgttcttgagcctcctctggcacccattctcgatcatcatggggcaagttcccaatcaatatcctttcttgtatttttttcccattcttgaaggatgttcaactcaaattagattggcaatggactgcttcagaaagtgccttttaggttatcacatagagaatatacaagtcttataccttaagaagcagttaagggctcgccaaataagtgaacagcaaataaataaggtggaagagttgtggaagaaaaatcccgatgctttttttgaggaccttgagaagcttggtgtagatgatggacctcagtccgtggctttgaaaatgaagatgcatatcatgtgtttaggaatcaggatggcttgttaa

SEQ ID NO: 60174 - DNA, 115 bp, Glycine max
  Peptide Sequence Number=SeqID_151859
atggctgaaccatcatctgatgctgctactacaagtgcaacgaggaaaaataaggtagacccaggttggaaatattgtcattcactggtggaaggagataccaacaccattgttt

SEQ ID NO: 60175 - DNA, 1881 bp, Glycine max
  Peptide Sequence Number=SeqID_151860
atgtcatttttctggtttactcttaacctgaaagttattcaggttgaggttgatttggaacataatcaatatcggtctttccaaggtttgacttgcctgatgcaaatttcaacaaggactgaagattttattgttgacacattgaaacttcgcattcatattggaccctatctaagggaaatcttcaaggaccctgccaagaggaaggtcatgcatggtgcggatcgagatattgcatggcttcaacgagactttggaatttacatttgtaatttgtttgacactcaccaggcttcaaagttgttaaacttggagagaaatagtttggagcatattctacatcatttttgtgaagttactgcaaacaaagaataccagaatgcagactggagactacgtccacttcctgatgagatgataagatatgccagagaagatacacactatctgttgtatatatacgacttaatgaggattaagttatttgccttgtctaaggagtctgaaagttctgagtcttcagacactcctctggtggaggtctacaaacgcagttatgatgtctgcattcagctatatgagaaagaacttttgacagagaactcctatcttcatatatatgggttgcaaggggccggtttcaatgctcagcagcttgccattgtttctgggctgtgtgaatggagggacattgttgcccgtgcagaggatgaaagtacaggatatgtattgccaaataaatctgttcttgaaatcgctaagcagatgcctcttactacaagcaagctacggcgattggtgaagtcaaaacacccttatgttgaacacaatcttgatactgttgtcagcatcattaggcattcaatccagaatgctgcttcatttgaggaagctgctcaacagttgaaagaagcacaagctgtcactgcatcagatgtagtacctgttacagatggaactgaagatcccccatctcatacacggcattctaaggaatcttctcagcatcaagctacaagtgtaccaataaaaattaagtccaatagtcttatttttgagccaccaaaggatagtctcacaattgcagagcagaatagggatgcaaatgttggtgcactttctacagcaaaggggaatggagcagctgttcaggtgcttaaaaagcctactggtgcttttggggcactcctggggagttctgcttcaaagaggaagcttggtcctggtaagggcaaggaagagatcaagctagagcagattagatcttctgtcagtcttcctttccattcatttttgggtagcagtgaaaagtcagaacctacagaagaaattcctagtgtagcatctgaaatgtcagaaccgcagaaacctgtttctgatgtagtttctgcctctccagtagatgagattataatgctagaatcagatacgggtgcaaaggatatggagcagaataacctagaaaactccaatgaacacagggagaaagattctgttgtgtccacttcgggaaaagaggatgaagatgagccagtatcactgtcagaattgtcatcgaatttaaaaaaatgctttcattcaaatgatcaaaataataaaatcagacagcccaagaaaactgaacagcccagtggcttagtgcagctgaagccatttgattatgaagctgcaaggaaacatgttaagtttggagaacataaaaagcatgcatcttccaagggttccgatggtcatatggaggtagtagaggactccggtagcaagaagcagcgttcgacaacaggacagggacaagctagtgatttgagtaaacaattgccacaaggtagaagacgtcaggcgtttcctgcttctgggaatcgtagttcaacattccgctga

SEQ ID NO: 60176 - DNA, 954 bp, Glycine max
  Peptide Sequence Number=SeqID_151861
atggagcagggtggagacagagttggacatgttaacaaggttattggttatgggaaaagggtcattgttaagaagaggaaaccttaccatcatcatcatcgtaggattcataataagaagacagtgcctaataaagtcccaaaggcacttcaggagctatttgtttcatgcagggaaacattcaagggtcctggtggtactgttccctcaccacaagatgttcagaaactgtgtcacattcttgatagcatgaagccagaagatgtagggctaagatcagatctgcagttcttcaagcctgaaaatattgtcaaagagaaccaaagggtcacgtgcacaaccatatatagttgtgagaatttctcgctctgcctctttttcctacctgcaaagggagtcattcccctccacaaccacccagaaatgactgttttcagtaaacttcttttgggtcaaatgcatattaagtcctacgattgggttgattctgaggtctctcataatttgttgcaccaaccatctcagttcagattggcaaggttaaaagctaataatgtgttcacagcaccctgcgacacttcagttctgtatccacaaagtggaggcaacatccatgaattcacagctataactccatgtgctgtgcttgatgtccttgggccaccttattccaaagatgatggcagggattgctctttctatagagatcacccttatactgcttttccaagattgttttctatggacttatttgactcaaacaaaaataaatcaaagtccaatatagtttatgggtttgcaacctacaaacaacctggtttttatgctgcaagtggtaaggtgaaagaagagaatgatagttacggatggttagaagaaattgagatgccagaaaactctcaaatggatggaattgagtatttgggtcctccaattatagagactgccctatag

SEQ ID NO: 60177 - DNA, 1122 bp, Glycine max
  Peptide Sequence Number=SeqID_151862
atgaaacaagagttgaaagaggccataaaaattgagttttcacaaaggggatcacaatactcacccccaattgaggctgacatacaacaaatgggtgcacgtgtgaacacaaagggtagtaatgttgaaactggtgtcaacccattaggggaagaagatgttgttgatgttatatcgactatgggattgtatgtgcaatgtgatcattctacacacttggtggccttgggaaaaatatatggaggggggtctaccatacacaatgtggcttatgcagatgacatggtaagggtcagtgttgaaaaagttttcgacagtgatgctaaagtcctgttccccacgactcacttactccaacacaaagtggctaaacctgttcgaaggtcaaatgatgtggaggcagatgatcccttgcgtgggctgatcatgagcctttgtgatatttatgacaaacctgttgaattgttgtttaatgggactaaatttgggattcatgatgtagatgcatctgtcttcctaacatattctgatgtaaatgaaataatatcagttcaagcttgggtcatggttccatgtatggattccttgagccttagtccatacacaatgcaaaggataaacatggtgaatcccaacaatacattgaaacatgggttaaggaatcccaacgagaggggccattggcagctggttgttttgtgtcctatgaaggaagttatcgtttggttttgttcattgtgtaagaagcctgatattcatatcaaagctgcaattaacaatagtgcaatgaacccattaaagactactttgcatggtcatattgatcaagttgcacctaagtggattgaagtaaaggatcagtgttttaagtgcaaccaacctggccattttgcaagtcaatatgaacctgaggatgtagatagtgctgatgatagccaattgacatcaacacaaatgaggttcaacaactacattcatccatgtctaagcacttataacttcaccaagtgtgtcattattggaaagaggggtttggatatgttgttgaatactcgtaaccctcacggtggattgttcgctgaaaattatgaggcacttacttcttttggtccctcattttga

SEQ ID NO: 60178 - DNA, 800 bp, Glycine max
  Peptide Sequence Number=SeqID_151863
aagctagagaagccaaagaaaatctactaaacatccaagctgaacgtgaaagctatgatgcccagattgaagacttaaagttactcttaaaagctactaatgaaaaatatgagtccatgcttgatgaggcacgacatgagattgatgttctcgtatgtagtattgaaaattctaagagtgcctttgagaactccaaggctgagtgggagcatagagagcttcaactagtcagctgcataaagaaaaatgaagaagagaaggggtaccaggaaaaagaaataaaaagattgttttatttgcttaaagaaactgaggaagaagctaatgccaacagggaggaagaagatcagttaaaggaaaatctgaaggaagttgagcctgaggcaatccaactggaagctgaatctattaagaagttggaggagttatctaagttgctggaagaagctacaaccagaaaccacactgaggaaaatggggatcttactgacagtgagaagtactatgatttgcttcctaaaggagtagttgttgatgtgtattataatggtgatgtggtatcaacttctgaaggggtattatttgactgtcctaatggtcctaaattcataaaaattagtgaggaaatgttgcttgtagctttgaggaaagcaattacaaatgccatcggaggtggaagaagcttatttgaggatgattgtatgaagcttaaagacaacaatgaagtgggaaagatgtttttcacctttccacaatttagttctaaaggtttgatcaatttgtatgcaatggttggctga

SEQ ID NO: 60179 - DNA, 264 bp, Glycine max
  Peptide Sequence Number=SeqID_151864
atggttttggcatcaggatcagtggccctacacatctccctgtacaatgttgctagacaagcagagccccaactataccgtctgactcgttcgatatcagccaacacaatgagggttttaatgtcagacaagacaggaaatcgggttcatttgacgtacctcattgtgttggctgatatcgaacgagtcgtagctttgaagctcaacaagtgtgtgtcttacatcgctcaacaagtgcagtcactagatgatgatcaattttga

SEQ ID NO: 60180 - DNA, 291 bp, Glycine max
  Peptide Sequence Number=SeqID_151865
atgggcgacttattaggtgttgatttgcgtcaggagttttctgctgagactgagcaagcagaagcggggagacaacgggttatcgttttagggtttgagggtttagggcttaggggttacggtttggggtttaggggtttaaggcttagggttgtggattatgggttaggtttagggcttaggggttacggtttagggcttagggggtttagggttaggttttatgggttagggattaggcttagggcttggggcttggggtttggtgtaacgacccgcctcgtcgctacg

SEQ ID NO: 60181 - DNA, 279 bp, Glycine max
  Peptide Sequence Number=SeqID_151866
atgctcaaccccaataacaaaagagaacactctgatggacagatacaaatggtaattcgcagtgctttgagaataaatcattacagggtgatagcagctggaggtggggcacagctttgcatgagattttttttagtttcttcagacatggttgaaaatgtggtggccactacaagtggctgggttcaatcttggatagtgtttacagcagagaaaaaagaaatcacaaaacaaaggtactgggggattatctcgcctgaaaagttcactggtggctga

SEQ ID NO: 60182 - DNA, 291 bp, Glycine max
  Peptide Sequence Number=SeqID_151867
atgtttttagccctaagcaggatggggcaatggtctgaaaaattcctttccaagatgaattgggtgcagcctggccatttgttgatccattcatgggagacaaaaaatctgtctaatttgctcgtagcagccccatttggtttgaaccatgtcagctatccattcattgaaatcaatgatattgttggcttccattcccctatgagacacaccctctctttcagattgatgtctgatgctgttaaaatctcccaggaagcaccacaatccatcaagaccatgatgtcttag

SEQ ID NO: 60183 - DNA, 3012 bp, Glycine max
  Peptide Sequence Number=SeqID_151868
atggcgacacatgggaatacgccacaggacccttttcatgtcttacgcaaaggtggtgtctactaccaaaacagacgtcgggcagaggaggcacctccacaccccagattcgtcgagtcccatttgtcggttcacctcaaagttgcagagggggaaaggaaatggtacacaaacacatgggtgggccggctaaagaatctaggggctttcgaaagagttgaggaagacataccctgggagctaggagtatatgtcgtgccgaaatacatcggtgatgacatgatactcctcctcgggctatcggtctccaaagcagaggagattatcttggaagaatcccaacacggcacatctccgttccaatcgctagaaaagtggaatccgacgatgaggccgggtcatcgactggtatgggtccaatgctggggagtccccctagaagtatgggacataaggaactttcgaaaaatcatggttgcagttggagaccttatcgaggttgacaatgatgttgaagagttgagaaggttagatagggccagaatccttatcagaactccatggagaccactattccaccacacagttgcagttcatatcagcggggaggtccacacggtgcatatagtcgaagaagggtggagcgacgccggaacgcgcatcccccttcgtcgaggcgtgacggactcatcggaggagcttgacttcgacgacaacaacagcggaatactgtgcgcagcgatggcgacaatctccgatatccggcaccggccaaacagcctcaacggcgactggattgttgttgccgacaaccaacagctctcgcctttacccgatggtcctcgtgtcatggagaatccagtgggtaatgcacaagacagctgggcacatctccccaatatcgacatttgtgcgcgtacacgaaagtcaccaaagaagaaaggaaaagggagcaaagccacgtcgtcagcagctaaggggggcccaggatacgtggaaaaggaaagagctgctgcacaaaggggagatgatcacgaaactcccaacgggtcacttatgacctcaacagtgccacataacaccaaagtttttgaatctgggccaattactgaggtgggccttactaaccacaccacattcataacatcacaaccttttaatgccagcccaccacaccatgaaacccccaacgtgcctctaatgtcttccaaagtggcacatgatactcaagttactgaggctgggccaactattgaggtgggccttactaatcacaccgtagccaccaactcactaccccaatgccagcccatcccatcaaacaaccgagaaaggaagggagtggaaagtgaccccatatcgggcatggtcacagcatcagcagctacgggctactcatccatggacagaggcacatcacaacaaggcatgcaaaataatccaatgttgtctttagaaactgagggatccaatgtaggccagattaaagaggcatcatcccaatgggagcttgcaaaaatcatgggggtatcttgcgattcagaccaggccacaatcatcaacaaaattaaagctatgaaggccaaagacaggatatatcatccttttacttcacttgattttccgatgacaccaccgagaaggagctctggcatcacttcagaaagtggggcgacatgcggggttaaagacactcaccacctggcaaaacagcttgatggtatcatcattggggggttgaagatgtatgtgaacatctctaggtacaatagggaggggccaaggcagagggatccaggaaacaagccacgtgatcgagaagacagtaaccaagttgtagttgaccgggccacggacgccttacaacagccactcccaaggacatcaaagttccatgtcctcaattcacctaaacatagaccccaacgacaccaactggctgaaggatgtgtggatagggcggctaacaaatcctgccatggagctaaacaactcacgaatggcggacaacatggaggggcatcactattctatacaatggagaaatggagcccaaccttacgcacaggtttcaagttgacatgggtccaagtttggggcataccacttcaggctagggacctgaagtacattaggcgcatactggtaacaatgggggacatggtggatgtggatgatgacacagaggcgaaacggaggcttggcagggctagggtgctcataaagacaccatggagaccgataatcaaccacacagttgatgttcacataagcggcgaaagctttaaggtgtttgttgtcgaggaaagtggaggaggcagccacgattgtcgacgaagacgctgtagcctgagtgggtcgtcggaagagattgtttccaacgatagctctctcgggcatcttactcggagatcaagcaactcccggaaccacagagatgataggtggaccattccgacgaagttaggtggcaccaacgaccaggataggggtggaacatcggtgcctgactcgaggaatgacgatgtcgacgatgtccatcaaacaatcctattacccagcagttcccactcaacggctacataccccgctaacatgcgaaccgcacagggaatggtgaagtgtgtcggggacataaacactgcaggagggggatatatgtttcacgttaaaggaaagaaagatggtgacgtggcatctacaagcaacgtggcagaagctaatgaatctggggcaggcaatttcaaaattaaagaggcccaggtggaagtgtgtgaaaaaacattgcatgtggagtgggagccttcatccactaaggcgacactcatgaggttcgataaatcccaaacccagcatctccaaagaatggcacaaggggggactgctgccatgagccataattactccacaacacaggaagcaaattattccacaacacaggaagcagctctcaacgaagacatacaggaaactgatgaattactgcactttcaagaggcttccgacatctag

SEQ ID NO: 60184 - DNA, 369 bp, Glycine max
  Peptide Sequence Number=SeqID_151869
atgcttcaccctacagcagccattaacgaaggaggagaagcttaccttgacggcagaagtggcggagacgtctcaacagaagcagctaatgcgcggaaaagaaaccaacaagtaaaggggatgtcctccaatgctcacactcaagaagagaacaagccaacaggtcgaaggcgcagagaagaaaaggaagcagcgcaaggaggaaacatcttccacaacctggttggtcggttaagtgacaagcaaacctctaggagtttgttggcaatgctgcatgagcaatttgccaaagaaagaacccaagtttctctagaacatcagctttccaaattcccttccaaaggcgggatcccgacgcagggtgtttaa

SEQ ID NO: 60185 - DNA, 162 bp, Glycine max
  Peptide Sequence Number=SeqID_151870
atgcaagatgggacatatgtggaaccagagatgcctaagatcccgttggcgctagcatctgtggaggaagcacctgcacaaggaccttctaatgtggagcatcctagacatgtagtggacattacaaagtcagtggaacctaaatgttcactcttcacttaa

SEQ ID NO: 60186 - DNA, 138 bp, Glycine max
  Peptide Sequence Number=SeqID_151871
atgtcgcggaacttcacagattgcttaacgatgggtgtcaagttcctcgaagcggtcaagcgaagattgcatgccatcaaacaatggtccccggacgacattagggccatcctttgcccatcatggggatttaattga

SEQ ID NO: 60187 - DNA, 390 bp, Glycine max
  Peptide Sequence Number=SeqID_151872
atggataaggagatgaaagcacttgaaaggaatgaaacatggaagatagttaagaggccaatggacaagaagcctacttattgcaagtggatctatactgtcaagcataaatcagatggcactctaattgatacaaggcaagactatgaaaagatgaagaataaaaaggttattgtggctggtgtctcactaagagaggcttgtgcgattagcgagaatcatctgctaagcgaggcactcatcccgcttagcgagttggagaatctggaggagaatatgccaaccatatgcgcgctcagcatgtcatcagctcgctcaacgattcatttatcttctctcgcgctaagtgtgcccagctcgctcagcggaaattcactaactcgcgcttag

SEQ ID NO: 60188 - DNA, 216 bp, Glycine max
  Peptide Sequence Number=SeqID_151873
atggaatcccaacaagattcaacgcccttacactttagacaatcaccatccctgatgaatttaccaccaagaacagagcacaactatcaaatgaaaagaatagcaaaacaagaacaacatacctttgtctatgacagtgacaaggatgacaatgggggcaatgatgaggacgatgatgacaacaagcaatgccgacaacaatccagtgattgttga

SEQ ID NO: 60189 - DNA, 201 bp, Glycine max
  Peptide Sequence Number=SeqID_151874
atgtccttggctctcactcccatgaatcagatagtgccatacgtcccaccacaaccgtctgatcctctgatggagaagatcagtcgccttgaacgggcagttaataagttgagtagggacaagtatgatgttgcagatcttgagaatctctccttataccccaaagtcaggcttccgtacgatgatgatgtccactcctag

SEQ ID NO: 60190 - DNA, 522 bp, Glycine max
  Peptide Sequence Number=SeqID_151875
atggattgcaacgaagaagactgtgaagaaggtgtctacagcgacgtacaggcagcgcctggatcgtctgaggatcccagatgtctgctagatgccatatgcggagcactgacctgtgcaggactttcatccgatttcgtgcttctcgggacagctccgctgggggcctgttgttaccatttggcggcagcaggtgatctatgtgttgtgccaggtcagtgtgcgcctaactacatagactggttctttgtcatatcacatccattcatgactgtgctacagacggatcctcctcgagatgcatatgtgacgcagcccagtcatatccctcatgaggcagcaccgacatcgacacatgcggatcctgacgcagacgagcccagacatgcagtggctttccatgcgatcgcggaggcgttggagcagcatctaaatgcgttaggcacatccacacatgaagaggtcatccaaaatgcctcaggattgtcaagggtttcacagaagaccgcaatgtgtatgtga

SEQ ID NO: 60191 - DNA, 2298 bp, Glycine max
  Peptide Sequence Number=SeqID_151876
atggcttctcatattgttggatacccccgcatgggccccaagagagagctgaagtttgcattggagtcattctgggatggaaagagcagtgccgatgatttgaagaaggtggcttctgatctcagggcgtccatttggaagcagatgattgatgctgggatcaagtacatccccagcaacactttctcatactacgatcaggtgcttgatactaccgccatgcttggcgccgttccacccagatatggatggaacggcgaagagataggatttgatacctttttctccatggccagaggtaatgcatctgtgcctgccatggagatgaccaagtggtttgacaccaactaccactttattgtccccgagttgggacctgatgtgaatttcagttatgcttcccacaaggcagtgaatgagtacaaggaagccaaggcgcttggagtagatacagttccagtcctcattggccctgtatcatacttggtgctctccaaacctgccaagggtgttgataagtcgttttgtcttctttctctcctcccaaaagtccttgctatctataaggaagttgtggctgatcttaagcaagctggtgcttcgtggattcaatttgacgaacctatccttgtcttggaccttggctctcaaacgttgcaagcacttactgcagcatacgcagaacttgaatctactctatcgggtttaaatgttcttattgagacctactttgctgacattcctgcggaggcataccagaccctcacagctcttaatggagttgcagcatttggatttgatttagtccgtggaactaagactcttgatctaatcaagggtggatttcccagtggaaaatacttgtttgctggcgtggtggatggaaggaacatctgggctaataatctcactgcttctcttgatacattaaatagtcttgagggaattgtgggaaaagataaacttgttgtgtccacctcctgctcacttcttcacactgctgttgatcttgttaatgaaaccaagttggataatgagataaaatcatggctggcttttgctgcccaaaaaattgttgaagtaaatgcattggccaaggcattgtctggtcaaaaggatgaggcctttttctcttctaatgctgatgctcaggcatcaagaaagttttctccaagagtgactaatgaagctgttcagaaggctgctgctgcattgaagggttccgatcatcgccgtgccacaaatgtcagcactcgattggatgctcaacaaaagaagctcaaccttccaatcctcccaaccaccacaattggatccttccctcagactgttgaactgaggagggtgcgtcgtgaatacaaggctaacaaaatctcagaggaggagtatgttagttcaattaaagaagaaatccgcaaagttgttgaactccaagagaatcttgatattgatgtcctggtacacggggagcctgagaggaatgatatggtggagtactttggtgagcagttgtcaggctttgccttcaccgttaacgggtgggtgcaatcttatggatctcgttgtgtgaagccgccaatcatctacggtgatgtgagccgccctaagccaatgactgtcttctggtcatccactgctcagagcatgaccaaacgcccaatgaagggaatgcttactggccctgtcaccattctcaactggtcctttgttcgaaatgaccagcctaggtctgagaccacctatcagattgctttggctatcaaggatgaagtagaagatcttgaaaaggctggtattactgttatccaaattgatgaggctgctttgagggaggggttaccattgagaaaatcagagcaagctaactacttggactgggctgtgcatgccttcaggatcaccaatgttggtgtgcaggatacaactcagatccacacccacatgtgctactctaacttcaatgacatcatccactcaatcattgatatggatgctgatgtgatcaccattgaaaactctcgctctgacgaaaagctcctgtcagtgttccgtgaaggagttaagtatggagccggaattggccccggagtctatgacattcactccccgagaataccaccaactgatgaaattgctgataggatcaataagatgcttgcagtgcttgagaaaaacattttgtgggtcaaccctgattgtgggctcaagactcgcaagtaccctgaggtgaatccagccctcacaaacatggttgctgccacaaaactcatccgtagcaagctttccagtggcaagtga

SEQ ID NO: 60192 - DNA, 546 bp, Glycine max
  Peptide Sequence Number=SeqID_151877
atgacatttcctaatctgaagaatttgaaacttttgctaagactggaattgaggaattgcttaataactggtcccattccaaactacattggagaaatagaaagtttgaaaagcatagatctgagctccaacatgttaacaggttcaatcccagattcatttcaggatttaggaaatctaaattacttgtttctgactaacaattctctaagtggaccaattcctgattggatactgagcataaaaaggcatattgatttatctttgaacaatttcacaaagacttctgcaaataattgccaaatgccggatgtgaacttagcttcaagcctctctcgcacagcaaacacttcgtatgttccttcttgtggactagttctaaatcaatacagatggaatgaatcattcaagtctgaaattatatgctgtgcatcttctattggttcatctgtcaattcaaaatttcttgcagatttttcatcttctgttgggaagaaatcattgcaacattttaattcagaagagtctgatcccgaagaaatttga

SEQ ID NO: 60193 - DNA, 1701 bp, Glycine max
  Peptide Sequence Number=SeqID_151878
atggatgccaaggtgaagcaaatgattaagcttattgaagaagatgcagattcctttgccaggagagcagaaatggcatatcgggcattggctaagagatatgatcatgcaactggagtgatccgccacgcccataagaccatggctgaagcatttcctaatcaaggtgcatttcttgatctagatgaaccacaaaaggatgcttctgctcatttccatgctatcaaaagaaatggtggttatactggtgaacccgattctcctttgaacaaaaccggtttgaaacagctcaatgatctctacatccctagagaacaagaaaatcttccaaagtttgctagaagggggttcaatttttttgagacgcgagaggagagtaatgagcaaaacagtggaagcaacaacactttgtctgagtctgaacgcgtgacaaaagatgagacagaaattttggccttgaagaaagccattgccaaattagaagatgaaaaggaagctggcttgcttcagtatcagcagagtttggagaaaatgtctaatctcgagttagaagtgtctactgcaccagagaattctcgaaaactcgatgagcgagcaagtaaagctgaagctgaagttcaagccttgaaggaagcccaaatcaaattacaggctgaaagtgaagctagtcttcttcagtaccaggaatgcttggagaaaatatctaatctggagaaaaatatttcttctttgcaaaaggaagcaggagaacttaatgaacgagctactaaagctgaaactgagtctgagtccctaaagcaggaacttgctagagtagaagctgaaaagaaagctacccttgttcaatataaccagtgcttggagacaatatcaaaactggaggagagaataaaagaagctgaggagaatgcaagaaggattaaggagcatgccgatatagcagaaaaagaaatcgaagctttggaattacaagttactaaacttaatgaagaaaaggaagatgctgctctccactatcagcaatgcatggagataatttccagtttggagtataatctctcttgtgctgaagaggaggtgcataggctaaattccaagatagttgatggggttgaaaagttagagttcagaacagaaatgtcttctcttggagacatcaaatcacactctgcagagagactgcgattcattgaggctgaaactgctttccaaactcttcagcagttgcattctcagtctcaggaagagcttagatctcttgcttctgaacttaacagtaaagtggaaatactggggaatgtggaatctcgtaagccggatttagaggatgaagtacacagggcatatgatgatgatgactatgaaggaagtttttgtgacaaccctttgctggagaagacttcaaatgaatcaaatttagcaagcatagatagccatagaaagtgctttccttttcagtttggtcgtgttggaaatcggcaaaagattgtgattttggttactttgctagttttcatcatcgtggttgcttttgctgtagtaatctggattgggctaggaaagaatcccattgattctgaagtgacagctcagggcttcaatgtaaaatcgttgaggtcaatgtcaaagaaagtgagggttcaaacgaaggagcaagcagaaagcgagggttcaaacgaaggagcaagcacaaaggtatag

SEQ ID NO: 60194 - DNA, 672 bp, Glycine max
  Peptide Sequence Number=SeqID_151879
atggttaagactagaggattaggccatgtgttaggtaggattgttgctagaggtctggggagaggggatggtgatgattttgacgagccagaggctgatatagctggggatgagcctatggtagatgctgacgcacaggacaccggtccaaagaatggcgcacaggatattggtgcacatgatgttgcagatgaacctgagggatttcctggtggacccagggacctatcagtgcttacggagtatgttgaccatgttgcggccagcgtatggtctggacaagaacgtcctgagttgaagttatcctcccatgggagaaaggtgcataacttgggcaggcatgttcttgcaattgaggacatggttgttgggacaggattaagtcctttgatcgcgtgttcgatagacatcaacaatcggggacttatatcctcctttgtcgagaggtggcactgggagacttctattttccatcttcctgtgggggaggttttgatcatgctggatgacatcgcgtctcttctccatttgcatatcgttggcgcaatccatgacttccagcctctacgcactgacgaggtggtggggctgttggttgagttattgatggtctcagtagaggtgatcatggccgagacaggcaaatgtggtggaccatacatatgcctgtag

SEQ ID NO: 60195 - DNA, 291 bp, Glycine max
  Peptide Sequence Number=SeqID_151880
atgagtctgacacaacctagggattctccaagacatccaccagtggtgcataatgatacatttattgaactagatcctcctcaacagcctgtcgccgcaatggctatgccagaaccacatgcacctacacctgttgatatagacatgcctcgttatgcagtggagggttgccaacgaatagcagaaaggttggaacacttgatcaacatgaggatgattactactggaactgaagcatacaccgtggccaaggaatgcctgagaatcgccaggggtgtcactgagcaatga

SEQ ID NO: 60196 - DNA, 174 bp, Glycine max
  Peptide Sequence Number=SeqID_151881
atgacgaaggaagtgatccacagtcacaactctatagtgcctcgactccacttttcctcctcttcttctcctatgtttttctctggttttaggttgctggggaaacttgccgaagcgagctgcttgcttagggttgaaggtatcagcttgcccaggcaagtgtggcttgcttag

SEQ ID NO: 60197 - DNA, 135 bp, Glycine max
  Peptide Sequence Number=SeqID_151882
atgtcttcttgtaatcgattacactgcctggcaagacttgatcttgagttaatcttgaagcaaggctttgttttgttgaagcaaccttatgttaatcttgaagcaatgcttaacctttggagcaaccttgtttga

SEQ ID NO: 60198 - DNA, 417 bp, Glycine max
  Peptide Sequence Number=SeqID_151883
atgaatgttttgagtggtgcaaccctcttttgtgaaatcactcgtgcacccaactacttcatgatttgtgtacatagggactcattaggtagtgatcaaggggttctcatgaactctaagagaataaaggtcattcctgagtggcccactccaccaacaccactcattgagttggtgaggaaccatgttccttcatgggaagatgcccaggaaatgggttttcagaccttaccttacttcaatttcccaaacacgactaatatgtatcctagagtttcaagaacctcaggatttgaggtcaaatccttttcaagggagggaatgatgcaatcctaccccgcaagggcattggatagaagactccaagtagattgggctaaagaagaaatccaagggaaggccctagggttctcatga

SEQ ID NO: 60199 - DNA, 228 bp, Glycine max
  Peptide Sequence Number=SeqID_151884
atgtcaggattcacaagcgattctcctcaaatttcagccagcccgcatcaattagaccttgcaccttatgctttagggtcctacaatgctcaatggaatgccccgaaactcctccgtggtaagcacatgttgcgttcgagtcatatccttggaaaaatggaggttgaggaaccttggctggggttatggctaccattgaattatcaagcagatatgggaccaagttag

SEQ ID NO: 60200 - DNA, 147 bp, Glycine max
  Peptide Sequence Number=SeqID_151885
atggaggtgctcatgattcaaatagaagaggatgaagaggtaactatgactagatttcttaatggtgtaaatagtgatatccgtgatgttgttgagctgcaggaatttgttgcaatggaggatttgcttcacaaagctattcgagta

SEQ ID NO: 60201 - DNA, 564 bp, Glycine max
  Peptide Sequence Number=SeqID_151886
atgacggatcttgtgagcgcggaagatggcataaatctccgcgtgtcaagtagcttgtcgccgcgattgacgaaggtcacagaagacgacgttagtctctgcgtgctatcaggcttttcgtcttacagacagcaaaaactttttacggatacccaatcgggtatttccgcccgtcagcgtgtctcaaaatttagtatgacatatcttgtcagcgcggaagatggcatatatctccgcgtgtcaagtagcttgtcgccgcgattgacgaaggtcacagaagacgacgttagtctctacgtgctatcaggcttttcatcttacagacagcaaaaagtttatacgataaccactcgggtatttccgcctgtcagcgtgactcaaatgtcagtacgacagatcttacagcaaaaagtttatacggataacaactcgggtatttccgcccgtcagcgtgactctaaagtcagtatgacagatcttgtgagcgcggatgatgacgtaaatctccgcgtgtcaacgggtttgtcggccgcgattgacgaagggcgcagaagacgacgttag

SEQ ID NO: 60202 - DNA, 261 bp, Glycine max
  Peptide Sequence Number=SeqID_151887
atgtacgtgtcgcaaccctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacacacggggaaggtcgacaagggtgtttccctttgctcctacgtattcctcaatttgggatgagaaaatcagacctacgtag

SEQ ID NO: 60203 - DNA, 426 bp, Glycine max
  Peptide Sequence Number=SeqID_151888
gtgcatattgcaaagaagaatgaaggctatgccaagcaagccaacaagaaaaggaaggaagtggtacttgaacccggtgatgatcctggagatctgagggcaaatgttttccaagaaggagggaatgatgagaatcctaaaattgtccaaatacagggacctatgaccaggagtaggaccaaacattcagtggataccctccaacaaatggtagcagacatacttagcaaggcccaagtggacaaggacaaaagcccaaatggagaaggacgaaggccgaagtggaaaaggacgaagccccaagtggagaaggacgaaggcccaagtggagaaggacgaaagacccaagtaaagaaggatgaaggcccaaaagcaaaggcactactaagcatatcaatcgttgctgaaggcccaagattaatctga

SEQ ID NO: 60204 - DNA, 537 bp, Glycine max
  Peptide Sequence Number=SeqID_151889
ggggaaagataaaactgaagaccccggaagaagcaacagagctaattcagaacatgtcaaccagtgatcatgccattctacgagacagcacccaccaacccacgaagaaaagcttgatagagctatcatcacatgacgcgttattggcacataacaagttgctttctaagcaactggagattttaacagaaacacttggttgtaccatctatggtgaggctcatgaaacaggccaatgtactcccactgaagaaaacactcaagaaattcattatatgagaaatcaacagcgacaagggccaatccaacaaggacctaacatattccagagaactactaagttggaggagaccttgactcagtttatgcaggtaacaatgtcaaatcataaaagcactgagtcaacactgaagaaccttgaggtccaggtgggacaactggccaagtttgtggaggttaaggatgaggatagtgttgtgcatgagaagaaaactactgacaagaaaagtactgatggcaagaaaaatgaagtgagag

SEQ ID NO: 60205 - DNA, 258 bp, Glycine max
  Peptide Sequence Number=SeqID_151890
atggtgttcttcgggcatctcattcataattacatttccgtgcatagcctaaaaaaaggacacgctttacgacgcccttaccgaactcgtgctagagctagagtaatgggtgaagtggaggagatacaagagaagatgaaggccgacatggaggccattaaagagaaaatggccacaatgatggaggccatgatgagcgtgaagaagataatggaagccaatgcggttgcaattgcccgctaccagcgttgttgctaa

SEQ ID NO: 60206 - DNA, 436 bp, Glycine max
  Peptide Sequence Number=SeqID_151891
tgtagattacaaaaacaaaggtgaaacgaaagatattgagctggtagagttggaacaggcacagattggtgctgatccttctagtgagacctccaataaatctgagaattataaggaggaagcacagaatgcaacacagaagcataaaccaaagaaggtagagagtgtcaacgctgatgcaaaagcctttggtgttgaaccactagaacatacgaagaaaagagatacaggccatcaaagtgtgtcattagagaataagacaggagattcaactgtgctgaagataggaaattcggctaaagttgtgataaaacaagacatgaagggaagaaggcataaatatgggtttaacaacaacaaacgtgagaaggtagagaagaaaagggtggtggatgatgaaactggcgacaaaaatcagctggatgaagtcttatga

SEQ ID NO: 60207 - DNA, 207 bp, Glycine max
  Peptide Sequence Number=SeqID_151892
atggctggtacattcttccttttgaaacagcaaaataatttagagaattatgagcgggacgccacacaatatatgtctatgtttctcttaaccagtgctttaaagggattcaatgataaacacagcaataaatccaaggcaaatggtaaacgaatttccgttaaaaattttattgatccaagaacattggaaccacagagaataaag

SEQ ID NO: 60208 - DNA, 342 bp, Glycine max
  Peptide Sequence Number=SeqID_151893
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagctcacttagcgagtacatcgaaatttcttgaacaaatgggacttcacagtccctcttttccagccactttcaggccttag

SEQ ID NO: 60209 - DNA, 354 bp, Glycine max
  Peptide Sequence Number=SeqID_151894
atgtgggcatgggaacgatgtccaaccttggctccaaagaggactccttcccaagtagaaaatacaccattggggcacaggtggctgcgacgtggaaaccaacatatcggcaatgatgatgtgagaatttttcgtcgcaagttggatattatgaaacgtcatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 60210 - DNA, 530 bp, Glycine max
  Peptide Sequence Number=SeqID_151895
atggagacgagcccgctgccaccttctctctctaatgcggccataatggtggcacgggtgatgctcaagcacggatatgagctcggaatgggtctaggcaaggacggcctcgggaatgccgacgtagtcgatatgaggggaaatccgtacaaatatggattggggtatgaacccgggatgctgggaaggaggaatgcgccgtcaagattctgggcggatagggcatggcccggccatgttagccagtgtttcaccagtgctggaataatgtttgaggaagaggtggcaacaatcggagaggagtgccctcaagacccgccaagtttcgtgcggccatgccatcccgattcccaagtggggaactggcgcgtgataagccagtcaaaggtctataccgctgattcaatatacgagggtcgattctttgaggatcctaacgacaagggtttgacaatcgatttcaaccgagatgtaagccaaacgatgaacgaagaagaggaagaggacgtcctttcaccagagttggagag

SEQ ID NO: 60211 - DNA, 773 bp, Glycine max
  misc_feature (49)..(49): n is a, c, g, or t
  Peptide Sequence Number=SeqID_151896
cggatgccgggagcagacaagcccgtcagggcgcgtcagcgggtgttgncgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaaaattacctcagcaacaaggtccaatttggacattttgcttgtttgttcatcaggccaataatgcatacatatttcctggatttggtcttggtttaataatgtctgggaccattcgagtgcatgatgacctgcttctagctgcctctgaggctttggttgcacaagtgagccaagagaactttgataagggactcatatacccaccattcaccaacataagaaagatttcagcacacatagctgccaatgttgctgctaaggcttatgagcttgctattggaggttctaggtaccgagctcgaattcgtaatcatggtcatagctgtttcctgtgtgaaattgttatccgctcacaattccacacaacatacgaagccggaagcataaagtgtaaagcctggggtgcctaa

SEQ ID NO: 60212 - DNA, 358 bp, Glycine max
  Peptide Sequence Number=SeqID_151897
aatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcagtaaatgtaatcttattctatgcaaaagacatagttcgtttccctttccaacagaatgccaccatactttacttattgcacactgtgtacagaggcagagagaatctcccattacttactgtgcactatctcttctatctttactaacattgtttttctccatgttcttcctctga

SEQ ID NO: 60213 - DNA, 583 bp, Glycine max
  Peptide Sequence Number=SeqID_151898
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccccttgctatgggggaagctgaggatgcgtcaaagtattccaagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60214 - DNA, 89 bp, Glycine max
  Peptide Sequence Number=SeqID_151899
ggtttgggcgagaagacccaccacttcacattactttatggtgagatggttattgataaattgccagattcacagaagcaggatgccaa

SEQ ID NO: 60215 - DNA, 219 bp, Glycine max
  Peptide Sequence Number=SeqID_151900
atgacagaacttgtgaaagtggccaacaaaagcgaggctcttgctcctacgtatcctccaatgaggaactcagacctacgtgcggataaccgtatggtgtctccgcgggctaccagattcttgggtcatggtaacaaaagcggtgtggtcgacaaaagcgaagctcttgctcctacgtatcctcaaatgaggaactcagacctacgtagttctggataa

SEQ ID NO: 60216 - DNA, 483 bp, Glycine max
  Peptide Sequence Number=SeqID_151901
atgaatttattgcctagcgctgttcatgcatcctccaccaacgagtctggagccctgcgaagttattgcgtagcgctgttcgccaatactccattctccactttttttcggagccccatgaatttattgcccatcgctgttcatgcatcgtccaccaacgagtgtggagccccacgaagttattgcgtagtgctgttcgccaattttccattctccacttttattcggagacccatgaattcattgcctagcgctgtgcatgtgtcctccaccaacgagtctggagcctggcgaagttattgcgtaacgctgttcgccaattctccattcaccaatcttattcggagacccatgaattcattgcctagtgcttttcatgtgtccttcgttatcaagcgcggagcctttggtgactgggaaatatgtttttctgttattttccggatcggttccttcgccaaacataaaaaaaagaaggagtag

SEQ ID NO: 60217 - DNA, 357 bp, Glycine max
  Peptide Sequence Number=SeqID_151902
atggagaaactaatgtttgacatggttaatgagtcatcttcgacaatgaatgctttggacaggcaaagtagtgttgaagtcatggaacaagaaggtggattatgtgatgggatagaagttgatcagtttcatcaaccgtctggtagtaatgaggttgccattgctaatgaggatggtatttcatatggatcagagctcatagaggttgacaaaatggtgctctctgggatatttttcggagacaggatgtcccttaagttgcaggaatatctgaagaagcatttcagagagtttaggcatgtccattgctgtcctttaaagcaggattgggtgaaggatcaagctgctaataaatag

SEQ ID NO: 60218 - DNA, 174 bp, Glycine max
  Peptide Sequence Number=SeqID_151903
atgcgtcccataacggctacgcatagtcaaaatgtctttctcaagggatttcctctttgtgccctatcaccctgtgtaatcgattacacccagccggtaatcgattaccagtgccctatcaccctgtgtaatcgattacacacccttggtaatcgattaccagaggccatttaa

SEQ ID NO: 60219 - DNA, 342 bp, Glycine max
  Peptide Sequence Number=SeqID_151904
atgaagaaaatgatagaaagaagaaaggaatctctcttaaagcttcgatcttctaaccaagaagaaagtgataaggaaaactcaattgaaatagacgaagatgatgatctgagtctatttgtaaagagattcaacaaattcttgagaaagtctgaaaagaaaaattttagtgaaaagaaggcgaagaaggcctacatcacacgggatgacaatgatctggaatcatctgagaattcagaaaatgaagtgataaacctgagtctaatggctaaaagttatgaaagcgatgaagagatgcatttgctgatttgcatagagaatcaatcaaacttgcaaaattag

SEQ ID NO: 60220 - DNA, 189 bp, Glycine max
  Peptide Sequence Number=SeqID_151905
atggcagtaggtcagcatacggcattgactgtgtgggaaacaaattttgtgggggaggcctttgtggttgagtgggccatatttgttggatgggtgccgaaatgggagggtttccgatgttggctgaataattcggttgatgcggggaatattggtatgtggggttgtgaggggtttgttgggatttag

SEQ ID NO: 60221 - DNA, 276 bp, Glycine max
  Peptide Sequence Number=SeqID_151906
atgactcatcaggattttcaagtgcaagccattggtcagtttgctcaagcgacctgtgctcctgagtttggacttccaagaccgttcaatcagagattactcgtcttgcacgttggtggggttgccgtaaaacaacgagaatcctctacaacaagagacccacggtctcttaaatcctttttcagaaataagaagaagatgaaatctctcttaaaagaggtagattgtaaaatgaagatcaatcaaaaattccttattgaatatgcaagtggttga

SEQ ID NO: 60222 - DNA, 450 bp, Glycine max
  Peptide Sequence Number=SeqID_151907
atggccgcaatgatggaggccatgaaagagcaaatggccgcaatgatggaggccatgatgagcgtgaagaagataatggaagccaatgcggttgcaagcgctgctaccagcgttgttgctaaggtgaacccgacgtccccatccgacatcaaccaaatgaatcatctaacctcagatatggtaggcaaagatttgggaagtacgggtggcccccatgatgtgcaaattcaaaacgagcacgccttcccgccatatggtttgcctctcaactatacgccacccaatgtggcgtacacccccaataagaatgtcaataactccactcctatacccccttggctcggatatgccactgaagggcaagcagttggtggtatacccctacaaaaccctttgcagggccctcagtatcaccccccagctacacctcttgcattccacaacaagtaa

SEQ ID NO: 60223 - DNA, 840 bp, Glycine max
  Peptide Sequence Number=SeqID_151908
atggcggtgcgtctgtttcccgctgccgaccatcccaatgctgctgtggtgtttcgccctgcgcctgtctggggcgcagtacttcttgatgaaagctcgattagtagggggcctgatgcccttgctggaggtgacaggtactccgtagaactgacagagacccgactgatagaggcccgtaaccagagctggaaaccccagggccctgttgacttcttcaggttcactgggtgtctttgtggggggagattggcattgcggtcgttgggcagaatgttgctaagtagcaatgtcatctatatctgtgtaagagtggtcatgttggtgcgcatgatccgcactcgtctctttgtagcggcacaggtgaaatcttgccccgatatgcatagtagctgtgtgatagcctccctctctggttgtgctcgcacagttggccctcctccaatatcagggggtggccaggaaccgttaaaaggaaactactggaccttaaattctcttaaggtgcggatgtggagcacactgaaaatgaggacacgtagccctctaaaggtgagggcgtgcaaccctctcaaggcgaggatgtatagtcctctagaggtgagggcgtgtagtcctctcaaggtgagggcgtgcatccctctgttggcgaggacgtgtagtcctctaaaggtgacggcgtgtagccctctgttggcgaggacgtgtagtcctctaaaggtgagggcgtgtagccctacgaaggtgaggacatgcagtcctctgatggcgagggtgtgtagccctttgaaggcgagggcgagtagccctctcaaggcgaggacgtgtagtcctctggag

SEQ ID NO: 60224 - DNA, 261 bp, Glycine max
  Peptide Sequence Number=SeqID_151909
atgacaatgcatacaagattgattttgcccggagaatatggagtacatgctactttcaatgttggagatctctcaccgtatttagatgatgatggtattcaagaattgagggcaattcctttcaaagggggaggggatggtacgaaaattgaccaagaggagttgaaaatcaacacaagtgacattcaaagggaagttaatggcgtgggggctgtttggaatcctcatcaagggctgagtttaattacttggctattttaa

SEQ ID NO: 60225 - DNA, 836 bp, Glycine max
  Peptide Sequence Number=SeqID_151910
agaggaaagtagagatatatcacactgagctagatgagtttaaggctgaattggagaggcgtaatttccataaatacctcaccaatttagtcgatgggagcatagacctagctttggtgaaagagttctatgcaaatttatatagttctgaggaccgtccaccaaagcaatccaaagtcagaggtaatttggtgaagattgatgctaacagtctcaaaacattcctggagacacctgtggtattagcagagggggaaaccttacccgcatactccagatactgtaggttgcctacagactacagagagatagaggctgcctcatgcatacctagccgagggttcatcttgaactctgagggccatcctgggaagattctcaggaaggatcttactacactagctcaggtgtggagtgtcctctcatactccaacttggcccccacatcacacacttctaacttgacagtggatagagctaggctaatctttggcttagtctctcgcatggatatgagcataggagcgctgatctttggccagatgacctctatagcccagtctaacacttctagacttgggttccctgctctgatcaccacattatgtagagccagaggggttgtctctgatagcctcacttttgagtgcctgagcccgatcattaacttggcctacatcaggaagaactgttggaaccccaaggatctaatagtttctatccgaggggttaggagagcgagggctaggccaattgagctcccttccacttctgcggctcctactccagcatccacgccagcagctccttctattccagtccagacagattcctag

SEQ ID NO: 60226 - DNA, 249 bp, Glycine max
  Peptide Sequence Number=SeqID_151911
atgatcgaaaatgtaattcacggggctccgaaaaagcttgagaatggagaatgcactaaagcaatcactacgcatggctccaaactcgaagatggaagacacatgaacgaaaacgcaattcatggggctccgaaaaaagggttgagaatggagaattgcactaagcaatcacttacgcatggctccaaactcgaagatggaggacacatgaacgaaaacgcaattcacggggctccgaaaaaggtctga

SEQ ID NO: 60227 - DNA, 516 bp, Glycine max
  Peptide Sequence Number=SeqID_151912
atggaagaaggattttcccatggttcagttccaattattttaggcaggaaacatccatttttatctgatctgcatacttgtcattccttatgcattgaatctgaatctaagtttgaatttgattctgtgtctaatttttatgctgagaatgaatctgaatttgaatctggttctgattttctgggtgtcgtacctcttgatgttgattttttagagtcagaatgcactaaccatgttgcaggaagtacatctacttctgacttgctttatgaggtacaggctaaggaaccttcttcttctcctaccacggttcctcccactgttcagccatcacccacaccagagttgaagcccttaccagcaaccctcaaatatgcttacttggaggacaaggaaaaattttcagtgatcatctctgccttccttgatgttaagcaagaggagaagttgttgctagttctcaagaagcacaagaaagccattggatggactttagcagacattccctggtattag

SEQ ID NO: 60228 - DNA, 336 bp, Glycine max
  Peptide Sequence Number=SeqID_151913
atgatgacaaaggtgatgaacaaaaagctcaaaagatcaaagaacaactcaagtgaatcaaagaacaactcaagtgaatcaaagaacatctcaagtgaatcaagaacaagtcaagagttcaagaatcaagaagaattcaagactcaagaagaaagcctgcaatcaagaatcaagattcaagatctcaagaatcaagatcaagattcaagactcaagattcaagaatgcagaaaagactcaatcaagataacacatgagtctttgacaaaacctttaccaaagagtttttactctctggtaatcgattaccatattgttgtaatcgattaccagtag

SEQ ID NO: 60229 - DNA, 408 bp, Glycine max
  Peptide Sequence Number=SeqID_151914
atgactcatcattcatctagtgttcatggcgagcgtactagtcataaggaccctttatctagaatcttagatgatttgagttccctcaagttatggaaagaaaaactagaaagaaaagaaaaaggaaaagagatggtaaaaataaatcaagatgagagggaacaaataaaggaagaagaaagaaggaaaatagtaaaagagttaagaaaagaaaaacatgtctcctatagtagtcataactcttgcaagagcctaagtgaagaacttcgtgacaattatgaaggaaggcataggtcacatcttagacctcactcccataggagagaaaatgatagaaagcctcaagaagctaacattaacctcccatacttccatgggaagtacaatgtagaggcttacttagattag

SEQ ID NO: 60230 - DNA, 225 bp, Glycine max
  Peptide Sequence Number=SeqID_151915
ggaacaatgtggagggtggggtgtggggacaaaatccgtttatgggaggatcgctggactggcagtgggcaaccactaatgctgaaatatcccaggctatatcagatatccagcccctatttgacaacgaggtagcatcggctgttgggtttttagaagacatatctcacatcacattacagcaacacgaagcagatagttggacatggaaacatgagtccaatg

SEQ ID NO: 60231 - DNA, 246 bp, Glycine max
  Peptide Sequence Number=SeqID_151916
atgttcggaatgtttgtctacaaggctgctgttctggtgcaagcttatagagataatgaacgcttacggcttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60232 - DNA, 567 bp, Glycine max
  Peptide Sequence Number=SeqID_151917
atgtggatggaccggtttgctcttaccttgaacgggagtcaagaacttccccgcttgttagccaaggccaaggcgatggcagacacctactccacccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctcgggaagaacaaatggcctccatgatggaggccatgttaagtatgaagcagctcatagagaagaacgcggccaccgccgccgctgtcagttcggctgccgaagcagacccgactctcttggcaactacgcaccatcctccctcaaatatagtagggcggggaagggacacactggggcacgatggcagccctcacctaggatacaaccgagcggcttacccttatggattgccgcccaactattcaccacccgtcttgcaagaagatgcgggccacattgcttctcccggccatgaaagagagcctcctcagcagctcgacgaa

SEQ ID NO: 60233 - DNA, 300 bp, Glycine max
  Peptide Sequence Number=SeqID_151918
atgtcatgcaggcacgcgctcagtgcgtcatcagctcgctcagcgagtcgtttgtcacctcccagggttagcgcgagtttggcgctgagcgaaagttcacttactcgcgctaagcgcgagaatggcgctaagtgtgacatcgagcaaaagagaaaagggggggtggagagagcattgaatagccgtcagagcttgaagagcaaagaacaaaggggctttagcattgaaagatgtattgtctccttagaacttgatagagtaggattaggttaccgtatgtctggatacggagtgcaatga

SEQ ID NO: 60234 - DNA, 474 bp, Glycine max
  Peptide Sequence Number=SeqID_151919
atgaggggagcaccagcggaagagagcctctctcctttccttgtgagagatttcggcgcgcaaagtttcaagattatacgaagagtccataaggcgtgggaaatcccgttaaggaaagataaagaacttaggggcattcgtaatggcatcatcggtggttatcatgaatggctgaaagttcgtacacgaggcagtgagctcaagcttcgaagggaagagagagaccaaccacgagcacatagcatggtcttaaaagaggagttagctgcttgctcaaggtccacaggaaacttatctcagcgtttatgcgagacaaagaccaacatgttagccatcgtcagcaagtaccaagaaaaactgaatctagccacaacccacgagcataaagtggcggacgagtatgcccaagtgtacgtggaaaatgaggctagaggaagggtgatcgactcgttacatcaagaggcaacaatgtga

SEQ ID NO: 60235 - DNA, 833 bp, Glycine max
  Peptide Sequence Number=SeqID_151920
gccgactgcatcggcacacaggcgacgggtaactgtcattgttgacgatgttgtgcctgcggtacctgcagactcgtctgcggtaccagagacagaggctgttgtagctagggatgaacccatggtagatgctgacgcacaggacaccggtccagatactgacgcacaagatattggtacacaggatgctgcagatgagcctgagggatttcttggtggacccaaggacccatcagtgcttacggagtatgctgaccatgttgcggccaacgtatggtctggacaggaatgtcctgagttgatgttatgctcccatgggaggaaggaacataacttaggcaggcttgttcctgcaattgatgacatggagacttctagtttccatcttcctgtgggggaggtttcgatcacgctggacgaagatgcatctcttctccatttgcctatcgttggcacattccatgacttccagcctctacgcaccgacgaggtggtggtgctgttggttgagttactgatggtcttagcagaggtggccatgactgagacaggccaatatggtggaccatatgtacgcctgcagtgtctgcgagacgtataccagtgcagatgtcagacgcagcactggatagctgccgctcgtgcttatcttctacatcttttgggttgcactctttttgctaataagagtgcaacccatgttcatgtctcacacttacaggccctgtgttaccttactcttgctgggcggtatgcatggggagctgctgacctcgtccatatgtacgatcagcttaatgatgccagtctctacaccagccgacagcttgctg

SEQ ID NO: 60236 - DNA, 318 bp, Glycine max
  Peptide Sequence Number=SeqID_151921
atgagccgtcgttgctcgccatcaaaccctcacaccaagaggaacatcttaatcaaagcggaatcatcagaatcctcctcaaggattcggtggagaaaattccccaatcccccatttcaaagcttctctgagggggtcactttaaagcatgagccgccattgccaatagcgatacaggatactggctggagggtgtcgccagtggcactagcgatactggctgatgtggagggagccgcttgctccatttgcgagacagccacacatagggtctcacctctcccattggcgagacaccttcagaaaatacaaggataa

SEQ ID NO: 60237 - DNA, 387 bp, Glycine max
  Peptide Sequence Number=SeqID_151922
atgatgcaatcctaccccgcaaaggcattggatagaagactccaagaagattgggccagagatgcaagagaagaccctagggttctcattagccttagggtagatttcgggcccatcgggaaagtatgtgcccgcttatctttgtacatattagattatgggtacatccttggtggcacaagtagagggtacatctacttgggttgttatactaagaacaagagagggtacatctcttgtggatcagttcaagtggagggtacatccacttggttgttcaaagagaacaagggagggtacatcccttgtggatctttggctagtaaaggattttacaaggttaaaagaaatctcaagaaccgttggttgcttggggattcgatgtag

SEQ ID NO: 60238 - DNA, 170 bp, Glycine max
  Peptide Sequence Number=SeqID_151923
caccaaaccacaagacaatggaggagatacatgtagaagacgatgaagaacaaggaatgaaagccttggatcttctacatcaatggtgtcctttgcttcttgaagatcaatggaaacttaatgtagaaggagtaaaggtgattggagatgacacttcaaggagaagatga

SEQ ID NO: 60239 - DNA, 228 bp, Glycine max
  Peptide Sequence Number=SeqID_151924
atgggaaagcacatagtccatgatggacttcctagtcatggacaaagtactgctggctatggacacatcatgagtgaagtctctctaatgaagggcagcagatcaaaggacaactgttacctatcggctgacacctcagagaaaccagttactcctccacatgtctattctccagagaagatgaagtcagaatatggcatcaactgggagatttggacatctgcttaa

SEQ ID NO: 60240 - DNA, 243 bp, Glycine max
  Peptide Sequence Number=SeqID_151925
atgaagaatttccacagaatcgcttacggaaacgtctcggaagcattacgaaagcacctcggtttggattttcttcacgaaaacacattttttcacccaagacaactgaaatgcatagccaagggggaaaaagggaggtgtttgccgcccagaggcttcttgaggaagatttcaaagcgcaccccaattactaagttcaccccctttttcatactttacggaaaagtacggaagccttactga

SEQ ID NO: 60241 - DNA, 318 bp, Glycine max
  Peptide Sequence Number=SeqID_151926
atgtgccagaaatcaaaaggaagcgtggttacgcaatccgtgaaattccgtaatgtggcggaagccaaaaggaagtattgttacgcaatccgcccacttgggccttccagattcttcctccagaaagcggttgcttctggtggaagcaacctggatcacctgggcgagctgggtggcaagctcctcccctattttgctataaatagggggaggagtgaagaagaaaagggttcagccttcttggcacttcgtattcacttgaaattgctgaggaaaattgttgccttgaagaaaattcaagtcgaagcgcttccgtaa

SEQ ID NO: 60242 - DNA, 303 bp, Glycine max
  Peptide Sequence Number=SeqID_151927
atgttagccatcatcagcaagtaccaagaagaattaaatctagccacagcccacgagcacaaagtggcagacgaatatgctcgagtgaaagacgccataactaaacgcaccccaaggcatccctatcgcaccagatccaaatctaggacgatggatgaccaagaggaagtacaggaacagataaaagccgacatgtcggctttgaaagagctaatggcttccatgatggatgccatgctaggaatgaggcaactaatggagaataatgcggccaccgctgccgctgttagttcggcctgctga

SEQ ID NO: 60243 - DNA, 531 bp, Glycine max
  Peptide Sequence Number=SeqID_151928
atggtcattgaccagtcccttttccatgacttaaccaaattacccagtgacggtgtaccatttgaaggtacactgaatgacgactggaaatttgatttctctgcccatgatgcccgccagttggtttgcaccaataatgcggatatgaccggacgtctctcttgccgggtttctgaggaagatctaattatcatgtgggcctttcatatagggcgtcaacttgactgggcacacttagtcagatatcgcaagcataaggcattgcgattaaatgctccactaccatatccacagcttgttactctctttcttcgtcattttggaattcctcttgattccgaatcttatattccaatcaagagatcctttttaattggtgctgctgtgattgcttcttttggttaccgcaaagagagtgatggctcttgggtcaaaaagggcgttccacccgctgatgatgaaggccacctaccagttgaagataattccactcttcttcaaaggcttatggacaagtttgatggactttag

SEQ ID NO: 60244 - DNA, 421 bp, Glycine max
  Peptide Sequence Number=SeqID_151929
ggtcggaacaggagagcgcacgagggagcttccagggggaaacgcctgcctatggaaaaacgccagcaacgcggcctttttacggttcatggccttttgctggccttttgctcacatgttctttcatgcgttatcccctgattctgtggataaccgtattaccgcctttgagaagcggaagagcgcccaatacgcaaaccgcctcgccccgcgcgttggccgattcattaatgcagctggcacgacaggtttcccgactggcatgcaagcttggcactggccgtcggtttacaacgtcgtgactgggaaaaccctggcgttacccaacttaatcgccttgcagtacatccccctttcgccagctggcgtaatagcgaagaggaccgcaccgatcgcccttcccaacagttgcgcagcctga

SEQ ID NO: 60245 - DNA, 237 bp, Glycine max
  Peptide Sequence Number=SeqID_151930
acttatcaaggtaatccttgtggcgtctaccttgacttatcttccttcacgggaagtggcgtctacccagacttatcttccttcaccggaagtggcgtctaccctgacttatcttccttcattggaagtggcgtctacccagacttatcttccttcaccggaagtggcgtctaccctgacttatcttccttcacgggaagtggcgtcatccaaatctctggaacctgtatcaaatga

SEQ ID NO: 60246 - DNA, 760 bp, Glycine max
  Peptide Sequence Number=SeqID_151931
ccctctatgatgagtcaatctctaacttactcataagggtggacccttgggtactagtacccatcgccttaagagggctgcacgtcctcgccttaagagggttgcacgtcctcaccttcagaggactacacgtcctcgactttagagggctacacgtcctcgccttaaaagggttggacgttcttgccttaagaaggctgcacgtcctcgccttaagagggctgcacatcctcgccttcagaggactacacgtcctcgactttagagggctacacgtcatcaccttaagagggctgcacgccctcgcctttagaggattgcacgtcctcggcttcagaggactacacgtcctcgcctttagagggctacacgccctcactgtaagcgggctgcatatcctcgcctttagagggttgcatgtcctcaccgtaaaagggctacacacccccgccttcagaggactgcacgtcctcgccttcagaaggcttcacgtgctcgcctttagagggctagtcgcccttgtcgtcctcgacttcatagggctacacatcctcgcctttagagggctacacgtccttgccttaagagggctacacgtcctcgccttcagaggattgtacgtcctcacctttagagggctacacgtcttcgccttcagagaactcaagttcctgggccacccccttgatcttggaggagggccaactatgcgagcacagccagagaaggaggctatcgcccagctactatgcataccagg

SEQ ID NO: 60247 - DNA, 342 bp, Glycine max
  Peptide Sequence Number=SeqID_151932
atggagacacttcagaaggtccacaaggcatgggaggttgtgcaaaagaaggacaaagaactcaagggcagtaacaatgggcccatcggtggctaccgaaggtggttgaaagcccacgtgctaggtttggattggctcccaagtttgagaactgctaaaagggaggaagttgaggcaccggaggaagacgaagaggagaatgccgaactaagagatataaatatagctaccaccgaggccttggaacaagagaccaagagggctcgtagggaagagcacggccgaaacatgtttcgaggggctttgtggggcagcaacaacgagcttaagctccggagatag

SEQ ID NO: 60248 - DNA, 983 bp, Glycine max
  Peptide Sequence Number=SeqID_151933
gaccacacgtcctcaccttcgtagggctacacgtcctcgccatcaaaggactgcatgtcctcaccttcagagggctacacgccctcgccatcagaggactacatgtccccaccttcgtagggctacacgccctcgccatcagaggactgcatgtcctcaccttcagagggctacacgccctcgccatcagaggaccacacgtcctcaccttcgtagggctacacgccctctcctttagaggaccacacatcctcacctgcagagggctacacgccctcgccatcagaggactgcatgtcctcaccttcagagggctacacgccctcgccatcagaggactgcatgtcctcaccttcgtagggctacacgccctcacctttagaggaccacacgtcctcaccttcagagggctacacgccctcgccatcagaggaccacacgtcctcaccttggtagggctacacgccctcacctttagaggaccacacatcctcaacttcagagggctacacgccctcgccatcagaggaccacacgtcctcaccttcatagggctagacgccctcgccatcagaggactgcatgtcctcaccttcagagggctacacgccctcgccatcaaaggactgcacgtcctcaccttcgtacggctacacgccctcacctttagaggactacacgtcctcgcctttagagggttgcacgccctcacctttagaggactacacgtcctcgtcaacagagggctgcacgccctcaccttgagaggactgcacgtcctcgccaacagagggctgtacgcgctcaccttgagaggactacacgtcctcaccaacagagggctgcacaccctcacctccagaggactacacatcctcaccttgagagggctgcacgccctcacctttagagggctacgtgtcctcattttcagtgtgctccacatccgcaccttaagagaatttaaggtcctctgtccttaa

SEQ ID NO: 60249 - DNA, 360 bp, Glycine max
  Peptide Sequence Number=SeqID_151934
atggcctccatcattgcggcgatttgctctttcatggtctccatgtcggcctccatctactcttgtacctcctccgctttacccattactctagctctagcacagattttcaacatggtccatgacatctccgtcaaggtgaaactggaagtaacagggacattgacatccctcaatgtgtttggcagtagacgaaggagcggtgtaacacgatccatcttttgccccaatttttgcaagatggttacttccatgcttcaacttgactcgatgaaccttttcgtaaaagcgcgagcttggttcaaccccataacccagggaatggcaattgatcgccaatacttcatcaacaattcatag

SEQ ID NO: 60250 - DNA, 304 bp, Glycine max
  Peptide Sequence Number=SeqID_151935
atggttaggaccaaaggattaggtcgtgccttaggtcacgttactggcagaggtgtgggcagaggagatcgtgatgattccgatgatgctccacagtgtcaatggcctaccgcttccgcacagaggcagcgagtacctgtgactacggcgcacgatgagccagtgctccctgcgccagatgtagaagttgacgtatttctggatgtcctgatggcaccagctgatgtagaggacactggggcagacattcctgcagacacaggtgcgcaggctgctgaggatgagcatgagggatttctgggtg

SEQ ID NO: 60251 - DNA, 219 bp, Glycine max
  Peptide Sequence Number=SeqID_151936
atgcatggtgaattgccagacatgtcaactgccactcacactgaggcggttgatgtacaaactggagatcatatagaagacatgatacaggatcttggccaagagggtttttggcaagctcatgcaccttattatgaaaaactactaaaagattctaagaattcgttgtatttgggatgcacaaccttcactcggttatcgatggtgctattttggtga

SEQ ID NO: 60252 - DNA, 240 bp, Glycine max
  Peptide Sequence Number=SeqID_151937
atggagaattggcgaacagcgctaggcaatgacattcgcggggctccagactcgaagcgcttagccatcatgacattcgcagagctccgactcgaaggtgtaggacacatgaacagcgctagcaatgacattcatggggctccggaaaaaagtggagaatggagaattggcgaacagcgctcggcaatgaaattcgcggggctccaaactcgaagttggaggacacatgaacagcgctag

SEQ ID NO: 60253 - DNA, 112 bp, Glycine max
  Peptide Sequence Number=SeqID_151938
atgactacgccacgctctaccgccctggtaacaggtgcctcttccggaattggtgctgtctatgccgatcgccttgccgctcgcggccttaatctggtgctggtcgcccggc

SEQ ID NO: 60254 - DNA, 201 bp, Glycine max
  Peptide Sequence Number=SeqID_151939
atggagggaggcataggttccatacaagacctcgctcccaaagaagagaaaaggataaaaggtctcaagagattgggaaatgaaggtgaaacaactaatgtagctccatttaaagcttgtaggccttggatcttcttcatcaatggagtcctatgcttcttgaattttaatcacaggggaatggagaagaagaagagttga

SEQ ID NO: 60255 - DNA, 258 bp, Glycine max
  Peptide Sequence Number=SeqID_151940
atgctttatgtaatcgattacaatgatttgggtacatcctttgtggtacaagtagagggtacatctacttgggttgttgtgactgagaacaagagagggtacatctcttgtggatcagttctagtggagggtacatccactaggttgttcaaagagaacaagggagggtacatcccttgtggatctatgcttgtacaggattttacaaggttgaaaagaaatctcaaggaccgcaggtcacttggggactggatgtag

SEQ ID NO: 60256 - DNA, 303 bp, Glycine max
  Peptide Sequence Number=SeqID_151941
atggcctcatctaactatttatttcccaaagggagttctataaataggtctcccatttttaatggcgtggaggctatagatttgaatatctgggaagccatagagattgggccatacattcccactaaggtggtaggaaatacaaccatagaaaaacctagggaagaatggagtgaggaggaaaagagattagttcaatacaatttaaaagccaaaaatataattacatctgctttaggaatggatgagtactttagggtatcaaattgtaaaagtgcaaaagatatgtgggataccctatag

SEQ ID NO: 60257 - DNA, 690 bp, Glycine max
  Peptide Sequence Number=SeqID_151942
atggcaggagatacgggttcatgcggttcaagggagtctcggatgcaaaaggattggaggttcgacagatcagttcggaatacagagttgcagaaaaagaaccccattaggaggaagtacaccgacgaagcaagagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatctcaggagggctgtagctgctattggggatgtcatcgagtcagacgatgacacagaggaccgccgaagattggaccgggctcgagtattggtgcggacaccgcttccgccgttgataaggtcggagagacagggttcgaaggtgggtcgaaccggaaaggaagctcgccgtccgatgggtggtcggagatga

SEQ ID NO: 60258 - DNA, 525 bp, Glycine max
  Peptide Sequence Number=SeqID_151943
atgaagagatgcttatgcaatgaatgcatttacggacacgagagcccggaaaatcatctcttcttacttgcgcattcgggggcgcagtgccccatgtgtgcagttaaaaaggtgatatggaccttccggcttcccgtgacaaaagacgagaccaacatacaatgcatgcatgacgacatgatgcatacgcgcaaaagcacaaaacgaggatggactaccagcaacaatatgttatcaaagagacaaactctagatgagggttcattgttatcaagcaagtcagagacccagcatgaccacagattcacctccactccttatgttcctatcgacccgtatagggccccttttcaactcacctccccagtggagtcgccaactgtcgcaacctacccttcagcgggagggcgacacgagggctcacgggtgcgtcttccatgggaggaggatgcgcggagtcaccaccaacgtttattcgaggaaaacgtcgaaaacaccggaaaaggtgtggtctacgaactttga

SEQ ID NO: 60259 - DNA, 663 bp, Glycine max
  Peptide Sequence Number=SeqID_151944
atggagggaagtatgattgatgctgccaatggtggaatccatggtgatatgacccttgttgaagctaggaatttgattaagaagatggcttccaactcccaacaattcagtgcaagaaatgatgctattgttcttagaggagtccatgaggtggccacggattcatcttcatctactgaaaataaaaagcttaaaggaaaacttgatgccttggtcaacctagtaacccagcttgccatgaataaaaaatctacacctattgcaagagtctgtggtctatgttcttctgcagatcaccatttagatctttgtccttctttgcagcaatctggagtcaatgagcaacttgaagcttatgctgcaaacatttataatagacctcctcagcagcaaaaccaacaacagcagaataattatgacctttcaagcaatagatataatccaggttggaggaatcatccaaatctgagatggacaagtcctccacaacaacaacagtctgtccctccttttcaaaatgttgctagcccaagcaagccatatgttcctcctccaatacaacagcaacaatcacaacaaagacaaccagcaactaatgcccctcctcaaccttccttagaagagttagtgaggcaaatgaccatccagaatatgcaattttag

SEQ ID NO: 60260 - DNA, 633 bp, Glycine max
  Peptide Sequence Number=SeqID_151945
atggcagcagaatgggagaaggaagagagagaggagaccccacttcaacgagaagaagctcaccaccataggaggccatggataagagcttggaggaagaaggagatgaatgaagggagaggaagagaagagcacaaaattttgtgctctaaaagagctctgaaatctgaatctaggtgccctaaaatacaagggctgaaacttatcgaccaccacaaagatagagtctacacctttttgggtcctaggatgcccaaggacaaagtccatactaatgtctacctagggtgcagatgggatggttatcaggaagtaaagaacaaaaacaataccttagaccaaagaaaagaagaaatgaaaagtacacagcggaaaagtaaagagtgtaggaaagaagaaaacaaacacaagtttttatactggttcggcaacaacccgtgccgacatccagtctccaagcaaccaccggttcttgagatttccaataaccttgtaaaatcctttaaaagcaaagatccacaagggatgttccctcccttgttgtctttgaacaaccaagtggatgtacgctccacttgtacagatccacaagagatgtaccctctcttgttctcagtattacaacccaagtag

SEQ ID NO: 60261 - DNA, 62 bp, Glycine max
  Peptide Sequence Number=SeqID_151946
gatgcacgtaaatttgtaatacgtgctaattcagaagcaacagtgatagtgtttgaattagg

SEQ ID NO: 60262 - DNA, 1034 bp, Glycine max
  Peptide Sequence Number=SeqID_151947
ccggaccgcgtgattaccgactgcaacatgccggagatggacggcttcgaattcacccgccagctgcgcgccgaagagaagcgctggtgcgacgcgcggtgccggtttacggcctgacggcgatggcggaggagcgcgtggcgcagctggcgcaggacgccggcatgaacggttgtctgtttaaaccgctggagcgcgcgcagctgctgcaggtgatcaccggcgcaccgatgaacccgacgcgcgacgataccctgctgacgctggaaaatctggcggcaaacaacccgcaggcgtggcgcgacctggtgaccaccgcgcgccagcagaacagttacgatctcgcccagctgacgcaggcggtggctgcgaacaattttgcttcggcgcgtcacgccgcgcatcagctactcggcagtgcccgaatgctgcgcgccgacgcgctgcaacatcgctgccgcgccgccgaacaggcggcggagcatgaagatggtgcgctattacagcagctgctgccggaggtcgccggggcggtggccgagctggacgcgctgttcctgcgtgccctggaaacgcccattcctgaagaggagccgcagctcgatctggtcggggcttttgcccagcgccagcagctgatggccttcctgcagcgccacccgctcgatatcctggtgctggattacatgctgggggaagaccagcttgacgggctgcaaatggtgaaacagctgcgcctgcactacccgcagctgaagattctggtgtcgtccgcggtggagaaaccggcaattgtccagctattgctgaaagccggcgtccagggatttgtcggcaaaagccacgatcaggaggtgctgatcgatgccatccatcaaatctgtcgcggcaagcgcttcctgacgccggacatgatgctggagctggataaatttcaggagagcgatcgcgagatgcacgactacctgacgccgcgccaggcgggcgacgacatcacgctgctgctgcgcgagctgagcccgcgcgaaatcgag

SEQ ID NO: 60263 - DNA, 183 bp, Glycine max
  Peptide Sequence Number=SeqID_151948
atggtgttggtagcggctattgcaaccacattgacctccattatctcctttatgctcatcatgacctccatcattttggccatttgctctttcaaggccttcgtgtcggccttcatctgctcttacacctcctctacttcacccattactctagctctagcacgggttcgaacatggggttga

SEQ ID NO: 60264 - DNA, 624 bp, Glycine max
  Peptide Sequence Number=SeqID_151949
cgctcaaccaagaggtgatgacgctgatgtgagagatgttgtggtagatagggaatttggtttggataaccaagatccattatatacgatgaatgagattccaatgagagagtcgagagccaaagaagaccttcgacttgacgggaaaggcaaaccccggaccgatacaaaagcctgcaaagaacccgccgagcttaaaggtcaatatatcggcccagcacttcccctgcaacacaaaataacaacggagagaaagggtctccttgtcgaactcctcgcgaacaggtatgacggaaagacatttgacaaccgtagcttctgtggttacgagtcggggggtgatcggtcgtctagcggagctacacagcaagccactatatgcgctactccgaattcttcttctgaaacttccgcctcttttcccagctatccctctttccctagtgtcgcagtctcgcggattctctttattgtgacttattgtgttggaaagaggctaaaacagccaaagcaatatgttcagaaaccgtctttagatcctaacattgttatgaaaaatgttccagatgggctaatctccgccgaaccagtgcaagaaagggaagaagaagtcaccaccataaa

SEQ ID NO: 60265 - DNA, 348 bp, Glycine max
  Peptide Sequence Number=SeqID_151950
gaatcgcacccacaaagacacccaatggacccggagaagtccaacagggccctggggtttccagctctagttacgggcctctatagtcctacaaggggcccgttccccccggcaaggtcacgtcatcatgacatagggatcgcgcccgcaagacaccctagtggacccgaagaagtccaacaggagtgcctgtcgccccctactaatcaagctttcatcaagaagtactgcatccccagacaggcgcagggcgaatcaccacagcagcctggggatggctggcagcgggcaacagacgcaccgccatcacctctagagttcacctcagctcatccacaaaaaggttag

SEQ ID NO: 60266 - DNA, 216 bp, Glycine max
  Peptide Sequence Number=SeqID_151951
atgatgacaacaaaagatgatgacaaaagtgatgaacaaaaatctcaaagatcaaagaacaactcaagtgaatcaagaacaattcaagagttcaagaatcaagaagaattcaagactcaagaagaaagcctagaatcaagaatcaagattcaagattcaagatctcaagaatcaagatcaagattcaagactcaagaaaagactcaatcaagataa

SEQ ID NO: 60267 - DNA, 249 bp, Glycine max
  Peptide Sequence Number=SeqID_151952
atggtgggcaaaaaagcggttagctcgttcggtcctccgatcgttgtcagaagcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 60268 - DNA, 444 bp, Glycine max
  Peptide Sequence Number=SeqID_151953
atggatcgcgcccacaagacacccagtggacccggaggagcccaacagggccctgaggttcctagctctggttacgggcctctggatcgcgcccacaagatacccaatggacccggaggagcccaacagggccctgaggtttccagctctggttacgggcctctgttagtcctacagggtgcctgttccccccagcaagggatcgtgcccgcaagacacccagtggacccgaagaagtccaacagggtcttggagttgccagctctgattacgggtctctgtcagttctacgaagtgcttgtcgcccccagtaaggtcattagtccccttactaatcgagctttcatcaagaagtattgcgcccccggcaggtgcagggcgaaacaccacaacagcctggggatgatcggcagcgggcaacagacgcaccgtcaccacctctaa

SEQ ID NO: 60269 - DNA, 432 bp, Glycine max
  Peptide Sequence Number=SeqID_151954
atggactcgcactgtctcctgagcctgaggttgtacatcaaggaaaatcctccccacctgattgccctaggaagactttatgaggggtcaacaaccgttcacaacatccctttgcaccatgatcaagtcaaggttggtgttgaggaagttagagatgcaaatgctcccattcctgtacccactcaagagggagctgtgagatcggggaaatctgcacataggtcggatcatcatgtcgatgatcccctatatctgatgacattgactatcccacggctttttcttaagttgttacaggttatgtgggatgctaccgtgtttggggtttttaatgacaacttccccttgtacataaagcatgaagatctgtctgaaataccacacggtggtcaatgtctcaacatctctgttatacaattgtggattttgtaa

SEQ ID NO: 60270 - DNA, 924 bp, Glycine max
  Peptide Sequence Number=SeqID_151955
atggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggaaaatcaaggcgaatgggctttcttttattgacatcttggcgcttttgatctttggagtggtcctctttctgaatatggaagggttagtggacctagcagtgattgacgctttcctcgcctttcatcatggcaaggaaagcccagtcgtcgccattttggccatgtatgacacattcgaccgaggatgcccgtctatctgctacaaggtcaccgctcgtgcgtcgaaaaaggaaaggattctatcttcatgcgaaggatgtccaaatgttcccttaatgggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctattataagtggctgagaatccgaacacaaggattggattggctcccaaatctaaagactgtgagagacgatgaggttaaagcttcggaagaaagtgataaggtacaagccctaaaggcagagcttgaaagagcccgggtagtcgaagagaagttcaaggcagcaatagtgagctcaagctccaaagaggtgaaaggaatcatcatgggtcaaaggcatgatcttgaaggacgagctaaaagcttgccttag

SEQ ID NO: 60271 - DNA, 664 bp, Glycine max
  misc_feature (561)..(561): n is a, c, g, or t
  Peptide Sequence Number=SeqID_151956
gcggaatttgatatcccagaggcttctaacagtaggacgaaaaggaagttactacagaccatgggggagagatggaggcagtttaaatcagacctcacgaggaaataggcccttgcagccgatctggacggtgtcgaggacactgtctgatgtgcgcatgaaggcacaggccatccagaagcagaatactgcccccaacgttttgtctcctaggggttatgattatttggagcagaagctcctggctgagaagacgaagaagaagttggaggaagttgcacagtcaagaagcgttgatggcatcatcgaccctccatccccggtcagatgccacgtgaaatggaagatggcccgcacaaagaagacaggggagatgacgactgaggtcgtaaaggaaattgctgagaagattgactcgtttgaggagcaggccacacagggatcgttcgtcccccatggacgtcaggatgttctcgccgctgctattggacgtctagagcaccctggacgtgtccgtgctgctggagccggtgtcaccatcaagcaatactttggatcggntccacaaacgtcccgcagcgcttcctccctgcctcctgacgaattgcagcagctgacccagcagatcagggaccagctagaggagtcatcacagagaaagtga

SEQ ID NO: 60272 - DNA, 1348 bp, Glycine max
  misc_feature (619)..(619): n is a, c, g, or t
  Peptide Sequence Number=SeqID_151957
gttctatccagtcaaggtcaagagcctagggatcaccagtctaagagagttagggcaattgatgggtcagctccagcggcaagcttttcgtaaagcttacggtaaaatctgggacctagccatggtaaaagtctccacagaggccattgcctccctcgcccagtattatgatcagtcgttgaggtgcttcatctttggggacttccagctatcaccaatggtggaagaatttgaagagatcctaggatgtcctctagggggaaggaaaccatacctcttctcaggaaaatgtttggaggcaaaagcaagaatcttggcaggtaaaggcgagtgggccccgttcatagatattcttgcactgttgattttcgggggagtcctctttccgaatgtggatgggttggtggacctagcagcaatcgacgcttttctcgcctatcataaccacaaggaaagcccggctgtcgctatgctagccgacctatatgacaccttcgaccgaagatgtgaaaagagaaatacaaagattgtttactgtacttcagctctttacgtatggttggtttcgcacctttttcgccaagaggtgaggcatgcttgcccattagaaagccaccgntcatgcacagagaaaggaagggcgaattgggatcaacttttagcaagcaaagaaggagcatctgtcaactggggttgcatcagctacaatcccattcttgctataagacaacttggctaccctatgagaggggcatcactagaggaagagatcgtgcctgtcatttcacgaggtttcaataaggccaacgtggagacacttcagaaggtccgcaaggcatgggaggtgttgcaaaagaaggacaaagaactcaagggcagtaacaatgggcccatcggtggctacagtaagtggttgaaagcccacgtgcaaggtttggattggattccgagtttgagaacctctaaaagggaagaagttgaggcaccggaggaagacgaagaagtgcaagcccttagggcggaactcgaggcttgtagggaagaacacgaccgaaacaaattccgaggggctctgtggggcagcaacagcaagcttaaactccgaagagaggaaagggaccaatcgcgggagacagagaccaacatgttagccatcatcatcaagtaccaagaggaactaagtctagccacagcccacgagcatagggtggcggacgagtatgcccaagtgtacgcggaacaggaggctagaggaagggtgatcgactcgttacctcaagaggcaacgatatggatggaccgatttgctcttaccttgaacgggagtcaggactttcccgattgctag

SEQ ID NO: 60273 - DNA, 606 bp, Glycine max
  Peptide Sequence Number=SeqID_151958
atgggttctgtcttgatcccttctgtaaacaaaccaacggagggtccgtgtcgccttcgtaaaaacgtgcgttggggcattttgctacccctagacgtcgtatctaagaaggggacaaattccccggacccccgcattcctagattgcatctgtgtcatatgcattccatcatgcattcatccatcccacccatgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaacctctccaaatgcaagccttccgcaagacttacggatagatcttagagttgaccatagcagaggtgtccatagaagccattgcatcacttacccaatactacgaccagcctttgagaattgcaactgtggtccaggattcagcaagaggtttggaccgcataaaacagactcggaacggcatagcgggcctaccacagaggtacctagaagacaaggcgaggggtatggccaatccgaggagtctgggtcccgtttatggatgtgttag

SEQ ID NO: 60274 - DNA, 165 bp, Glycine max
  Peptide Sequence Number=SeqID_151959
atgttcctcgtattcaacaaagctttgaaaggacttgatgatactccacaacctaaatccaaggctgttgctaggtggattgttgttaagacaaaaggaagcactgagtgcggctattacgtcatgcattggatgtccacgataatcttaggaactcagaaataa

SEQ ID NO: 60275 - DNA, 202 bp, Glycine max
  Peptide Sequence Number=SeqID_151960
gtgtcgcaacggtacccttcggcgggagggcgacgcgagggctcaccggtgcgtcttcgaaggaaggaaaatgcgcggagtcgccaccaacgtttattcgaggaaaacgtcggaaaaaccggaaaaggcgtggtctacgaactttaagtgtgaaaggttcgggagttgtatttacgcacggggaaggatatattttgattga

SEQ ID NO: 60276 - DNA, 1032 bp, Glycine max
  Peptide Sequence Number=SeqID_151961
atgaaacctgggataacggtaagccggtacgtggaaaccctggcggctgatttgccgctggcggttgaccacttccgctactttgccggctgcgtgcgcgcccaggaaggcaccgcggcagagatcgacgaattcaccgccgcctaccacttccatgagccgcttggggtcgtcggacaaattatcccgtggaacttcccgctgctgatggcggcgtggaaactggcgccggcgctgggtgccggtaactgcgtggtgctgaagcccgccgaacagacgccgctctccattaccctgttgatggagctgattaaagacctggtgccgccgggcgtgattaacgtggtgcacggctacggcaaagaggccggcgaggcgctggcttcgcatccgggtatcgccaagatcgcctttaccggatcgaccgccaccggcggccacattcttgagctggcggcaaaaagcctgatcccgtccaccgtcgagctgggcggcaagtcgcccaacattttctttgaagacatcatgcaggcggaggagagcttcatcgaaaaagcggccgaaggcgtagtgctgggcttcctcaatcagggcgaagtctgtacctgtccgtcacgcgcgctggtgcaggagtcgatttttgagccgtttatggcggcggtgatgaagcgcatccagaccattaaacgtggcgatccgctcgacactgagaccatgatcggcgcgcaggcgtcgcagcagcagttcgacaaaattctctcttacctggagattgctcagcaggagggcgcgcaggtgctgcacggcggcggggtggagaaaatcggtgaggcgtttgccagcggttactacattcagccgacgctgctgaaaggtgataacagcatgcgcgtcttccaggaggagattttcggaccggtggtcggcgtgctgacctttaaagacgaagcggaagcgattgccatcgccaacgattcgatttacggcctcggtgcgggcgtgtggacgcgcgatattaaccgtgcttaccgc

SEQ ID NO: 60277 - DNA, 870 bp, Glycine max
  Peptide Sequence Number=SeqID_151962
atgtttcgacacgttaagaaactgcagtacacggtgcgcgtcagtgcgccgaatccgggcctggccaatctgctgttagagcagtttggcggtccgcagggcgaactggctgcggccatgcgctattttacccaaggcctcggcgatgaggatttaggacgccgcgacctgctgatggatatcgctaccgaggagctcagccatcttgagattatcggctcgctggttggcatgctcaataaaggcgccaaaggcaagctggccgaaggcactgaagaggaaggcgaactgtatcgctcaatcacgggtgccggtaacgatagccatctgacttcaattctttatggcggtggtccgccgctgaccaactccggcggtgtgccgtggaccgcggcttacgtggatactatcggggaagtgacggcggatctgcgttctaacattgccgccgaagcgcgcgccaaaatcatctatgaacgtctgatcaacgtcactgacgatgtcggcgtgaaggatgcgttaggcttcctgatgacgcgtgaagctgcgcgccagctttcatttgagaaagcgctgtactccattcgcgacaacttcccaccgggcaagctgccgccaattgagcagtatgcgcacaactactacaacatgtcagaaggtgaggacgtgcgtggtagctggaactccgatgacaacttcgattatgtggccgatccgcaaccggcggtggatggcggcgatggtcagccctccgtgacactgtcgccggatgagcagcgcgacattgacgcgctggccgcacgcaccgcatccgatccgctgatcgatccaatcaccggggcagaagcgggcagcaagaaggcgccctga

SEQ ID NO: 60278 - DNA, 2793 bp, Glycine max
  Peptide Sequence Number=SeqID_151963
atgacaagcgacgctggcgtccattcctattctgccgtcctcatgggttcgcccattctgctcaaactgttcgaagacaatcccacgctggccagccaggtctttcgcctgattaaacagcaggaaaacctgtttaccgtcaaccgcgccgaatccgaagtgatggccattaatcacgccgccggacgccatccggtggtggtgagcgcgccggtttttgcgctgattagcgtggcgcacgcggtgagcatcctgccggacagcgcgtttaacttcaccatcggtccggtggtgaaacgctggaaaattggttttcaggggcgtgaagtgccgcctgcagcggagattgaggcgctgctgcgcctgaccgatccgcatcaggtggtgctggatgctgaacagcactcggtgtttctgccgctgccgggcatggagatcgatctgggcgccatcgcgaaaggctacatcgccgatgtggtgcaggcgtttctgcgtcagcagggtgttgcgcaggcgctgattaatctcggtggcaatgtgcagacgctcggcagcccgccgcatcagccgcagggctggggcatcgggcttaaaaagccgtttggccgggacgatgagctgctgggtacgctgcaggtgcagggcaaatcggtggtgacgtccgggatttatgagcgctactttgaacgcgacggccgctgctggcatcacatctttgatccgcgcaccggctatccgctggacaatgcgttattgagcgtgacggtgattgccgatcgctcgctggatggcgatatctataccacgctgctgtacggcatgggcgtagagcaggggctggcgtatctcgccggccagcctgacatcgacgcgccagctggatttcagctggcagctgcgtcactgacagtactgctgcagcagcgaatggtactccggctgcaggcgatagcgatacaccgggcggccggtggcaccgtagtgaatgctgctcgtcggtggaaaactcatggccgggatgggcgtcaatccactgacacagcgtgcgcagcgtctgcggcgttaagcctttcggcagccgtttgttgtcgtgctgggtggccgggctgccgtgcatcagcagatcgagatccgattgctgatagtagtgctggttatccatcagcgattttttctgccgccagccggtcagcgcctcttcaaaacgcgggaactggaacgctccggcagcagatcgagcccgttctcctgctgcatatagatatccagcagcaccaggtcgatcggcgtttcgctattgaacaggaactcgcgcgcctgctgcagcgtcgcggcggtacccacgcagtgaaagcccggtacctggccgataaagctgcggttcagctcggccaccatggcgaacaggccgaccccgcgatcctcgcctttggtagagaagcccttgtcaaacacggttgccagatgctgcggcgcaatacccggtccgtcatcgctcacttcacaggtcagccagccgttctgatagtgcagcatgacgtggatttcgccctcggtctgctcactcatcgcatccagcgcattctccaccaggttgccgaccacggtgatcagcgccgccatctgctgctcgttgccgctgtccggcaggtaactggcatcgctgatggtcagacgatggccgcaatcagaggcgcggaagccgatttccgtctgatagttattagcggtcttcagaatataggcttctacctgcgcataatttttcatgtgcagcaggccgaggatcacatgcagcttattcatgaactcgtgcgagcgctcacgcagggcatcaacatagtttaccatgccggtcagacgctgcatcagctggctgatttcggtcttgtccctgaaggtgcagaccgcgccgataatgcgtccctgactgcgcaccggcacggtgttgctcagcagcagtcggccattgacgttgagctcctcatcgcgccgtgcgcgaccgccgttgagcacttcctgcagatgctggtcgatcaccgaggcatcataaatgcgcgcggtactcaccacgctgctgcccattttatcgctcagcagctggcgcgccgcctgattgaccagcgtcacctcgccctgatcgtccatcgccaccacgccttccttgacggagttaaggatcgcctggcgctgctcaaacagggtggaaatttcgtatggctcgaggccgaacaggatacgcttcagcacgcgcaccagaatgaaggtgccaaccgcgccggcaaaagtgccgatcagaatggtccacagaatgctccagcgactctggttgatctggtcggtgaccgcctccagcgagatgccgatagccaccacgccaatctgccgctgctgggcgtcatacaccggggtaaacacgcgcagcgatttggccagcgagccctgattcacggagacattctcgttgccgcgcagcgccggttcgatgtccgggccgataaagtgtttgcccaccagctccggattacggtgcgaatagcggatgccatccatgttggtgatgctgataaacagcagatggttgctctcttccaccgctttggcgatgggctggatagcggcccgatcgggcggcaggcgcagcgcctgctgaatttcgggggatttcgccagcgtgcgcgctaccgccatggctttatcctccagttggctgcgcgtcgcggcgccaatctggaagaaataaaacatgtgtacgctcagcagcaccagcacaatcaccgcgctgagcattag

SEQ ID NO: 60279 - DNA, 1272 bp, Glycine max
  Peptide Sequence Number=SeqID_151964
atgatgtatgcattggtcgacgtaaactctttctacgccagctgcgaaaccgtgtttcgcccggatctgcgcggcaggccgatcgtggtgctgtcaaacaatgatggctgcattatctcgctgagccgcgaagcgaaggcgctcggcatcaaaatgggtgcgccgtggtttaaacatcgcgacgagctgatgcgtcatcaggtggtggtgttttcatctaactatgcgctgtacggcaacatgtcggcgcgcgtgatggagacgctcgaccggctggcgccgcgcgtagacgtctattcgattgacgaggcctttcttgatgtcagcggaattgaaggctacacctcgctgacgcgctttggagagcaggtacgtgactgcctgtggaaagagacgcacctgaaagtgggcgtcggcatcgcgccaacgaaaaccctcgccaagctggctaactgggcggccaaacgctggaccaaagccgaaaacgtcatggacctctctgatccggcgcgccagcgcggcctgatgcagcgggtgggcgtagaggaagtgtggggcgtcggccgccgtttatcgaacaagctgaacctgatgggcattcaaaccgctctgcagctggcggagacgcccactgcgctgatccgcaagcatttcggcgtggtgctggagcgcaccgtgcgcgagctgcgcggcgaaccctgcctggcgtttgaagaggtgattccgcaccggcaaaatatcctctgctcgcgctcgtttggcgatcgcattaccgattatcaggatatgcgcgaagccatcgccagctatgcggcacgcgcagcggagaaactgcgcagcgagcgtcagtattgccgctacatcggcacctttatccgcaccagcccgcacgatccgcatcagccctactatgccaacgccgccagccagacgctgattacccctaccgccgacagccgcgacatcattcaggccacgctcaactgcctggatcgcatctggatccccggcaagcgctacctgaaaggcggcgtaatgctgggcgactttttcagcgacggggtggcgcagcttgatatgtttgctgactatcagccgcgccgtaacagcgatcagctgatggcgctgatggataagatcaacgcccaccagcgcggtgccctgtggtttgccggtcagggcattcagaaaccctgggcgatgaaacgcgacatgctgtctccggcttacaccacgcgtattagtgacgtgccgcgcgtgaaggccaaatga

SEQ ID NO: 60280 - DNA, 402 bp, Glycine max
  Peptide Sequence Number=SeqID_151965
atgcatggcggcagatgcgtcatgttatttattactcatcacgagcctcccgttaatcaccgattcggagaatattccatgaaagttaaatcgctactcgatctttttattcacgatctttcggacgtttacagcgcggagaaacagatcacccgtgcgttacccaaactggtccgggcagcctccgatgaaagtttaaaaaacgcttttcagcaacatctggaagagacccagggacaaattgagcgcctcgatcaggtcgtagagagccacgatgagctgcgcatcatgcgtatgaagtgccacgcgctggaaggcctggtagaagaagcgcaggagctgattgaatccactgaagccggcccggtgcgcgatgctggcctgatcggcgcagcgcagaag

SEQ ID NO: 60281 - DNA, 327 bp, Glycine max
  Peptide Sequence Number=SeqID_151966
atgaattatatcccatcctacaagaagacatggttagcaaagcaaagagcattggagatgattcatggaaactgggaagaatcatatgccgaactgccaaaactttttggagctttgcaatcttgtgttcccgggactgtggtcgctgctcaaacagaatccttatatgaggggggagaaatagttacgcatacacggagaagatgcactggcgacatcttggggatatttgtgcaaataagccaagtgcagctgaatggcttgatcaattacccaaacaaaaatgggtacaatgcttcgatgagggaaaacgttggggacatataa

SEQ ID NO: 60282 - DNA, 552 bp, Glycine max
  Peptide Sequence Number=SeqID_151967
atgaaaagagaaaaacatgcctcctatagtagtcataactcttgcaagagcctaagtgaagaacttcgtgactattatgaaggacggcataggtcacatcttagacctcactcccataggagagaaaatgaaagaaagcctcaagaggctaacattaacctctcatacttccatgggaaggacaatgtagaggcttacttagattgggaaataaaggtagagcaaaaactgaaaagaaagtctactttaaaatcttatggctctcattcttatccaaagaaagaccaaggtctaggcatcttaggggcagcaccttctaaggggaagacaatagaaaaacaaccccctaaggctagtatgcaagaaaagactagctctataaagtgctttaaatgtcttggacgaggacacattacttctcaatgccccaccaagaaaaccatgattatgaggagccaagacatttatagtagccaagatgaggctactacttcaccttcctctagtgaaaatgaagaagcaaaaggggaagaatctagtgaagaaatctaa

SEQ ID NO: 60283 - DNA, 489 bp, Glycine max
  Peptide Sequence Number=SeqID_151968
atggagagaagtatgatagatgctgccagtggtggagcccttgcagacatgacccctgctgaagccagaaatttaattgagaagatggcttcaaactcccaacaatttagtgccagaaatgatgctattgtcattagaggagtgcatgaagtagccacgaattcatcttcatcagctgagactaaaaagcttgaaggtaaactagatgccttggttaacttggtaacccaactggccatgaataaaaaatctacacctgtcgtcagactctgttgtttatgctcctttgccgaccaccacacagacctttgcccttatgtgcaacaatctgaagcaattgaacaacctgaagcttatgctgcaaacatctacaatagacctcctcaacctcagcagcaaaatcagccgcaacagaacaattatgacctctctagcaacagaccatacgttcctccaccaatccagcagcaacaacaacaacaggaatag

SEQ ID NO: 60284 - DNA, 429 bp, Glycine max
  misc_feature (421)..(421): n is a, c, g, or t
  Peptide Sequence Number=SeqID_151969
atggataatgaagagggagtgcaagaacagatgaaggccgacctatcggccttaaaagatcaaatgacttctatcacggaggccatgctaaagcttcagaaaactatagaagataatgctacgacgaccgcttccaatacagatagggaagtggaatcggtgctacagcccgcaataaatttgggtcgagatagaaacacgatggttttcggtcggaggtatagtcctcaagcctacccttatggtttgcctccggacatcactccccgtaccgctccagacgatttgagccaagcccctaccttcgaggggcaactccctccttatgctgactatcctctgcaagaagatgataaaggagatgcccatctaggccctctacttcccctcaaggatccggccccccatgaattgccccaancaaacata

SEQ ID NO: 60285 - DNA, 324 bp, Glycine max
  Peptide Sequence Number=SeqID_151970
atgggttctccacctgcctccactactcctcctcctcctctttctcctctttctcctcctcctacttcggacgcatcggcttcgacgtctgccgtgaagcgaacacgcaaagcctcacgcctacgatcgttgtacactagaccacctggtgttgagagaccagtggtgcatgttgatcctgctacagggaaggccgacagtccccacaagaagaaattaagaacatatttggggattgtggcacgtgataaggtggacatcacctacgagaactggaaggaggtccctactgctcagaaggacccgatttgggaggatattcag

SEQ ID NO: 60286 - DNA, 264 bp, Glycine max
  Peptide Sequence Number=SeqID_151971
cgagcatccgcaaagcacaacactcctaggctaagcgcaaggaagactctggaagaagatgagtgtcgcaacgtgccctttcgcgggcgagcgaaggcgaggctcacgggtgccctgtcgcaacgtttatttgtggaaaacgtcggaaaaaccgaaggaaaaccggtcaaaatgaaaattctaagttcgggagttgtatttacgtttgaggaaggtattagcacctctcacgtttgtctcaaaggacaacagcctattttttag

SEQ ID NO: 60287 - DNA, 249 bp, Glycine max
  Peptide Sequence Number=SeqID_151972
atgtgtcgcaacctacccatttgcgggcgagcgaggcgaggctcatgggtcgacaaaagcggggctcttgctcctacgtaccctccatcaaagaggaaatcagacctacgtaattcttttaaaaggggcgaatcaagtgattcttttttacttggaaggtggtcatttaaggcgttggaccttaaactgatccatttttacttggtgagaaaagctaaggcgttggaccttaaaacgttttttcagtga

SEQ ID NO: 60288 - DNA, 776 bp, Glycine max
  Peptide Sequence Number=SeqID_151973
cttccattttagaagaagaagctcaatcctctgattatgcatcatcttattcaccgtcatcaagggaatccactacagatttaccagaagcctctgtcatggctgaagaacatcaacacagggttacccttgaagattactccaatagttttgtgcctcaattctttacaagagaagccaagaagtggctctattcattcaaaggcaacagtctgaagacgtgggaggaagttgttgagaaatttctgaagaaatacttccccgagtcaaagaatgcagaagggaaggctactatttcatcattccaccagttccctgatgagtccttgagtgaagcattggagagatttcgtggatggaagataaagttgaaaacccctaaagaggcaattgaattgattgaaaatatgtctactagtgatcatgctatcctacatgatagagtacatcaacccaccaagaaaagcttgttggagttatcatcacaagttgctttgctggcacaaaataaattgctctctaagcaacttgaaatcttaacagaagcacttggttgtaccatttgtggtgaggctcatgaatcaggtcattgcattcccattgaagaacacactcaggaagttcattacatgggaaatcaactaaggccaccccaacaagggccaaatatttttcagaggaccaccaaactggaggagacactagctcagtttatgcaagtgaccatgtccaaccataagaatattgagtcagccctgaaaaaccttgagatctag

SEQ ID NO: 60289 - DNA, 456 bp, Glycine max
  Peptide Sequence Number=SeqID_151974
ctgattcagttctacgtgtctattcgcgaccgcgatcagaaccgtgacctgaccggtgacccatggggtggccgtacgctggagtgggcgacctcttctccaccgcctttctataactttgccatcgtgccgcaggttcatgaacgcgacgcattctgggaaatgaaagaaaaaggtgaagcgtacaagcaacctgctcattacgaagagatccatatgccgaaaaacagcggtgcgggcattgtcattgccgccttcgctacggtatttggtttcgcaatgatctggcacatctggtggatggcgattgttggcttcgctggcatcgtaatcagctggattgtgaagagctttgacgaggacgtggactactacgtaccagtccgtgaagttgaaaagctggaaaatcagcatttcgacgagatttctaaagcggggctgaaaaatggcaactga

SEQ ID NO: 60290 - DNA, 528 bp, Glycine max
  Peptide Sequence Number=SeqID_151975
atgccacgcctggacggattcgggctggcccggaaactgcgtgcggatgactcctccatccccatcgtcgcgctcaccgccaatgcgatgcccgaggacgcgcagcgcgtgcgcgaggccggcatgtccacgctgctgctgaagccgctcgacctgccgtcgctggaggccgcgctgcatggattcgacctcgatcgctcggcacagccacccttacctccggtggtgagcgaggcggttcagcggcagatgcgcgaggcgttcctgcagaccgcgcatcgcgactacgcggcgctgacccaggcgctggactgtgccgatgcaccggccatgatcgatcagctgcacagcttcgccggcgcgctggtatttctgggagagccccaggcggcgcgcagctgccagcaggccgagcaggccttgcgcagcaccggtgcgacagatgcggcgtcgagggcgatcgtcattgaggctgtcggattgatcgcggcgagcatcgagcgtcaggtcgccgcgcagcaagcttga

SEQ ID NO: 60291 - DNA, 837 bp, Glycine max
  Peptide Sequence Number=SeqID_151976
cagtgggatcaggtgcccgatcacctgaaaaggaccttccgcgtggtggatgagcacaaccggaagctgcaggaaggcaaagacctgcatcagctgaagcaggtgctgaaaggcaaggtgcaggagacgctgtccaaggtggcggatgacggactggagcagagcggattacacctgtggagcttcggcgatctgccgcaaaactatgagcagaagcgcggcaactatcaggtcaaagcctggccggcgctggtggatgaaaaagacagcgtcgcgattcgtctgtttgacagtgaacgcgagcagcagaagatgatgtggcgcggccagcggcggttactgctgctgaacattccttcgccaatcaagtatctgcacgagaagctgccgaacaaagccaagctcgggctctatttcaatccgtacggcaaagtgctggagctgattgatgactgtatcgcctgcggcgtggataagctgatggcggacgccggtgggccggcgtggcagcaggaaaactacgagcaattgcgcgataaagtacgcgccgaactcaacgacacggtggtgaccatcgccagccaggtcgagcagattctcaccagcgtgttcaacatcaacaagttcctcaaggggcgggtggacatgacgctggcactggcgctggcggatatcaaaacgcagctgagcggcctggtgtatcgcggttttgtcaccggcaacggctatcagcggctgggcgacaccctgcgctatctgcacggtattgagcgccggctggagaagctgccggtcgatccacacagcgatcgggcgcggatgctgaaagtgcaggcg

SEQ ID NO: 60292 - DNA, 510 bp, Glycine max
  Peptide Sequence Number=SeqID_151977
atgatgagaactaaaaatgttgatgatcacaatgcaatagctgtggtggagtctgagagggggagaaatcattcaaggagacatgatgggccaagaggaagatcaaaatcgcaatcgcgtttgcaacgagacatgagtaacatacaatgttactattgtggtgagaatggtaatgtgcaagtgaggtgcaaacaaatgaaggaggacttgaagaaattgaaagatatgaacaaagatggcgccaacttccaagctaatgtagtaaaaagtgttgaagatgaagatgatcacatttgcagatatcgagatatgtttgatacttcgaaaaccgatggagaattcggccatttcaagttagggaatgatggaaaaatgaaggttgaaggcatatggagcgtgaggatgaagctctatgatggtgctattcaaactttcccaaatgtgaggttcaaagtggggatgcaaaatgtacaaggggagacacttggtgctgcgagaacagaagaataa

SEQ ID NO: 60293 - DNA, 432 bp, Glycine max
  Peptide Sequence Number=SeqID_151978
atggcagcgcaattaatccatgatcgagtggagatggagtgcctagagggagtttgggagaccctcgaaggcaatgcgaggtgccgattccgtggcacgattcgattcacggctacttcattggtacatgcagaggaacccgcactcacgcttcagcgaactgtggagtggatattacctacacctactccatatcgactagtggagccagtccaagtgatagaggtttcgtcatctgaagaagaccctgaggaggacccagaggagttacctcctgagcctgttgtggatgctcttgactttcccgagggtgatgaggacgcactccctaatgtggattctccaaaggacgtcatgtcagcatttgaggcagactctatggaggagagcggccctagagggatagcgactagtggagactcttcatcatag

SEQ ID NO: 60294 - DNA, 252 bp, Glycine max
  Peptide Sequence Number=SeqID_151979
atgttaggattcacaagcgattctcctcatgttccagccaacccgcatcaattagactttgcaccttactctttgaagtcatacagtgctcaatggaatgtcccggaactcctccatgatatgcacatgttgcgttcgagtcgtatcctcggagaaatggaggttgatgaaccttggttgaggttatggctaccattgaattatcaagtggtgttcgtcattggaagtgcggtagacaggctttgtggttga

SEQ ID NO: 60295 - DNA, 408 bp, Glycine max
  Peptide Sequence Number=SeqID_151980
atggcacgaatttacatattgattatactcaacatttttccaaaagtttttgttcaacacttgctttgtcaagaaaagttcattgggcaaaaacttatgctattctattttcttcctctcctccattcttacaaaaagattttcaagagacctactcttggtgactgttttcaagagaaggtcttcttggttgcaaacactgaacacaagggaccaatgttccttgggttcattgcaagaagcaggatttgcttcttggttgatcactggacacagaagacatcatcttttgggttcattgcaagaagtgggtacaacttcttggttgttatcactggacacaagggaccaatgttccttggggttcattgcaagaagtgggaagaacttcaggattgtaatcactga

SEQ ID NO: 60296 - DNA, 534 bp, Glycine max
  Peptide Sequence Number=SeqID_151981
atgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcgcgtaaacgcatgaaaatgtacccgcacgattttctggcggcatgcgtcagcgagtcatga

SEQ ID NO: 60297 - DNA, 348 bp, Glycine max
  Peptide Sequence Number=SeqID_151982
acagattttgcaccctttatcattcaggagcaacaagctgagtgggaacaacaagctgagtgggtaaacgcgcaaagacagattctgcgccctttatcattcgggagtagcgaggcggagacaaataatggtcattctgtatctcgctgcccaggctcgatcgtttccaacaaaacgcagagacaaattatggtcattcagcgtcttgtatcaactgagaggaacaaattcgacagttctgctggcagggaggttcactggctgaatggatgcgaccctcatttgaccacttcgaggtacttggcacccatcgttaggcaattcgtgaagttccgtgatatgccggaa

SEQ ID NO: 60298 - DNA, 450 bp, Glycine max
  Peptide Sequence Number=SeqID_151983
atgacgcctaccaggcaccctctggacccggataagtccaacagggccctgggatttcccgccttgatcacaggactctgccagtcgttcggagtccccgtcgcacctagcaaggtgattcggccgcccatcacccaagcttttgttgagaagtattgcacacagagacaggcccagggggatgctccgcaggccgcagatgcgccgccacctcatcaggctggcccagctggatcatttgatacggagtacctgcagagccagggttttacttcttttctgtgccctactccggaccagttcagggcagaggtcgcatggccaggagattggcctgaggcccgggcaggagaggcaccagcagaggctcccgacgaggcagatgaggcccgcgaggacgaggagatggccgatttacttgatttcttaggagggagtggagccacatga

SEQ ID NO: 60299 - DNA, 304 bp, Glycine max
  Peptide Sequence Number=SeqID_151984
gggcattgcacaggctgaaaggcatcctcctataagcaaaagtgccgaaggggcaggtgaatgtggtcttttcctgatcctcaggagcaatagtaatttgcatataaccaaaaaaaccatcaaggaaacagtagtgggatttacctgccaggcgttcaagcatctggccggtcttcttcgggactacctggatgggactcacccattggctgtcggagataggataaatgattccagcttgcaaaagcttggttatttccttcttcactacatcaagaatcaccggattgagtcttttctgtgg

SEQ ID NO: 60300 - DNA, 482 bp, Glycine max
  Peptide Sequence Number=SeqID_151985
gcgttctcgcctttagaggactagacgtcctcgtcttcagagggctacatgccctcaccttcagaggactacacgtcctcgcctttagaggactacatgtcctcgccttcagaggactacacgtcctcgccttcagagggccacacgccctcgccttcagaagactacctatcctcgccttcaaaggactacacgtcctcgccatcagagggctgcacactctcgccttcagagggctgcacacccatgccttcagagggatgcacgcccttgcctttagaggcgtacacatcctcactttcagagggctccacatttgcgccttaagagaatttaagtttccttttatcagttcagttcctgggccaccccctaatcctggaggagggccaactatgcgagcacaactagaggaggaggctatcgtacaaccactatgcatactggggcaagatttcacccgtgccgttacaaagagatga

SEQ ID NO: 60301 - DNA, 219 bp, Glycine max
  Peptide Sequence Number=SeqID_151986
atggcacatttcataccatgccacaaagtagatgatgctagtcacatctcaagactcttctttagagaagttgtgaggcttcatggtgtagctaattcagatgatgaggggtctacagatttgaggacaaatcctcttcaagtgggaggagatgatggaatcctcccaaggaggggacctatcactagagccatggctaggaggctccaagaagattag

SEQ ID NO: 60302 - DNA, 201 bp, Glycine max
  Peptide Sequence Number=SeqID_151987
atggctgatggaaaactgatagagatgaagggtagagttaacctagggttaaaaagatccaatttgagcaaatttggattatggcaagggggatttcgacatctgcccaatttgtgcagcaaaaagctgtcaaattttgtgcagcagaaaattgtgtttgtgcaaaaagtgttgtgtgttgctggttgtcgaaaagggtag

SEQ ID NO: 60303 - DNA, 72 bp, Glycine max
  Peptide Sequence Number=SeqID_151988
atggaacgccccggggcttctcccatgacaagcacacgtttctttcgagtcgtattctcggagaaactggag

SEQ ID NO: 60304 - DNA, 387 bp, Glycine max
  misc_feature (113)..(113): n is a, c, g, or t
  Peptide Sequence Number=SeqID_151989
atgagaaagcgccacgcttcccgaagggagaaaggcggacaggtatccggtaagcggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccctatcaattgctacttccaatatggttgctactgcccttgccaagcagtgagtgagtga

SEQ ID NO: 60305 - DNA, 632 bp, Glycine max
  Peptide Sequence Number=SeqID_151990
atggggacaaatcaaactggcaaaaggttttatcaagtcaagattaagggcctagatatcaccagcattaaggagttggggcggttgatgggacctcaccaaatgcaagccttccgcaaggcatacagaaagatcttagatttgaccatagtaaagatatccataaaagccattgcatcactcacccaatactatgaccagcccttgagatgcttcacgtttggagacttccaattagtaccggccgttgaagaatttgaggagattctaggatgtcctcttgggggaaggaaaccgtatcttttctctaggtttcttccctccttgagaaaaattgtaattgtggtcagggattcggcgagaggattggaccgcgtaaagcaaactcgaaatggcatagtgggcctaccacagaagtactcagaaggcaaggcgagggacatggcgaatcaagaggagtgggtcccgtttatggatgtattagctttgttaatctttggggttgtcctctttccaaacttggatggtttggtggacctagctgcaattgatgctttccttgcatatcaccatagcaaagagagcccggtggtagctgtcttggcggacttatttgacacatttgatcgaag

SEQ ID NO: 60306 - DNA, 264 bp, Glycine max
  Peptide Sequence Number=SeqID_151991
atgtcgtggaactttacggattacctaacgatgggtgttaagtacctcgaggcggtcaggcgaagaatcgaacgaccaacatcatctggataccgtcaaattcgttcccctcggttgacgaaaggtgcggatgaccataaggtatctctgcctgccacccgactcgctgtccctggatggctaaaaggtgcagaagacgatgttagtctctgctggttgacgaaaggtgcagataaccacacggaacccctgcatgtcacttga

SEQ ID NO: 60307 - DNA, 629 bp, Glycine max
  Peptide Sequence Number=SeqID_151992
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtttcccagtcacgacgttgtaaacgacggccagtgccaagcttgcatgcctgcaggtcgactctagaggatccccagtctgcagttgggtaccgagctcgaatacgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 60308 - DNA, 111 bp, Glycine max
  Peptide Sequence Number=SeqID_151993
atggctcgaaatggagcttacaaattcactttccaatacagtattcaggtgttgaacccgctgcttatgttttcttccagatggggcatgcatgtgacccttaacccgtaa

SEQ ID NO: 60309 - DNA, 372 bp, Glycine max
  Peptide Sequence Number=SeqID_151994
atgccgggagcagacaagcccgtcagggcgcgtcagcggttgttggcgggtgtccggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccttcatgacttga

SEQ ID NO: 60310 - DNA, 961 bp, Glycine max
  Peptide Sequence Number=SeqID_151995
atgaataccgaaagttacgagaaaatcctgcgtgaccggcagcgcgagctttatcgccgcctgcataagatcgaggccgacttcgaagagccgcgcaatcctgatgacgatgacagggccaccgaacgcagcaatgacgaggtgctggacgagctggggcaggtggggcaggatgagttgcgcgctatcgacgccgccctcgagcgtatcgccaagggcactttcggcacctgcgtcaaatgcggaagcgagatttcggaggatcggttgaaggctgttccctatacgccggaaagcgtggctgggtctcttccccccgctgggaagaaggtggcccgaagggccggacgagggggcaagctctccgaacacatctaccctgccgcctcatcccgctgccgcggacttctccccggcggggagaagaaacaagtgtatgccgctcgctccacaggcaattggtctggccgcagggcaacccaggacctctcctttcgcaacagcaccgaacgcaatttgatcgccattaaccggctgctacaggattggactatgagcgatttgtggcggttcggacgccagtatgattttcacgagattgtcgccgatggcatcgtccacggggtcggtatcgtgctggcgcttatcggcgccacggcgctgattttctacgcgatggtatggggtacgctcagcgccattgcagcggcgtggatttacggcctcggtctcgtcgtccacctatacgccgtttctgatgcggggtatccacgatcccatgatcgcggtcatgctggggctgatctggctcgctgcgatctgcggcctccttctcaaatgcctgtttcccggccgttacgaccgggtcgccatcggcctttatctcgccatgggctggagcggcgtcctggtggtcgagccgctgtcggcgcatctcgcgccggtcacgctctggctgatc

SEQ ID NO: 60311 - DNA, 651 bp, Glycine max
  Peptide Sequence Number=SeqID_151996
atggtaattgaccagtccctattctatgatttaacccagttgccaagcgaaggtgtaccatttgaaggtgcactgattgatgattggaagtttgatttctctgtacatgatgcccgccgattggtttctgaagaagatctcattgtcatgtgggcctttcataaaggtttacaaattgattgggcacaccctgttagatatcgcatgcataaggcattgcgattgaatgccccattgccttatcctcatcttgttacccttttccatcaacacttcaacatccctcttgattctgaaccttatgttccaatcaagagatcattccttataggcgcttcagtcatagcatcctttggttatataaaggagcatgatggctcttgggtgaagaagggtgctagaaatgttggtgaagaaggacaagagggagaagatcatctcttctttcgaagattatggataggtttgatggtcttcaaacctttgttggtgaaaggtttgacactttggaattgcaaatggatatgcgcttcaatgaaatggagtcaagaatcacaaaggttgaagaagatgtgtcttacattcgttcaagctttgatcttccaccaccgccgccaccatcatcttagatctctatttttatattattag

SEQ ID NO: 60312 - DNA, 159 bp, Glycine max
  Peptide Sequence Number=SeqID_151997
atgcaacagggacaggcagatatcctcatagctaggttccctgaccctaactatggtgttaaaatgggacaggcagatatcctcatagctaggttccctgaccctaactatggtgttaaaatggtaaattttataataaactccccttacctatcgtga

SEQ ID NO: 60313 - DNA, 258 bp, Glycine max
  Peptide Sequence Number=SeqID_151998
atgcagagttcaaagcgcgatgtctatcttgtagcctacctaaatggtgctttaaaaggtcttgatgatgctccacagcctaaatcaaaggctcctgctaggtggattgtcgtcaagatgtccaccatcattttagaaacatttaggaataactgggaagcgtattttaacaatcctagaccattggagccagagagattaaaggcgttgcggatccagtgggcacaattttatctccgagttagagatcagacttag

SEQ ID NO: 60314 - DNA, 366 bp, Glycine max
  Peptide Sequence Number=SeqID_151999
atcatggggagaacccgaggtttaggtcgtgccataggtagagttgtaggcagagatagagctgctgacgaggatgctggtgatgttcccgagaggcgtaggcctactgcctcagcccgtaggctacgcgttcatcagatgactatggagggacgtgatatggctgaggacgtcgctggcatgactgatgatgtccctgagcagcctacggaagcacctgagatgcgtgcggacgcacagggtgctgatagtggtgaggggtcagatggtgatgatgctgcagagggattccctggtggtccacgcgacccgtcagtgctgacatcatttgtcgagcatgttgcacatgctgtgtggagtggacaa

SEQ ID NO: 60315 - DNA, 204 bp, Glycine max
  Peptide Sequence Number=SeqID_152000
atggataagagcttgaaggtaggagaatatgagtggggggagagggagagaaagagcaagaaattttgtgcctcaaataaggttattttgatgatgccaaagaatcaagagttaagcaaagtttcaagcaaagattcaagaatcaagaataatcaagatcaagattcaagactcaatattcaagagaagactcaatcaagataa

SEQ ID NO: 60316 - DNA, 1053 bp, Glycine max
  Peptide Sequence Number=SeqID_152001
cgcaaatgggcccgcgagctggattatcggttgattaaagagttatgggcgtggcaccacgataagctggcggtgcgttttgcctatgagtggcgcgatgacagcggcaactggttccgcagctacggcaatgaaaactggcactttggtgccgatggtctgatgattcagcgcttcgcctgcatccacgatttgccgattagcgctgaagcgcggctggttcactggccggctggcagacgcccggacgatcatccgggcctgagcgagctgggtctgcggcaggctgccttccagcgccacgcccgccagcgtaaaggcggaaaagctcagccagcgctgccatttatcctcggtgcaggatgcacgacgctggtgcaatgccttaacgtcggcgcgacggatagtgctgaatcacgcggtggcgatagtgctgccagcaacggaagcttccgaacgcagtatgctgtgccagccagcgatcaacttcaagcagctttagacgaacattctgctgacaggcatggtagcactgctgctgagcgggtgcgagcaaaaaccggcgcagcaggcgctggtgctggaaggcaaaaccatgggaacgccgcgctgcagcaggcgattcagcagcagctcgatcgcgacgatggcgaactctccacctggaaaaaggactcggtgctgtcgcgcttcaaccagtatcaggggcaggatcctcagccggtcagtgccgatatggccgatatcgtcacccgcgcgctgcgcatcggccagctgaccggcggcgcgatggacattaccgtcggaccgctggtgaatctgtggggctttggcccggcgcagcagccggctcatacgccatcggatgccgctattgccgccgccaaagcgcagaccggcctgcagcacctgcgcgtgattgaaacggtgaacggccagtggctgcagaaagatctgcctggcctgtatgttgatctctccaccatgggcgaaggctacgccaccgatcacctggcgcggctgatggagcagcagggcatcactaattatctg

SEQ ID NO: 60317 - DNA, 164 bp, Glycine max
  Peptide Sequence Number=SeqID_152002
ataaattaaatatggatgaagatgaggatgatgatgtgccacaaccaccaagcaacatcatggaagatgttaatccaaatgaaagcaatattggtgaagagtctcattcttttgatggagaaggatcacctgaagttgacccaacattggcttcttggatataa

SEQ ID NO: 60318 - DNA, 129 bp, Glycine max
  Peptide Sequence Number=SeqID_152003
atgatcgccgcagcgttatccacaaagcgccaagtcaagaagcactgctacaatattcccttgtatcacggcacagagtattgggtgtggaccatctacttctacggcaaagttaacatcgctcaccag

SEQ ID NO: 60319 - DNA, 399 bp, Glycine max
  Peptide Sequence Number=SeqID_152004
atggggacaaatcaaactggcaaaaggttttatcaagtcaaggttaaaggcctagatgttgccagcattaaggaattggggcggttgatgggacctctccaaatgcaagccttccacaagacttacggaaaaatcttagatttgaccatagcagagaattgcaactgtggtcaaaggttcagcaagaggtttggaccgcgtaaaacaaactcgaaacggcatagcgggcctaccacggaagtacctagaagacaaggcgagggatatggcaaatcaagaagattgggtcccgtttatggatgtgttagcattgctaatctttggggtcgtcctctttccgaacgtagatggtttggtggacctagccaccatcgacgctttccttgcataccaccatag

SEQ ID NO: 60320 - DNA, 222 bp, Glycine max
  Peptide Sequence Number=SeqID_152005
atggctatggacttgaaacttctcttcgactacccgggctctctcaaagctttgcctttagggcttccacttatgatagccgccgatgatcccattactgcttcccctaagctctctgtcctttcttcacgccgcatcccatgccttgcgaactccttggagtaccctagcattgtggtcactgaaaccacgtgcgatgaaaggcgtgatgctttcgtctga

SEQ ID NO: 60321 - DNA, 247 bp, Glycine max
  Peptide Sequence Number=SeqID_152006
gttgccgtcgcttgtgacggatgcgaggggtgctaataccttccctgttggtggtgactccatgtgttttccttccttggaagatgcacccgtgagtctcgcgtcgccctcccgccgaaggggcaaggatgggcattctcaccctgggtcaaggtttatggtaagttgggattttggctcaaggcttgtagaacaaatggacatgatatatgtcagggtgttggtttggccagcgattcagggataa

SEQ ID NO: 60322 - DNA, 369 bp, Glycine max
  Peptide Sequence Number=SeqID_152007
gcgcaaacttcatcgcgcagccaagcgctgttcgaagcgatccgccagtatatcgatctccatttcgctgagccgctgagccgggaatccgtggcccagtcgttttacctatcccccaattatctctcgcacctgtttcagaaatgcgggcccatgggttttaacgaataccttaatcatattcgcctcgaacaggcgcgcatgctgttgaaaggccatgatatgaaagtgaaagacgttgcccacgcctgcggcttcgccgacagcaactacttctgccgtctgtttcgcaagaacaccgaacgttcgccttccgaataccgccgccagtatcacagccagttgacggaaaaatcctctgcgccgtaa

SEQ ID NO: 60323 - DNA, 227 bp, Glycine max
  Peptide Sequence Number=SeqID_152008
atacgaaaaatgaggttacattatgcaaaaagggcaacagaaataaagagaaagaaagagttctgaagcagacccagcccaacactcgggctaagcgcgcgtcaggcgctaagcgagaaaagaaggcaggcgctacgcgaggcgttaagctcgaagatgcagaatccgttatgcgcgctaagcccagctacgcgctaagcgcgcgatccaacagaagcataggctaa

SEQ ID NO: 60324 - DNA, 689 bp, Glycine max
  Peptide Sequence Number=SeqID_152009
atggaggccatgaaagagaaaatgaccacaatgatggaagccatgatgagtatgagaaaaatgatggaggtcaacatggcgacagtcgttgccgcaagtgccgccactgagatagaccaggctcacctatcaggcttcaatcaagtaaatcctcctgcctcggatatggttcaaaacaagcatttcttcccacaatacggcttgcctcccaactatacgccacccaatgttgcacacgctcccgatgagaatgttgacaactctgcacccatacccgttgagagccaaaaaccccaaactgatcatgcacatgtctctcaaaccatgggggagacatatgaagtaccccaccacaatctagccgactttgagccttgcctcggatatgccattcaggggcaagcagttgggggtgtagccctgccaaacactttggagggccctcaatttcgcccacaaccacaacccttgcattttgcggaggggagagtccctcctgctatggtggaaagaggaaaattttatcatagagaggaaaggctcagggccattgaaggaggtggagattatgctttcgctgacatggcagaattatgcctagtgcctgacatcgtcatccctctgaagttcaaagtgctagattttgataagtacaaagggactacctgccccatagaatcacctgacag

SEQ ID NO: 60325 - DNA, 864 bp, Glycine max
  Peptide Sequence Number=SeqID_152010
atgaggggagcgccaaccgaagaaagtctctcgcctttccttgtgagggatctaggcgcgcaaggtctcaaggttatacaaagaatccacaaggcgtggaggagtccgttgaggaaagacaaggagcttaggggcatccgaaacggcgtcattggaggttggctctccaaattgaaagttgtcgatgaggagaacttcgaagctccggaggaagatgaagaagtccgtgctctaaagttagagctagggaaggcgagactcgccaaggagaagttcaaatcagctgctacacacatccggaaggagtgcaccgagttacagaggaaaacgcggcactgcagagctcttgaacaagaaaccaaaagggcccgcaaggaggaacatggccgagaaaaattccgaggagcattgtggggtagcaacaatgagctcaagctccgaagagaggacagagatcggtcacgggtgcatggcatgatcttaaaagaagagttagttgcttgcgcgaggtccaaaaggagtttggctctacacttggaagccacggagcaaagcatgctagccatcatagggcaatacaaggaagaattgaaccagtccatggcccatgaacaaaagctagtggaggattttgcacaagtgtatgccgaacaagaagcaagagggagggtgattgatgcgttgcatcaagaagcgactatgtggatggataggttcaccttgaccttgaatggaagtcaagacctcccgcgtctgttagccaaagcaaaagccatggccgaagtgtgtactggccccgagggagatccatgggctaatcaattactgtcaacacatgatagacttgatggcccatatcattag

SEQ ID NO: 60326 - DNA, 480 bp, Glycine max
  Peptide Sequence Number=SeqID_152011
atgactgggctaaggcacttaaaagtaaggttgttagagacaacccctctggctttacatagggcggtgatcagagtaggaaagccaagtctagaagagttggactgggatatagaagtcatctggccagaaatgagagctcctacgttcatgtccatgcaagagactaggccaaagatcagcctagctctgtccactgtcagatcaaaggtatgtgatgtgggggccaagttggagtatgagagaacactccacacctgggctaaagtagtcaaatctttcctgagaatcctcccaagatggcccttagtgttcaagatgaaccctcagcttgagtatgtgggcaaagtctcaccctctgccaacaccacaggtgtctccaagaatgtgttgaggctgtcagcgtcgatcttcactagatggcctctgactctggcttgctttggtgaaggaccctcagagctgtataggtttgcatag

SEQ ID NO: 60327 - DNA, 375 bp, Glycine max
  Peptide Sequence Number=SeqID_152012
atggcggagtgtcatatcctaatcttttccggggactatcaccttagttcgcccaggctagcctctggctcgcttgggccaccaaataacttcatggtgaagaaaccaactcactcgggtaagctcattgcttcagcactaagtttcaactcgcctgggcgagctgcctttgccccaagtgcccattttccattaaatagacgtgctagggaggctgaggaagggttccaaggttcagaagtggagggaattgagagaactaagaaagaagaagaagaaagaagaggaaacgaagttgaggtgctgctgaatcgcgactgtgatcaatctctacatcgttccttgttcggtgatcttcgtgcgaccatcggttag

SEQ ID NO: 60328 - DNA, 570 bp, Glycine max
  Peptide Sequence Number=SeqID_152013
atggagagaagtatgatagatgctgccagtggtggagcccttggagacatgactcctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatagaaaaatatacacctgtcgcaaggacctttgcccttccatgcagcaacctagagcaattgagcagcctgaagcttatgctgcaaatatttacaatagacctcctcaacctcagcagcaaaatcaaccacagcagaacaattatgacctttccagcaacagataccaccctggatggaggaatcaccctaatctcagatggtccagccctcagcaacaacacatagcagcctgctccttccttccaaaatgctgctggcccaagcagatcatacattcctccaccaatccaacaacagcaacagccccagaaacagccaacagttga

SEQ ID NO: 60329 - DNA, 170 bp, Glycine max
  Peptide Sequence Number=SeqID_152014
gtacgacctcgatcaagtcgccaactgtcgcaacctacccttcggcgggagggctcgcggggctcgcgagtgcgtcttccatgggaggaagatgcgtggagtcgccaccaacgtttattcgaggaaaacgtcggaaaaaccggaaaaggtgtggtctacgaactttttag

SEQ ID NO: 60330 - DNA, 621 bp, Glycine max
  Peptide Sequence Number=SeqID_152015
atggctacctcaccaaaagaaacttcagctcctggttcacccgctgtaccatcatctccatcatccaccaaagcaccatcaatccaggaacaacctgatttccatatccaacccatacaagtgattcctggtcaagcccctggtcctgaaaaactggttcccagaagacaacagggagtgaagattgctgaaaaccctagccctgcaacaagtcctagggaagtaaacccggagatggataagaagatccgaaaagatgttccaacatcttccaccccaaatgtttctgtgcctgatgctgagaaagatgttccaacatcttccacaccaaatgctgaagccgtctcttcacccagcaaagaggaatcaacagagaaagaggatccagccacaaaggagacccctgcaccacgggcaccagaacctgctccaggtgacctcattgacctggaagaagtagaatctgatgaggaacccattgccaacaggttggcacctggcattgcagaaaggttacaaagccgaaagggtaaaactcccatcaagaggtctggacgaatcaagactatggcacagaagaagagcacaccaatcactcctaccacatccagatggagcaaa

SEQ ID NO: 60331 - DNA, 363 bp, Glycine max
  Peptide Sequence Number=SeqID_152016
atggaggattacaaagaatccatgaactgcaccctagctatctaccactacagtaccctctactctttccttatggagaagacggatatagagctgacatacttcaccgttctacttcatccagcaaaaaaagaaagttataccatggttgaatctgaaagacttagctacatcagaaacaaccaaaagaagcttagagttgacaagtattctagcttacaaagttcattggatactggaacagctaaaggcttaaccaaaggaaaaagagtcatcttaccttcaacgtttgttgggagcccacgttatatggatcaactttactttgatggtatgacaatatgcagtcatgttggtttctga

SEQ ID NO: 60332 - DNA, 207 bp, Glycine max
  Peptide Sequence Number=SeqID_152017
atgtcagtgaaaaacctcgtagggtgcctaggagtacatgacaagacagatcacgcactgggagaccagtcaagatcatgttgttttgcgagaatgcttcaatcatgtgggattgatacaggcttaaaggagtactcaaattgggtgtatttacccccaaggcctagactccgaagagttcgtcaggacctttccctcctgatttag

SEQ ID NO: 60333 - DNA, 387 bp, Glycine max
  Peptide Sequence Number=SeqID_152018
atgactcgttgttcccagaatttcacaaattgcctaatgatgggtgccaagcacctcacaaggaccaaagaaaggtcgcatgtcatcaagcaaagagtcgcgggtgaccatgacttgtcgttcccggattttcacaaattgcctaatgatgggtgccaagcacctcacaaggaccaaagaaaggttgcatgtcatcaagcaaaggtccccggacgaaaattagggtatgacactaatttcgctcctctcggtcgacgagagtcgcgggtgaccatgacttgtcgttcccggaatttcacaaattgcctaatgatgggtgccaagcacctcacaaggaccaaagaaaggtcgcatgtcatcaagcaaaggtccccggacgaaaattag

SEQ ID NO: 60334 - DNA, 358 bp, Glycine max
  Peptide Sequence Number=SeqID_152019
tgttgaatttaaaaagaacttattccatgacaaaattgtagaaacagaagagctttttaagaggtggaatgaatatcttttcagcacacgattaagggtcagccaaccaccattgatcaattgtgatttttgtggaggagagcattacaatgacaattgtcatctctactcgatgaatgactcttggtgggaacaggagttaagtccttacaatcaatatgaagaagaaagaactcctaatcttgaaagagtgtttgaggaattcatggcataccatgctagctcaaaagccaatcaaaattcaatgaaaaatcatgaaattcattttgacaagagctactcaatagaaaacttttaa

SEQ ID NO: 60335 - DNA, 264 bp, Glycine max
  Peptide Sequence Number=SeqID_152020
atgaggccctatctgtacggggaggtcgatctctcccctcacctcttggcggctgccgtcgaaggcacggaccaccatggaacttggcctagatgggaagtgttaaacggaaatttctccaacgtgcttttgggcatcacgttcaaattggagccgttatcaatgagtactttggccatgacgtggtccatgcatttgactgaccatgcaaagccctgttatgtcctctcccctcggcagggatttcctcttcagcaaaggtga

SEQ ID NO: 60336 - DNA, 381 bp, Glycine max
  Peptide Sequence Number=SeqID_152021
atgaagacttcccccttgtacataaagcatgaagatctgtctgaaatagcactcagtggtctcagcatctctgtcatacagttgtggattctgcatctaactgagacaagtatgcgagcgagcaattctgatgtgtatggattcctcaagccacagtccatccagagatctgagcaattgcaatttgaatcagaaagttacaagaagaactggatgcagaattcaaaacgggatgtctacctaggagcctacctgaatgggccagacaactaccttaaaggaataattaacagtgctttgaaaggacttgacgatactccacaagctaaatccaaggctggtgttaggtggatcgttgttaaattaacgtttaatatctaa

SEQ ID NO: 60337 - DNA, 1317 bp, Glycine max
  Peptide Sequence Number=SeqID_152022
atgggacccctccaaaggcaagccttccgcaaagtgtacgggaagattctagatttggccgcagcggaggtatttacggaagctgtcgtatccctcgcccaatactacgaccagccgttgaggtgtttcacgtttggggacttccaaatggtaccaactattgaagagtttgaggagatattaggatgccctcttgggaggagaaaaccgtatcttttctccggccttcttccatccttgagcaagattacagctgtgattggagattcagcgaaagaattggatcgcatgaaacaaactcgcaatggaatagtgggtctgcctcagaaatatttggaaggcaaggcaagagatgtggcgagtcaagagaagtggggcccgtttgcggatgttttagctttgttgatttttggggttgtcctctttccgaatgttgacggtttgatagacttagccgccattgatgctttcctcgcatatcaccatagcaaggaaagtccagtggtggctatcttggcagatttgtttgacacctttgaccggaggtggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccattgaggaaagacaaggagcttaggggcatccgaaacggcgtcattggaggttatcatgggtggctaagaattcacacgcggggcttaggttggctctccaaattgaaagttgtcgatgaggagaaattcgaagctccggaggaagatgaagaagtccgagctctaaagttagagctagggaaggcgagactcgccaaggagaagttcaaatcagctgctacacacatccggaaggagtgcactgagttacaagaggaaaacgtggccactgcaagagctcttgaacaagaaaccaaaagggcccgcaagggggaacatggccgagaaaaattccgaggagcattgtggggtagcaacaatgagctcaagctccgaagagaggagagagatcggtcacgggtgcatggcatgatcttaaaagaagagttagttgcttgcgcaaggtccaaaaggagtttggctcaacacttggaagccacggagcaaagcatgctagccatcatagggcaatacaaggaagaattgaaccagtccatggcccatgaacaaaagctagtggaggattttgcacaagtgtatgccgaaaaagaagcaagagggagg

SEQ ID NO: 60338 - DNA, 707 bp, Glycine max
  Peptide Sequence Number=SeqID_152023
tgagtgaatattctctggagggtgttttgattaagtcagcgctattggttctggaagacggaacccagtttatcggtcgggccataggggcaacgggttcggcggttggggaagtcgttttcaatacttcaatgaccggttatcaagaaatcctcactgatccttcctattctcgccaaatcgttactcttacttatcctcatatcggcaatgtcggcaccaatgctgctgacgaagaatcttctcaggtacatgcgcaaggcctggtcattcgcgacctgccgctgattgccagcaacttccgcaataccgaagacctctcttcctacctgaagcgccataacattgtggcgattgccgatatcgatacccgtaagttaacgcgtctgctgcgcgagaagggtgcacagaacggctgcatcatcgccgccgactcgccggacgccgcgctggccctggccaaggcgcaaggtttcccggggttgaagggcatggatctggcgaaagaggtcaccacccaagaggcctacagctggcagcaaggcagctggacgcttgaaggcgacctgcctgaagccaagacccccgcggaactgccgttccacgtggtggcttacgactacggcgccaagcgcaacatcttgcgcatgctggtggatcgcggctgccgcctgaccgtggtgccggcgcagaccccggccgacgag

SEQ ID NO: 60339 - DNA, 360 bp, Glycine max
  Peptide Sequence Number=SeqID_152024
atgaggggagcgccgactgaagaaagtctctcgcctttccttgtgagggatctaggcgtgcaaggtctcaaggttatacaaagaatccacaaggcgtggaggagtccgttgaggaaagacaaggagcttagaggcatccgaaatggcgtcatcggaggttatcatggatggctaagaattcacacgcggggcttagattggctctccaaattgaaagttatcgatgaggagaacttcgaagctccggaggaagatgaagaagtccgagctctaaaattagatctagggaaggcgagactcgccaaggaaagaatgtaccgagttacaagaggaaaacgcggccactgcaagagcccttga

SEQ ID NO: 60340 - DNA, 390 bp, Glycine max
  Peptide Sequence Number=SeqID_152025
gaactcgatctcatcgaagagagattgagagcggttgaaggctttagcgactatccgttcacagacatggggcgacttgtgatgcaatcctaccccgcaagggcattggatagaagactccaagtagattgggtcagagatccaagggaaggccctagggttctcatgagccttaggagtcttgtgagattgtcgcaacatgcccttttggcgggcgaggcgaaggcgaggctcatgggtgcgctttccaaaggaggaaagatgcacggagtcgccaccaacgaaggtattagcacctctcacgtcgacaaaagcggggcttttgctgctacgtaccctcctttggagaggaaatcagacctacgtagttctttcttatgcgtgaatcaa

SEQ ID NO: 60341 - DNA, 177 bp, Glycine max
  Peptide Sequence Number=SeqID_152026
atggctcaaggcttacgtagcaatgctagacatgatacatgtcagggtttgtcttttatcaatttcgtgcattctaaatccgagtccatttcgggcgtctgggaaaatcttcagaagcaaatctacccttcaggtgtatcatccacactttcggcacttatgggttttggcttttga

SEQ ID NO: 60342 - DNA, 531 bp, Glycine max
  Peptide Sequence Number=SeqID_152027
atgggtcaatcatttgcttcattggtttcaacggtggcagctgcggaatccgctattgggttagccattttcgttatcactttccgagtccgagggactattgctgtagaatttattaatagcattcaaggtaagactttcaaagtgactctcgacgggagaatccaggctattcaggaagaatcgcagcaattccccaatcctaacgaagtagttcctccggaatctaatgaacaacaacgattacttaggatcagtttgcgaatttgtggcaccgtagtagaatcattaccaatggcacgctgtgcgcctaagtgcgaaaagacagtgcaagctttgttatgccgaaacctaaatgttaagtcagcaacacttccaaatgccacttcttcccgtcgcatccgtcttcaggacgatctaggcacaaagtttcacttattagttaggaggagattttgcccccagtgtatctcgaaagcagaaaaaatagaactcattcgagagagcttggtggtcttaagaatggttcgg

SEQ ID NO: 60343 - DNA, 177 bp, Glycine max
  Peptide Sequence Number=SeqID_152028
atgtggcattggggtatagggttttatagacggccttgtttgagccgaagtgaatttattatttatttagaaaagttttatgatgatgttagaaaggtgaattacatatatgcgtggggtagagggtgtcacaaggaggaggaggaggaggaggagaggcaggtggagaagccatga

SEQ ID NO: 60344 - DNA, 234 bp, Glycine max
  Peptide Sequence Number=SeqID_152029
atgggggttcaaatagaaatcaggcccacttgggccttccagaatattcctccagaaggcggttgcttctggaggaagcaaccgagctcgcctgggcgagttggaaaatccaagccgaggcgcttccgtaacgtttccgtggttgatttcgcgaagattttcaaccgttcttcgacgttcttcgttcattcttcgtcgttcttcggtcttcaaccaatttctaaaaaagcctaa

SEQ ID NO: 60345 - DNA, 348 bp, Glycine max
  Peptide Sequence Number=SeqID_152030
ggattgcgcccacaaagatacccagtggacccggagaagtccaacagggccctggggtttccagctctgggatcgcgcctgcaagacacccagtggacccaaagaagtccagcagggtcttggagttgtcaaactctaattacgggtctctgtcagttctacggagtgtctgtcacctccaacaagggcatcaggccccctactaatcgagctttcatcaagaagtactgcgcccccaggcaggcacagggcgaaacaccacagcagcctggggatggccaacaacgggcaacagacgcaccaccatcacctctagagttcaccccagctcatccacaaaaaggttag

SEQ ID NO: 60346 - DNA, 282 bp, Glycine max
  Peptide Sequence Number=SeqID_152031
atgtatgttcaagaagaggatagattgataatggaagagagtgaaaaggtaaatttgactacttctacttttggaaaggataggaaaaagtctgtaggcaccaataaaggaaggattcccaaccaacaaggtatggaaagcctaaggaagccagtgggaagtgagcagtgcatctactcagggagtaggatgagctcgcatgtagaggccattggaacgtgcgtcttagttttaagtagtggctttaaattacatttggagaaagttcttttatgttcctag

SEQ ID NO: 60347 - DNA, 450 bp, Glycine max
  Peptide Sequence Number=SeqID_152032
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggcctttgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 60348 - DNA, 590 bp, Glycine max
  Peptide Sequence Number=SeqID_152033
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattgatgatgctgtgagaagaatcttaagagtaaaatttgtcatgggcctatttgagaatcctcatgctgatataagcctggtgaaccaacttggtagtgaggagcatagacagttagcaagggaagctgtaaggaaatcacttgtgttgctaaagaatggtggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 60349 - DNA, 473 bp, Glycine max
  Peptide Sequence Number=SeqID_152034
atggcgcctaccaggcaccctctggacccagataagtccaacagggccctggggtttctggcgctgatcacgggcctctgccagtccttcggagttcccatcacccccagtaaaggtgatgcacatcaggccacagatgcaccgccaccacctcggcaagccgatcctactggatcactaggcatggagcgctatctacgacatttggttcgccagcaggcggccaaccaccatggacaggtgcaaatacatgagtgtctctaccggttcagcctcagtcagcaggggcaaggttccaccccttttgcatgccctactccggagcagtttggggctgaggttgcatggcctggagactggcccgaggcccaggcagaggaggagcctgcaggatccctcggtgaggcagatgagtcccatatggatgaagagatgactgacctgctcagtttcttgggagggagaggagccac

SEQ ID NO: 60350 - DNA, 299 bp, Glycine max
  Peptide Sequence Number=SeqID_152035
gtgtggctggaggagtaggagccaatccaggtgcttgcactgtagggtcatcagatataataataggtgtagatgggagagctgcttctggagcgggagaagatggatccaccactggagatggtggatcagctggtactggtgatgaggacatgaccaagagcaagggcaaggatacacttgaaggacttggaggacctatgacaaggactagagcaaggaaagcaaaggaagctcttcgacaagtgctgtccacactatttgaatacaagcccaagtttcaaggagaaaagtccaag

SEQ ID NO: 60351 - DNA, 495 bp, Glycine max
  Peptide Sequence Number=SeqID_152036
ggcctgggatttcccgcgctgatcacaggactctgccagtcgtttggagtccccgttacacctaccaaggtgattcggccgcccatcacccgggcttttattgagaagtactgcacccagagacaggctcaggaggatgttccacaggccgcgggcgcgccaccaccatctcatcaggctggcccggctgggtcatttgacatggagcagtatttacggcatttggttcgccagcaggcggccaaccaccgggcacatgtacagactcatgattgtctgtaccagctgagcctcagcatgcagagccagggcttcgcttctttttcatgccctactctagaccagttcagggcagaggtcgcatggcccggggattggcccgaggcccaagcaggaaaggcgcccccagaagctcccggcgttggagaggaggcccacgaggacgaggagatggccgatttgcttgacttcttgggagggagtggagctacatga

SEQ ID NO: 60352 - DNA, 204 bp, Glycine max
  Peptide Sequence Number=SeqID_152037
atggaagatttggtaacctattggaggctcccaaatcaaatgaataggcctaaattattgttacaaaacttgaaagcaatgaagggatggccaatcctccttccattccctatatggcaaccacaaacaaggaaacaaggagacaagcataactcaaagaccaaacaaaaacaaagaaatgaaagcaaacaaatggagttttaa

SEQ ID NO: 60353 - DNA, 918 bp, Glycine max
  Peptide Sequence Number=SeqID_152038
ggccaggtgctggcgtccgagcagatcagcctgttcggcctggtgctggcaccgaagaaaccggtccattacggccgcatcgcgccgggcgaggcgcatgacatcttcgtgcgccaggcactggtgaccggcgagatcaatacccgcgccagtttcgtcgccgacaaccagaaggtgctggaggtcgcgcgcgaggaagaagccaagctgcgccgcgccggcatcgtcgccgacgaagactggcaggcacgctggtacctggaccgggtgccgccgcagatccattcggcctccggcctggatgcctggtggaagggtcttgcgccggaacagcgcaagaccctgcactggtcgctggccgacctgttgccgggcgaaggcagtgagcaggagcgctacccgaagtacctcgcgctgggccaggcacgattgccgctgcattaccgcttcgagccgggtgccgacgacgatggcgtgaccctggatgtgccgctgcatctgctcaatgccctggacccagtgcaactgggttggctggcgccgggtttcgtcgccgacaaggcctctgcattgatccgcagcctgcccaaggcgatgcgccgcaactacgtgccggcgccggacttcggccgcgcgttctacgaggcgttcccgcagcccagcgccgatgccatcaccggcgaactggcgcgtttcctgtcgcgcgcaaccggcgcgaccgtgaccgcgctcgatttcgagcccggttcgatcgaaccgcacctgcacatgaacctgcggctgcgcgacgagcagggcaaggtgctggcgacctcgcgcgatctggatgcactgcgcgccaaattcggcggtcgtgccggcgatgcgttcgctgcacgcgccggccgcgagatggcggccgatggcgggatcctctag

SEQ ID NO: 60354 - DNA, 150 bp, Glycine max
  Peptide Sequence Number=SeqID_152039
atggaaaatgctaagcacatggctacaccattgagcactgcttgttatttagataaagatgaaaccagtcagtcaatagatgttaagcaatatcaagattacaatcaaatcccaaacaatcacatcttagtgccgttaaaagaatcataa

SEQ ID NO: 60355 - DNA, 174 bp, Glycine max
  Peptide Sequence Number=SeqID_152040
atggcagaggctagaaaagtgcaagaaaatgaactgcgttttctggaaaacgcgatcaactcgctaagtgagcatgctgcgctaagcgagttcatcaatactcattgtgtatataggcattctaggaagaacacgctaagtgcgcctgccgcgctaagcgagttcatcttttga

SEQ ID NO: 60356 - DNA, 300 bp, Glycine max
  Peptide Sequence Number=SeqID_152041
atggtaattgattaccagcagtttattcaaattttaaagcctgtgattgattacacaagtcttgtaatcgattaccagaggagattttcagaaaataatttccaagagtcacatctattcaaatggtttatgaatggccatcaaagaggattcttgaacacaagggaagggttgtccctgcgtggttcagactttgtaaaaggagttttacgaagaaagtggaaaatctcaagtcggttgcttgaggactgtaggcacgggaattggccgaatcaagttcgcattcctctcttcccttaa

SEQ ID NO: 60357 - DNA, 162 bp, Glycine max
  Peptide Sequence Number=SeqID_152042
atgggtgccaagtacctcgaagtggtcaaacgagggtcgcatcccaacaacggatggtccccggatgaaattaggacacgatcgcctctggatggcgaaaaaggtgtgcggaatgaccataatttgtccccgctcgcctctcaacttgctatttttgaatga

SEQ ID NO: 60358 - DNA, 1260 bp, Glycine max
  misc_feature (61)..(61): n is a, c, g, or t
  Peptide Sequence Number=SeqID_152043
atggcgagccaagagaagtggggcccgtttgtagatattttagctttgttgatttttgggnttgtcctcttcccgaacgtcgacggtttggtagacttagccgccattgatgctttcctcgcatatcaccatagcaaggaaagtccagtggtggctatcttggcagatttgtgcgacacctttgatcggaggtgtgagaaaaacagtgcacggattgtctgttgtttacccgctctgtgtgtgtggttgatttcacacctattccaacaagacatgagacacccgtgtccgcttcaaagatatctctcatgcgccgaaaaaggaagagtcgattgggaccaacatttggctgggatagggggcagcgcgatcaattggttttctcgttggaaggaaggcaaggaaggagttcttttctcatgtggggactaccctaatattccattgatagggactagggggtgtattaattataatcccgcactcgccataagacaactagggtaccccatgaggggagcgccaaccgaagaaagtctcttgcctttccttgtgaggaatctaggcgcacaaagtctcaaggcgatacaaagagtccacaaggcgtggagaagtccgttgaggaaagacaaggagcttaggggtatccgtaatggcgtcatcagaggacttcgaagctccggggaagatgaagaagttcgagctctaaaattagagttagggaaggcaagactcgccaaggagaagttcaagtcagctgctacacacatccggaaggagtgcaccgagttacaagaggaaaacacggccactgcaagagcctttgaacaagaaactaaaagggcccgcaaggaggaatatggccgagagaaattccgaggagcattgtggggtagcaagaatgagttcaagctccgaagagaggagagagatcggtcatgggtgcatggcatgatcttaaaagaagagttagttgcttgcgcgaggtccaaaaggagtttggctcaacacttggaagccatggagcaaagcatgctaactatcatagggcaatacaaggaagagttgaaccagtctgtggcccataaacaaaagctagtggaggattttgcacaagtgtacgccaaaaaagaagcaagagggagggtgattgatgcattgcatcaagaagcgactatgtggatggataggttcgccttgaccttgaatggaagtcaagacctcccgcgtctactagccaaagcgaaagccatggccgaa

SEQ ID NO: 60359 - DNA, 330 bp, Glycine max
  Peptide Sequence Number=SeqID_152044
ggccgaaaggagaaggaaacttctgcaagacagaacagttgcatccattcttgaggaggagactcatttctccgacttattatcacctgattcaccatcatcaagggaacctgccactcaattacctaaagccattaccatggcaaaagagcatgaccagaggattacccttgaggattattcaagtagtttagattacctaatgaagaccccctatgcacacttggcaacgttcattgaaatatgtaacactgttaagattgccggtgtaccagatgaagctattaggctcagccttttctcattctcattggcaggagaggccaagag

SEQ ID NO: 60360 - DNA, 573 bp, Glycine max
  Peptide Sequence Number=SeqID_152045
atggattccctcatcattagacttctccgcgtgcctcatgtatcgaaggatgaaaatcctgctgatagtatggagacgtcagccatggttgcatctcgtggtagaggaggcggctgcaacagtagaagaggtcgcagtggaaggggtggatgtcctcattgcacctactacaacaggatgggtcacacccaagagaattgctatttgttgcatgggtttcccgacaaggtcacacatgtttctagatcagagaaagcagagtttagattctttgatgaggagtatcaggagtatttgaagcttaaattcgagaaacccagcaaccaagctcaatcctcatctgtaccatgtttttcaacagcatgtatctctcaatccattgaaggtcctagtccttggatattcgactcaggtgcctttgatcatatttatggtaataagtcctccttttcatccttttccattctaaaaattcctcacattgttactgtagctaatggctccaaggttgcatctcaaggaagtggtcaagaacatgggacggggcaattgattggagaaggacatgaataa

SEQ ID NO: 60361 - DNA, 570 bp, Glycine max
  Peptide Sequence Number=SeqID_152046
atgggacaattggctacacagttaaatcgacaacagtcccagaattctgacaagctgccttctcaatctgtccagaatcccaaaaatgtgagtgtcatttcattgaggtcgggaaagcagtgtgaatcttccactggtaattctgatttacagaagcagcatatccctcttccattccctccaagagcaatttccaacaaaaaaatggaagaggcagagaaggagatcttgaaaacatttagaaaagtagaggagttgtgcactaataagcggaagcttaaaggaagtgaaataattagcatgggtagaaatgactccgcattgattggtaaatctgttcccgaaatccctgaaaaatgtaaagatccaggcacactatctatggagtttggtgatataactgttcattttaatattcttgatgctatgaaacacccatctgaagatctttctgtatttcgtgctgaaataattgaccatatagttgatgaatacatgaatgatcttcattctaatctgcatgcctgtcactcttcatgcattgaatctgaatttctagggatcctctag

SEQ ID NO: 60362 - DNA, 444 bp, Glycine max
  Peptide Sequence Number=SeqID_152047
atgacttgtcgttcccggaatttcacaaattgcctaatgatgggtgccaagcacctcacaaggaccaaagaaaggtcgcatgtcatcaagcaaaggtccccggacgaaaattactggattgcacccacaaagacacccagcggacctgaagaagtccgacagggccctggggtttccagctctggttacgggcctctatcagtcctacagggtgcctgtacacccccggcaaggtcacgtcatcatagggatcgcgcctgcaagacacccagtggacccgaagaagtccaacagggtcttggaggttctacggagtacctgtcacctccagcaaggtcatcaggcccccctaccaatcgagctttcatcaagaagtactgcgcccctggcaggcgcagggcgaaacaccacatcagcattgggatggccggtagtgggcaatag

SEQ ID NO: 60363 - DNA, 540 bp, Glycine max
  Peptide Sequence Number=SeqID_152048
atgggtgttcaggcccttgcgctggctggtggagcccaccaggcgctcatagaaggcgacgtcggcacgcaggccggcgatttcctcatcgcgctcggccagcgaggactgcacctcggtgttggcggcgcggctgatgcggtcggaggcttccagcgtggcctgcttctggcgcaattcggtcagctgcgcctgcaacgtctcggcacgcttctcggcagcctgcaggcgctggccctgggcgtcgcgcggcgtggccatccagcagccacccagcacggccagtaccaggctgagcagccagatgccgccgatcaccagcaggcggcgacggtcggccggtggttgtggtgcgccgggcaggcggacctgcacgcgcatgggaggacggttggtcatgggtggattccggggcatcgcgagggcgacaccggtacggcccctgtggcaaacgacgcgctagtgtatgacaggacgggtgggtttcctgcgcagtggcgagccacggtctgtggcgttcaggcatgccatcgtcgatag

SEQ ID NO: 60364 - DNA, 241 bp, Glycine max
  Peptide Sequence Number=SeqID_152049
agggagggggggggggggggcgcgcgcgcgcgcgcgcggcgagagagagagagagagagagagaggaagtactgagtgcggctactatgtgatgcactggatgtccaccatcattttaggaacttttaggaataattgggaagcgtattttaacgatcctagaccattggagtcagagagattaacagcattgcggatccagtgggcacagttttatctccgagttagagatcaggcctag

SEQ ID NO: 60365 - DNA, 621 bp, Glycine max
  Peptide Sequence Number=SeqID_152050
gcttttcgtcttacagacagcaataaagaatgttatacggataaccactcgggtttttccgcccgtcagcgtgactcaaatgtcagtatgacagatcttgtgagcgcggaagatgacgtaaatctccgcatgtcaacgggcttgtcggccgcaattgacgaagggcgcagaagacgacgtcagactctgcgtgctatcaggcttttcgccttacagacagcaaaaaagaatgtttatacggataaccactcgggtatttccgcccgtcagcgtgactcaaatgtcagtatgacagatcttgtgagctcgaaagatgacacagcaataaagaatgtttatacggataaccactcgggtttttccgcccgtcagcgtgactcaaatgtcagtatgacagatcttgtgagcgcggaagatgacgtaaatctccgcatgtcaacgggcttgttggccgcaattgacgaagggcgcagaagacgacgtcagactctgcgtgctatcaggcttttcgccttacagacagcaaaaaagaatgtttatacggataaccactcgggtatttccgcccgtcagcgtgactcagatgtcagtatgacagatcttgtgagcgcgaaagatgac

SEQ ID NO: 60366 - DNA, 177 bp, Glycine max
  Peptide Sequence Number=SeqID_152051
atggtggtggtgacactgacaacaatggtgggatggaatagtggtaataacgatggtggcggtggtggtgaaatgatgatggtaatgataatagcgatagaatgtggtaatggtggcgacaatgacaatggaggcaacaaaatggtggtggtgatggcagtaatagatgtgggatag

SEQ ID NO: 60367 - DNA, 518 bp, Glycine max
  misc_feature (479)..(479): n is a, c, g, or t
  Peptide Sequence Number=SeqID_152052
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgntgagccttatccggtaactatcgtcttgagtccaacccg

SEQ ID NO: 60368 - DNA, 489 bp, Glycine max
  Peptide Sequence Number=SeqID_152053
gtgatggctccaaagaaccttctctctaagagggcaaggaaggaggccactgaagaagggtccagtgcggccccacaagaggatatggaatttgatggacaccggttccgaagtgaggaacaccaatgctattttgaagcaatcaagagttggtctttcctcaaggagagacaggtccagttgagaaagggagcatatgctgagttccaggaggaaattgccaggaggcaatggactcaactcgcaggtcccatggctaagtatgatccggaaatagtcatggagttctacgctaatgcatggcccacggaggaaggagcctcgaggtttgatgaggaggtcattggccagttgctatgcatttcagggcaggactttgcgcgcagcgtgacagggagacgggtgcagatcatgcacactagcatgaccaccctgacacagatctgggatgacactgcatctcagcaacatcctccccagcgatcataa

SEQ ID NO: 60369 - DNA, 716 bp, Glycine max
  Peptide Sequence Number=SeqID_152054
gcgaatgggcttcttttattgacatcttggcgcttttgatctttggaggtatcctctttccgaatatggaagggttagtggacctagcagcgattgatgctttcgtcgcctttcatcatggcaaggaaatcccggtcgtcgccattttggccatgcatgacacgttcaatcagagacgtgaaaagagcggcgcaagaattgtttgttgtacaccggctctctatgtgtggctggtttcgcacccttttttttccaagaaggtaggctcgtctatccgctacaaggtcaccgctcgaaggaagaatcgggattctatcttcatgcgaaggatttccaaatgttcccttaatgggaacaagggaaaggacagagagcttaggggaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccggctgaagccttggaacgagaaaccaagaaggcccgaaaggaagaacacgaccaaaacaagttttgaggggctttatagggcatcaatagtgagctcaagctctgaagaggtgaaaggaatcatcacgggtcaaaggcatgatctggaaggacgagctaaaggcttgccttcg

SEQ ID NO: 60370 - DNA, 321 bp, Glycine max
  Peptide Sequence Number=SeqID_152055
atggtttccttgaagaagagttggtacatagatagcggatgctctaaacacatgacgggagatgcatcaaaattcactcagatttctcccaagaaaagtagacatgtgacttatggcgacaacaataaaggtagaattcttggagtcagaaaaatagaatctttagaggaaatgcatattcatggagaagatcacaaagacaaaggagatggaaataatgaagattttgacattgatgaaataaaaatagatgttgaaattccaagagagtggagaacttctagatatcatcctcttgacaacattattggtgatatataa

SEQ ID NO: 60371 - DNA, 219 bp, Glycine max
  Peptide Sequence Number=SeqID_152056
atgcctataggttggacctcccagaagagtggagctgatattgaggaggaggaactaacagatttgaggtcaaatcctcttcaaggggaaggggatgatgcaatcctccctaggaagggaccaatcactagaaccatgagcaagaggctccaagaagattgggctagagctgctgaagaaggccctagggttctcatgaaccttagggtagatttctga

SEQ ID NO: 60372 - DNA, 213 bp, Glycine max
  Peptide Sequence Number=SeqID_152057
atggccgctaaacccttcaacgacttaacttttggcggccagcacatccagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60373 - DNA, 664 bp, Glycine max
  Peptide Sequence Number=SeqID_152058
gatccccggtactagtaccctcgcctctagaggactacacgtcctcaccttcagagggcttcacgtccttgccttcagagggcttcacgtgctcaccttcatagggctacatgccctcaccttcagaggacttcacgtcctcgccttcatagggctacatgccctcaccttcagaggactgcacgtcctcaccttcggaggactacacgtcctcaccttcggaggactacacgtcctcaccttaagagggttgcacaccctcgccttcagaggattgcatcccctcaccttcagaggactacacgtcctcaccttaagagggttacacgtcctcgccatcagagggctacacggctacaagtcctcaaacatcagaggactacacgtcctcaccttcagagtgctacacgtcctcaccttcagagtacttcacatcctcaccttcagaggactgcacgccatcgcctttagagggctacgcgtccttactttcagtgggctccatatccacgccttaagaggatttaagggagaccaactgtgcgagcatgaccagagagggaggcagctactatgcataccggggcaagatttcacccgtgccattgcaaagaagcgagtgcggatcatgcgcaccaacatgaccactcttacacagatatag

SEQ ID NO: 60374 - DNA, 513 bp, Glycine max
  Peptide Sequence Number=SeqID_152059
atgtataatctaatgtttgctttcacatctcgtggtatcaaatatgacacatcctataacactggaaagggacctccaactttccgtatacatggccaaacacatcatcttattggcagcctcctccctatgcctaataacccacctaagtttgcacaactatatatttatgatacagacaatgaaatcatcaacagactttcacaaaatcccatgcacgatatgcttgatgaacagattatcattgcaattaaagacatgctcgatcatcacaatcattatgcccaaaagtttatgatggctagggacaaattgcaatctgctacacttccagacctaaagataaaattgattagtcaaaggcaaacatacggaaggttgtataacttaccaacaaccattgaagttgctgctttgattgttggtgatgaacactcagctgataaaagagatatcataatagaaaaacaatccggacttctgaagagaatacatgaacttcatcctgcataa

SEQ ID NO: 60375 - DNA, 244 bp, Glycine max
  Peptide Sequence Number=SeqID_152060
tgttttaaaaggtcttcatgatgctccacagcctaaatcaaaggctcctgctaggtggattgtcttcaagtgtaatagacaaagaggaagtactgagtgcgactattatgtcatgcactgcatgtccaccatcattttaggaagtttcaagaataactgggaagcgtattttaacgatcctagaccattggagctagagagattaaaggcgctacggattcagtggccacaatattatctctga

SEQ ID NO: 60376 - DNA, 426 bp, Glycine max
  Peptide Sequence Number=SeqID_152061
tgtttcgtttctaaacgaccatttagaggaaacactgggtccaacaaaatagaagaaaataactcaaagtgtatcaatctcacacaggaactttctttgttctggaagcgtgttagcagctcaatagtgaatgactttttttcttgggagaccccattgttccttcttccgaggacagggatggaaattctcatcctgggtcaaggtttatggtggtttgaggtcttgggtcaaaaggcttgcagaacgaccgaacatgatgtatgtcagggtgttggtttggccagcggttcagggataaaggggatgtcccatatttatttccatgacacacatacaacaatgatgatttggaaattttatgcaaaactggtcatgcatgcacccatgtggacactcaagcgtcaagtttttatggtcatgtga

SEQ ID NO: 60377 - DNA, 156 bp, Glycine max
  Peptide Sequence Number=SeqID_152062
atgaagatgctcttgataccacatgatgtagctcctatggagctttttgatggcagcagaatggagaaggagaaatatgattggagacgccacttcaagaagaagatgagtctagaagaagctcaccaccatatgaagccatggataagagcttga

SEQ ID NO: 60378 - DNA, 272 bp, Glycine max
  Peptide Sequence Number=SeqID_152063
caattaaaacgaagccaaagggttacatagaatctgattatgtacaagatgatgtgccttaccaagttgaggaaatgtcacatgtcaacaaagtcattgaagttgaaagtatttctagattgcaagatttaagaggtaatgttgaagaagtaaaccctggtaatttgttgacaaatgaagaagaatcaaataatttgaatggagaatcgaacaatattgaacaagataatgaaggggaattagaagatgactttgaagttttacaattctga

SEQ ID NO: 60379 - DNA, 198 bp, Glycine max
  Peptide Sequence Number=SeqID_152064
atgtatatgtgtggtgaatggaatgttttgaatatccttgaaatggccccgaggaagctcccctcaaagagatccaggaaggataaggcgggcgaaggaactagttccgctcccgagtatgacagtcaccgctttaggagcgctgtacaccagcagcgcttcgaggccatcaagggatggtcatttctccgggagtga

SEQ ID NO: 60380 - DNA, 804 bp, Glycine max
  Peptide Sequence Number=SeqID_152065
atggagaggagtatgattgttgctgccagtggtggagctcttagtgatatgacccctgttgaggctaggaatttgattgagaagatggcttccaactcccaacaattcagtgcaagaaatgatgttattgtccttagaggagtccatgaggtggccacagattcatcttcatctgctgaaaataaaaagcttgagggaaaacatgatgccttggtcaacctagtaactcagcttgccatgaatcagaaatctgcatctgcacctgttgtaagagtctgtggttggaggaatcatccaaatctgagatgggcaagtcctctacagcagcaacaacagcagcagcaacaaagacagcaagcaactgaggttgctcctcaaccttccttagaagacacaaaagcctctattcagagtctgacaaatcagatggggcaagtggctactcagttgaaccaaactcagtcccaaaattctaacaaattgccttcgcaaactgtgcagaatccgaaaaatgtgagtgccatcaccctgaggtctggcaagcaaactaaagtgcctccactagtagcagcacctgcacctgaacctgttaagcttcattctacacctgaaaaagaggatgagatagttgcacaaaagagaaagcttcctaacaaaaattttcatgcaggtggaccttcttccagtagttctgacttacaacagcctcctatccctcttccattcccacctagagcaattccaaacaaaaagatggaagaagcggaaatggagatcttggagaccttcagggggatcctctag

SEQ ID NO: 60381 - DNA, 174 bp, Glycine max
  Peptide Sequence Number=SeqID_152066
atgaggagatttttggttgatagagcaagtattgagaatgtgaatgttgtacaacaagaagccgaattagaaccgccacctaatgtggttaatgagtttaacccaaatgagattgtgcgtgatccaggtcataggaaacaaattaatgagtatgctctggatattcaagatcaa

SEQ ID NO: 60382 - DNA, 393 bp, Glycine max
  Peptide Sequence Number=SeqID_152067
atgttttttaaatatggtattgacaatgtctttgtacataggtttcagccaacatatgggtgttctaatatcatatcaaatatcattagggcaaaatttgatgaaccagctccaagttggttgaaggtgtcagttgacctttgtgataggtggtttggagagtttaagttcttgtttcatattttatgcagaaagagtatagatgacactcacaagaagagcgagccattagagctgtttttgagacaaaagaggagtgatgtaagctccattggagcttgtaggcctaggatcttcttcattaatagattcctttgcttcttaaaagatgaatggcagcggaatggagaagaagaagagttgagaggagacaccacttcaaggagaagatga

SEQ ID NO: 60383 - DNA, 2259 bp, Glycine max
  Peptide Sequence Number=SeqID_152068
atggctacccatatttgtctctctctttgcttcttctacatcacaacctatcaccttgcaatttccacgttggctcagtctgacaactatatcatccacatggacatatcagccatgcccaaagcattctcctcccaacacacttggtatctctccactctctcttcagcattggacaattccaaagccaccagcgataatcttaactctgttattaactctaagctgatttacacctacaccaatgtcatcaacggtttcagtgcaaacctgtcacctaaagagcttgaagctctcaaaacctccccgggttacgtttctagcatgcgagatttacgtgccaagcgtgacacaacacactcaccacacttccttggcctcaaccccaatgtaggggcgtggccagtgtctcaatttggcaaagatgtcattgttggtttcgtggacactggaatttcgcctgaaagtgaaagcttcaacgatgagggattgactaaaattccttctcgatggaaaggccaatgtgaaagcactatcaaatgcaacaacaaactcattggagcaaagttcttcaacaaagggttgctggcaaagcaccccaacaccaccaataatgtttcttcaacgcgtgacactgaaggtcacgggactcacacatcaagcactgcagctgggagtgttgttgaaggtgcatcatactttggctatgcttctggatctgccacaggagttgcttcacgtgctagagtggccatgtacaaggcattgtgggaacaaggagattatgcatctgatataatagctgcaattgatagtgcaatatcagatggggttgatgttctttccttgtcatttggctttgatgatgtacctttgtatgaggaccctgttgctatagccacgtttgcagcaatggagagaggcatttttgtgtccacgtctgcaggaaacgaagggccattccttgcagtgcttcataatggaataccatgggtcataactgtggctgctggcactttggaccgtgaatttcagggtactctcacgcttggaaatggagtccaagtaactggcatgtctctctatcatggaaacttctcttccagcaatgttcctattgttttcatgggcttgtgcaacaaaatgaaggaactggccaaggcgaaaaacaagattgtggtgtgtgaagacaagaatggaactatcattgatgctcaagtggctaagctgtatgatgttgtcgcggctgtgttcatttcaaacagctccgagagttcttttttctttgaaaatagttttgcatctattattgtttccccaataaatggggaaactgtcaaaggttatattaagagtactaactctggtgctaaaggaaccatgtcttttaagaggacagttttgggcactagaccagctccgagtgtggatgattacagttctagagggccttcaagtagttgtccatttgtgttgaaaccagacatcactgctcctggtacatcaatcttagctgcatggccacaaaatgttccagtggaagtgtttgggtcccataatattttcagcaacttcaatttgttaagtggcacatcaatggcatgccctcatgttgctggtgttgcagcattgttgagaggagcacaccctgaatggagtgttgcagccattaggtcagcaattatgacaacatcggacatgtttgacaacaccatgggactcatcaaagacattggtgatggttacaaacaagcctctcctttagccttgggagctggtcatgtcaaccctaatagaggcctagaccctggactggtgtatgatgtgagagttcaagattatgttaatctcctctgcgcacttggctacacccaaaagaacatcaccatcatcacgggaacctcttcaaatgattgttccaaaccctctttggacctcaactacccttcttttattgctttcatcaatagcaacggttcaagtgcggcacaagaatttcaaagaacggtgaccaatgttggggaggggaaaacaatctatgatgccagcgttacacccgtcaaagggtaccacttgagcgttattcccaaaaagttggtgttcaaggagaagaacgagaagctgagttacaagttgacaattgaaggtccaacaaagaagaaagtggagaatgtcgcttttggatatctcacttggacggacgtgaaacatgtggttaggagccccattgtggtcaccaccctcaaattggatttctag

SEQ ID NO: 60384 - DNA, 93 bp, Glycine max
  Peptide Sequence Number=SeqID_152069
atggaggcacaggaagagagtgtgaggcctaggatctacagtcaggtttcagatctgcctaaaatcagttgggaggaggcaaagaaggattga

SEQ ID NO: 60385 - DNA, 483 bp, Glycine max
  Peptide Sequence Number=SeqID_152070
atggcctcaacctcttctgctctcactatatcctcttcttccacccttcttgatggcaaggctccaagacagtcaccagctgcttcccctcaatgtgtgagcctcccccctccccctttgcactctcagaaccgttcatggaagaccactgcttattgtcgcaaggttgctcgaaaagttatggcaatggccacaggagaggcaccagctgaagctaccccaactgaggtgccagagattgtcaagactcttcaagaaacttgggacaaagttgatgataagtatgcagtgagttcacttgccttggttggggtgattgcattgtggggctcagttggattgatctcagcaattgataggcttcctttgattcctgggattcttgagattgtaggcattggatacactggggtaagtgaagtatacttaattgctggcattgattacaccatttatgctcataacaatcggcaaggaatctag

SEQ ID NO: 60386 - DNA, 1065 bp, Glycine max
  Peptide Sequence Number=SeqID_152071
atggaagaagaaaaaagcttcacctatgcaatgcagctggtgaactctagcgtgctatccatggccatgcactcagccatagagcttggcatttttgacatcatagccaaagcaggtgaaggtgccaaattatctgccaaggacattgcagccaagcttccatgcaagaattcagaaggagccacaatgttggatcgtatcctaaggctcctagtatgtcactccatcattgactgcacagtggttgctgatcaacaacatggtcctcctccacatctgcaacggttctatgccatgaaccctgtggccaaatactttgcttccattgatggtgctggctcactaggccctttgatggtcttgactcaggacaaggccctccttcatagttggtaccaattgaaagatgcaattctagaaggaggtattcctttcaacagggttcatggaaaacacgtgtttgaatattccgacatgaactcgagcttcaatcagcttttcatggcagctatgacaaaccgtgcaactttaataatgaagaagattgttgaatcctacaaggggtttgagcacctcaatagcctggtggacgttggaggtggccttggtgtcacacttaacatagtcacttctaaataccctcacattaagggtatcaattttgacttgccacatgtcatagaacatgcctctacctatcctggtgttgagcatgtgggaggagatatgtttgaaagtgtgccacaaggagatgccattttgatgatgtgtgtacttcatgattggagtgatgaatggtgcttgaaggtattaaagaattgttatgcttctattcctagtgatggaaaggtgattgttgtggatggaattcttccatttgaaccaaagacaacaggtgcatcaaagagcatttcccaatttgatgtactgatgatgactacaaacccaggagggaaggagcgaagtgaagaggaattcatggcattggcaaaaggagctggatacagtggcattagattcacatgctttgtctctgacttatgggttatggagttcttcaagtaa

SEQ ID NO: 60387 - DNA, 1368 bp, Glycine max
  Peptide Sequence Number=SeqID_152072
atggccgccacaaaaccattgttaaccgacctagcctccaccattgatcgcgttccctctaacttcatcaggcccattggtgaccgtccaaaacttcatcaacttcactcctcccttgcttctattcccatcatcgaccttcaaggccttggtggctccaatcattcccaaatcatccaaaacattgcgcatgcttgccaaacttatggcttctttcaaattgtgaaccatgggattcaggaggaggtggtgagcaagatggtgaatgtgtcaaaagagttctttggtttgccggagagtgagaggctgaagaatttctctgatgacccatccaagacaacaagactctccaccagtttcaatgtcaagactgagaaagtttccaactggagagacttcttgagacttcactgtcatccccttgaggattacattcaggaatggcctggcaaccctccatctttcagggaagatgtggcggagtatagtagaaagatgagagggttatcactgaaattgcttgaggcaatctcagagagtttgggtttggaaagggattacatagacaaagcactggggaaacatgggcagcacctggccataaactactaccctccatgtcctgagccagagttaacgtatggtttgccagctcatgctgacccaaatgcaattactattctgctccaaaatgaggtcccaggcttgcaagtcctctatgatggcaagtggctaaccgtcaatcctgtccctaacaccttcattgtcaatattggtgaccaaattcaggtcgagcctgccagcttcgtcctcgtcgaaggagatagcgcggcggaggtgagacagcgggcagcgggaggcggagccggaggaaggagcggaaacggcggagaaagaggagtgggaaggggtggcggaagaagcggaggtgggagtgggagcggtcttgccggtgcagtcatggcccttcttagggaggccgcaacagccgcagttgtagctgccgggtgctgcgaaagccctgtcgggaaggtcgaactcgacgaagaggctgtggaagagatcgattcaaccaggggtgccgtgtgggcacgactagggttcaagaaaaagcaagaggtgataagcaacgataggtacaagagtgtgttgcatcgagcattggtgaattgtgagaaggagagaatgtccattccaacattttactgtccttcaccagatgcattgataaaacccgcacccaaactcgtagacaatgaacatcctgcgcagtacacaaacttcacatacagagaatactatgacaagttctggaacagagggctttcaaaagaaacctgcgtcgacatgttcaaggctcaagactaa

SEQ ID NO: 60388 - DNA, 1632 bp, Glycine max
  Peptide Sequence Number=SeqID_152073
atggagttgatgcaagaagtgaaagggtattctgatggcagagaggaggaggaggaggaagaggaagcagcagaagaaatcatcacaagagaagaaagcagcagtaagcaccactaccccttttcttctacctctaatttgtctttatcttcttctgctccttcaatatcatcaaattatacttctactactactactgctgcacgtcctcatcaccatcatcattctacagaatctcacaattcatcatctgggttagggttgttacaccagcaccaggaggcagcaggttccaatttcatcatcaacaataatcatcatcatcatcaacatcaccaccaccacacaacaaagcagctagacttcatggacttgtcacttggtagcagcaaggatgaagggaatttgcaaggatcatcttcttctgtctatgctcatcatcatcatgcagcaagtgctagttcttctgccaatggtaacaacaacaacagcagcagcagcaacttgcagcaacagcagcagcagcctgctgagaaggagcacatgtttgataaagtagtgacaccaagtgatgtggggaagctgaaccggttggtgataccaaagcagcatgctgagaagtatttccctcttgattcctcagccaatgagaagggtctgttgctgaattttgaggacaggaatggtaagttgtggaggttcaggtactcctattggaacagcagccagagctatgtgatgaccaaaggttggagccgttttgttaaggagaagaagcttgatgctggtgacatggtgtccttccagcgtggtgttggggagttgtataggcataggttgtacatagattggtggagaaggcctgatcatcatcaccatcaccatcatggccctgaccattcaaccacactcttcacacctttcttaattcccaatcagcctcatcacttaatgtccatcagatggggtgccactggcagattgtactccctcccttccccaaccccaccacgccaccatgaacacctcaattacaacaataacgccatgtatcatccctttcatcaccatggtgctggaagtggaattaatgctactactcatcactacaacaactatcatgagatgagtagtactactacttcaggatctgcaggctcagtcttttaccacaggtcaacacccccaatatcaatgccattggctgaccaccaaaccttgaacacaaggcagcagcaacaacaacaacaacaacaagagggagctggcaatgtttctctttcccctatgatcattgattctgttccagttgctcaccacctccatcatcaacaacaccatggtggcaagagtagtggtcctagtagtactagtactagtcctagcactgcagggaaaagactaaggctatttggggtcaacatggaatgtgcttcttcaacatcagaagaccccaaatgcttcagcttgttgtcctcatcttcaatggctaattccaattcacaaccaccacttcagcttttgagggaagatacactttcgtcatcatcggcaaggtttggggatcagagaggagtaggggaaccttcaatgctttttgatctggacccttctttgcaataccggcagtga

SEQ ID NO: 60389 - DNA, 1545 bp, Glycine max
  Peptide Sequence Number=SeqID_152074
atggagaacaacataatttccatatgtgatcacatgcctgtaggattcagattccgtcccacagatgaagagcttgtgaactattacctcaaacacaagcttcttgccgatgatttccctgtccacatcatccctgagatcgacctttgcaaagtggagccttgggatgtaccagaaagatcagtgatcaaatccgatgacccagaatggtttttcttcagtcctgtggattacaagtacttgaagagtaaaaggtttaacaggacaaccaagcgtggctactggaaaaccactgggaatgaccggaacgttaagataccgggcaccagcaatgtcattgggactaagaagacccttgttttccacgaaggccgtggtccccgtggtgtcaagaccaactgggttattcatgaataccatgctgttacctcccatgaaagccagagggcttttgttttatgccgcttgatgaagaaagctgagaaaaaaaatgaagggggaattgaggcaccaacctttgatgaaggggagcccagtgtacacttgttttctgactatggaaatcaggcaagagcagaagggattgcatccttcatggacatatttacactctgccatgtagatattattcccggagtagatatggaagaaatctttcaggcagtggatcgggccgagaaattctcccccccagtacaacggtctcaaactggcattgggctggaagattttttcgcaaactctccattgtttaatgcccactttggaagcgaaaacatcaatatgcaaacttcacttgaagttaccgacgatgaagagttggtaaattcattttgggttgatgatgaagaatttgttatcaatgaagaaagaagacactgttttgtcaatagttccacccaaccaaagtcatttagaagggtatacaatgaaagcagtgaaatagatgctgaagttgtctctaatctgaatgaacacattagtgctgatgaataccctgcactgaaaatgtttcaatcatcatatgatgtccgtggtggcacaagtcgtctagcttctaaccataaagcaaacaaagagaaaaaggagagtatcattccagatgatttttgggcagtggagacatcctcttgtgactcaactgcagatgaaccaattgaaatttctagttctccttccactccaacaagaatgaaaaatcagtgtcatctaagacctgacaagttcatattacaaagaactgttgcaggaagacctcaaacacaaaagaaagtttcaaacaatgcagtctcccatgtagaggttcggaaggaattgctcactgtgaaatcagaaaaagatcagaaaaatgctcaaaacgctagtttaagagggaacttcaaaaacaaaagccaacaatcctctgatgtcaacaacaatggttctttcttttacatggagacggcttcaaaccgaagcctatttccacgttcggtgtatcttgtcaatgttgtcatagggattttgttgttaatagttattagttgggatgtattatcatgttag

SEQ ID NO: 60390 - DNA, 249 bp, Glycine max
  Peptide Sequence Number=SeqID_152075
atgcaggggaattcaggggtgcccagaaagcgaaaatcgattattgttccctcaaattcaatcgcaaaagaacacattcgaatgaatgaaagaatgaagaaagcagcgttggtgttactcagttcatttcattctgtcattcatgggtgtctctcacattcacatctgcgcaagagaaggaagtgggctcacaatacaaagtggcccaatttctctttagtggaccttatgggcttcccacaagtgtag

SEQ ID NO: 60391 - DNA, 1617 bp, Glycine max
  Peptide Sequence Number=SeqID_152076
atgaagcaactcgagttaactctgttgctgtgcctcttttgggcactaacccttctctatggtgagatgttcgcttactgggttccgcccatcttcacctgttcctggccccatcttctccgcacctcttcgtcttcaatggttgaaacagacagcgggaactatcaagctgattatgttaaagttgctgttatcgcagatccacagctcatggataaaacttctctccgtcttcctgcaaaatcacttgcactggaacttgtggaattctacactgatttaaacatgcgtagatcattcgttgcatctgtcctgcctttcaaacctgatgtcatattacttttaggtgattactttgatggaggtccttatttatcagatgaagaatggcaggagtctttcaatcgcttcaggcatatctttggtttgaatgcacaaggaaaatacacagacatgccagtttactatattccgggaaaccatgatattgggtatgaaagtcttcattctctaaagccagaggttatccgacgctatgaggaaacatttgggattaggaactacagatttacagttggcaaagtggattttattgccgttgatgcacaaactctggatggacacccacaaaatcttctgacttctcaaacttgggattttgtgaagaatatctctgctgatgatgtggttcatccaagagtcttattgacacatattcctttatatcgacgtgatgatacgtactgtggtcctgatcgtagttccccaattatcaatcagaggatacgtcacagtctaaatggcaatactaatgatatatcgatgagtgagaacataggggaattgagagctgggactatagtgaggaagcttattttatctggtcatgatcatgatcagtgcactgtcagtcatcaatctaaatctgggcctgtaaacgagcacaccctaggtactataagttggcaacaaggaaacttgtatccttctttcatgctgttatcagttgataactcaactcatccaaatgcttccattcctaaagaggctttgttgactcatctatgttaccttcccatgcaaacacacatttacatatggtatattgtgctatttattctgacccttcttgctgccctattttggccaacaagtggcacgagtttctggcatcagtgttgcggcttatttggctattgtaaacaactaatagcttgcatcttttctagaagcgaaacgaaagaaaaggatgaggacgctaactatgaatatgagatgatgtgggatgcagaaggaacaatgcatcttgtaaagaaaaccttgaatgcatctactgtaaattcaaatgaccagagcttaggggaaaggggttacgttgtgatgcgagcagcggctagaaaaaatactgctcaggaaggagatctctctgtgaatgtggatatggcttcaggcattggtcttgatcctgtagcaaaaatgcctcccagaacgggcaaatcaaagacaaaaattatagtccagagattgatacgcacactgcgaatgcttactgtcatttcagcagtgaatgttcctctttacatgatgttgctattcaaggattggattgataaatag

SEQ ID NO: 60392 - DNA, 1755 bp, Glycine max
  Peptide Sequence Number=SeqID_152077
atgagagagccaagagatggagccaggaccgatagttccaagccctccaaagccgcaccaccgcctcagtccttccctctcattctcgacatcgacgatttcaagggagatttctcgttcgacgcgttgttcgggaacctcgtgaacgaccttctcccgtcgtacaaattggaggaatcggaatcggacggcggagatgctctgccgaatgggcatctccgcgtgccgtccgatgcgtccaagtactcgcaggggattgtgagtccgttgtttcctgaggttgaaaagctcctgtcgttgttcaaggattcttgtaaggagctgcttgagcttcgtaaacagattgatgggagactctacaatcttaagaaagatgtttcggttcaagactctaagcatcggaagacacttgctgagctagagaaaggtgtggatggattgtttgacagctttgcaaggttggattcacgaatttcaagtgttggtcagacagcagcaaagataggtgatcatctccagagtgcagatgctcagcgagaaactgccagtcaaacaattgaattgataaaatacttaatggaattcaatagcagtccaggcgacctgatggagctttcacctcttttttctgatgatagccgtgttgctgaggctgcttcgattgcccagaaattacggtcatttgctgaagaagatatcggaagacatggaatacctgtcccatcagctatgggaaatgcaactgctagcagaggattagaagtggcagttgctaatttacaggactactgcaatgaactggagaatagattgctttctcggtttgacgcagcatcacagaaaagagaattgaccacaatggcagaatgtgccaaaattttgtctcagtttaacaggggtacaagtgccatgcaacattatgtggctactcgtccaatgttcattgatgtggaaataatgaatgcagacactaagctggttcttggtgaccaggctgcccaagctagtccaagtaatgttgctcgtgggctttcctccttgtacaaagaaatcacagatactgttcgtaaagaggctgcaacaatcacggctgtattcccttcaccaagtgaagttatgtcaattttagttcagagagttttagagcagcgaatcactgcccttttggacaaactgttagagaaaccatctcttgtcaatttaccttccatggaggaaggtgggctcctattatatcttcgaatgctggcagtggcgtatgaaaagacccaagaactagcaagagatctacaagctgtaggatgtggtgacttggatgttgagggtaatgaattaacttcaaatatgcctgattttcttcattgcaaattggtgaacccatccctaaaaggaacattggtttggaacatagatgcaaatggtctaacagagtccctattttcaagtcacaaggatgaataccctgaatatgagcaggcatctcttaggcaattatataaagtgaaggcttcttgtactggtttggggatcccaatagaatcaatggctgagataaaactctggcactgcacagaaaggtgtttagtgggcactagacacaaactagggtatgcatatttaacaaaggatcttttttcttttctcaaggcaactggcaagtcatcgggattagaatcacaattgttcaaaggaatttccaaagacttggaagtacaagtgcttaccttcagtttggataattgggattgcttttga

SEQ ID NO: 60393 - DNA, 822 bp, Glycine max
  Peptide Sequence Number=SeqID_152078
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtatatcaagaaaatgtttatgttcctgagaagaaatttcactctttcaagaaggtgtctcggtccatgggatatggtgagaatgatatcaccttagtatcttttcaatcagtctccaaaggctatcacggggagtgtgggaaacgaggaggttatatggaggtgactgggttttctgcagaagtgagggaacaaatatataaagtggcatctgtcaacctttgctctaatatctctggtcaaattcttgcaagcttggtcatgagtccacccaaggttggagatgagtcctatgactcattcatggctgagaaggagaatattttggcgtcccttgccaggcgtgcaaagacactagaagatgcattcaacaaattagagggtgtaacatgcaacaaagcagaaggggcaatgtacctgttcccccaaattcgcctgtccgaaaaggctatcaaagctgcagaggctgcaaatgcaacacctgataacttctattgcaaacgcttgcttaatgccacaggagtcgttgttgttcctggttctggttttggacaggttcctggcacatggcattttaggtgcaccatattgcctccagaagaaaagattccggccatcgtcacccgcttgactgagttccatgaaaaattcatggatgagttccgtgactaa

SEQ ID NO: 60394 - DNA, 768 bp, Glycine max
  Peptide Sequence Number=SeqID_152079
atggcttcttttggagcaaatactgtaacaaagccaatcaaaaagaggaaaagaacgattgagatcaagaaagttgagcagataaacaggcgttacgtgaccttctctaaacgcaaattagggttattcaataaactcaccgagctctcagttctgtgtcaagtggaagccgctgtgatcatcacctcccaaaacgggaagctctatacgtgtggctaccccgacgccgatgccgtcgttcgccgctacctcagcggagggctatcccgagggctggacagtgaaagcaaaaagagacagcaagatgcaattgaaaccctaaggcctgaatacgaggccactcagaaccacttgaaagaagagcaaaagcgtttgcaagaaatcaaagagacgcgaaagagtagtttgtgctttccctcgtggtggaatctccccaccgagggtatgggtttggaggatcttgaacagttcaagacttctttggaacgtttgaagtttaacctagttggggcgctgcaagagaagcagatgaattcggtcccatcaatgccaaatgctcttatggttccaccaatgccatctactgtgcttccaccagtgtcacatgctgctatggttccaccaatgatgccgccacagtttcaaaacatgccactcttgagtgttcaacgtttaagtggaaatcaagttcaagatgattattggaggagtgctgctatagctagtaatggttttggaagcctgaaaagttatggatatgctacttaa

SEQ ID NO: 60395 - DNA, 555 bp, Glycine max
  Peptide Sequence Number=SeqID_152080
atggcatgccctcatgttgctggtgttgcagcattgttgagaggagcacaccctgaatggagtgttgcagccattaggtcagcaattatgacaacatcggacatgtttgacaacaccatgggactcatcaaagacattggtgatggtcacaaacaaacctctcctttagccttgggagctggagttcaagattatgtcaatcttctctgtgctttgaacttcactcaaaaaaacatcacaaccatcactagatcctcttcgtataattgttccagactttccctggatctcaactacccttctttcattgctctcttcactggcaacggttcttctatcaattcaagggtaacgctaattgggagtttcagagaacgcgtcattccaagcaaattgctcttcaagcagaagaaggagaagctgagttacgagttaaggatagaaggtcctaagatcgaaggtttcgggtatctctcctggacggacgtgaagcatgtggtgaggagccctattgtggtcaccaatcagtcaccgtcaaattcaactttcgtatag

SEQ ID NO: 60396 - DNA, 522 bp, Glycine max
  Peptide Sequence Number=SeqID_152081
acttatcaaggtaatccttgtggcatctaccttgacttatcttccttcattagaagtggcgtctacccagacttatcttccttcactggaagtggcgtctacccagacttatcttccttcaccggaagtggcgtctatcctgacttatcttccttcactgtaagtgacgtctacccggacttatcttccttcaccggaagtgatgtctaccctgacttatcttccttcaccggaagtggcgtcatccaaaactctaaagcctgtatcaagcgatccgctcctagtcaggttcacatcaagatcaacgatcgaggtttaaaaaagaagaatcaccggatgacgtcgatcgaacatttgttcggtgttgccgtaaaaatttacaatctacgtcggctaggttttttcgttcgacctcaatcgaagttgtggttcgaccgacagtggcatgttttgatttgcttggcaacaaaaacattagcccacctcggaaaaaaacttgattcgccgatactgatcgaataa

SEQ ID NO: 60397 - DNA, 261 bp, Glycine max
  Peptide Sequence Number=SeqID_152082
atgacagccaacattgtccccgttctcttgcgtattgacgctaaacgcgcgcccaccaagtgttcgttgaaatgcatacgcatacgcattagcgcagtgacatattttgtaaggtacttaaggacggatgcaagtggggatggggtcacgaccgaccgatcgttgccccttctctgcgcgaaacaaacagagaatgtcgctgcaaggcagccccgtatcctttgtattttgcagctttcttttactatttgtttgttttaa

SEQ ID NO: 60398 - DNA, 480 bp, Glycine max
  Peptide Sequence Number=SeqID_152083
atgacaataagggctcccactccttgggttaatctagtcaaagataatagaagtccttccaaaggttttggaatgaagttctcccctccaccctctgatgatgaagtgctgttggaagaaacagatttgcaacccctggaagaggcttggggacatagccttattggctatgtggctggtcgattccaaggaaagaaagctctgctggattgttgccaaaaatggggagtcaagttttcatactcagctcatgaaagtggttggctggtgtttaaatttgagtctaaggacagaaatcatgaccaagtctgtaactgtaggaggcttctcaaagaccccgtactgctgaaggttatgccatgcattgcctcttggaactcagaggtttggcaattgaagcagctcatgcgaagatccttcgctgggttaaactcaaggaaatctacctcatggagctttggaaccctcaaagttgaatga

SEQ ID NO: 60399 - DNA, 589 bp, Glycine max
  Peptide Sequence Number=SeqID_152084
tagcaaatgtggtcaagatcttggcacaagagttagaccgagtgaagcaaaagaggaatggggtggtagggataccatggcagcacttggaggaaagggtagacctatctatcccttacaaggtcatcgcatgtgtgccgaaaagggaaaggaaaattgggaggaactcttggcaggattccaaaacttccctttgatgggaacaaggggttgtattagttataatcccatactggccataagacaactaggctaccttatgagaggggcactgttggaaaagatcaacatacttttcatcgcacgaggtttcagtgaaggcaatgcaaaaatgcttcagagaatccgaaaagtgtggaatatagtggaaagaaaagataaggagcttaggggaagcagcaatggtgtcattggtggctatcataaatggttgaaggctcggacgcaagggataacttggttcccgaagctaaaaagtcccagtagggaagctgaagtcccagaggaaagcaaagaagtgcaagccttgaaagcagagcttgaaagaacgagagtggtcaaggaaaagctaaagacgacagtcaccagg

SEQ ID NO: 60400 - DNA, 759 bp, Glycine max
  Peptide Sequence Number=SeqID_152085
atggctcgctgcagggattgctgcgcatggccaatctgccgtttgtcgggtcggatgtgctgggttcccgcggtcagcatggacaaagatttcaccaaacgcctgctgcgcgatgccggcctgaaagtggcgccgtggctgagcgtcacccagacgcagcgcgcggcgctggatgtgcaggcggtgattgcgcgctttggcctgccgctgtttatcaagccagccaatcagggatcatccgttggggtgagcaaagtgacgcagccggatgaattcgacgcggcgctggatctggcgttccgctttgaccgcaaggtcctgattgaacagggcatcagcggccgtgaaattgaatgcgcggtgctgggtaacgaggcgccagaagccagcccgtgcggtgaaatcgtggtgcacgacgctttctactcgtatgacaccaaatatatcagcgagagcggcgcgcaggtggtggtaccggctgacatcagtgcggaagccagcgaggccattcgggctgtagcgattaccgcgttccaggcgctggagtgctttggcatggcgcgcgtcgatgtgttcctcaccgaaacgggcgacattattgtcaacgaagtgaatactttacccggcttcaccaacatcagcatgtatcccaaactgtggcaggcggccggcctgagctacagcgatctgatcacccgcctgattgagctggcgcagcagcgtcatcagcaatccagccagctgaaaagcagcgtgtaa

SEQ ID NO: 60401 - DNA, 210 bp, Glycine max
  Peptide Sequence Number=SeqID_152086
atgaaaaaggtgatgaacaaaaagctcaaacatcaaagaacaactcaagtgaatcaaagaacatctcaagtgaatcaagaacaagtcaagagttcaagaatcaagaagaattcaagactcaagaagaaagcctataatcaagaatcaagattcaagattcaagatctcaggaatcaagataaagattcaagactcaagattcaagaatga

SEQ ID NO: 60402 - DNA, 147 bp, Glycine max
  Peptide Sequence Number=SeqID_152087
atggacgaagatcaatgggcatattatagtgcgatgtccgaagaagttgatatggattttcaaaatgaagaagaagattgtggtgtgaatgaagcacatgttgattgttcagatgcttttaatacttctcaggtctttgaaacctga

SEQ ID NO: 60403 - DNA, 627 bp, Glycine max
  Peptide Sequence Number=SeqID_152088
atgggcatgagaacgatgcccaacgttagccccgtcagttattcctccacaacaacaaaacgcgccacttgcttacaggctatgataatttacttgagtttcgtcgtaattagatgtcatgaaatgcgacgagcgaaatggcaccagccggatagagtcatgagacaatttggaatgcaacaacctattccgggcccagtaatgcaacccaacaacatacatgacttgacattaaagggaaaggaaggaaaaaattggatgcgactaatgcaacccgcgcttaatgaatggaatagtcactatgaaaggagagtagagcaaatgccgccacaaacagggacccttagtctgaactctaaatatatgaggtggtacaggcgtaaaacaaaaggtgaaatcgccgaaacactacattttatggtgtcgcctgttgggagaaagatttgtacttttgatgatttactaccatgtatcgagaagatcactcttttgtctgacgaagaggataagatacttgaggcacatgaagatgctcccccttctcagccacaatttgaacatcaacagtttaatatactacaacaaagtgtggagactcgaggcttagcgcgacgggggatcctctag

SEQ ID NO: 60404 - DNA, 945 bp, Glycine max
  Peptide Sequence Number=SeqID_152089
atggcccccaacaacaacagaagagccccagtagtgggcacgaggaaaaaggaaggagacgcccacgctgtcaccaccgccccaacatggatgaaagcaccccaaaatatccaaagctcataccagcccaatcccccaaatttcttgatccgagctgggaattccctcccgactcaagtaaaaggaccacccgcagcagaaagagcgccggcccaacgcacagctccagccgcaccccggccagttaataatacagcccccggcgcaacctataaatatgcacagcacccgaaagacaacttccctcctattcccatggcatactccaagttatggccttcactattagagaatcacttggtggtggccataccagggaaggttcttcagccaccctaccccaagtggtatgattcgggtgccaacgtgaacgccgtcaaagaggatgggccatcacggacaaagaggttaggagacgtggctacttctagacgcttcatctatcaatcactgcaagcggcgcgcatggtcccccgaggtggggatgaaagggatgaatgtttgtttcacctcggggagtcgcatgacatggaaacctatcccatggtggaagaattacttcagcggctcatggactgcgggcagcttgaagtattcatagaagggaaggaagaaccacaaatctgcatgcaatcggaagagaagagggttcctctaacccccaaggccctagtgatatgttttactaggaaagggaccgactccacacccatatacccgcaggcggcacccaagccaacgccatttgcatatcaaagtaataaggccgttccgtggaagtatacccctcccatgtccagcgaaagagttgtaaccgaagttgactccctatcagctaaggtaaccaacatcaccggcctcagtggcgtgacccgcagtggttga

SEQ ID NO: 60405 - DNA, 606 bp, Glycine max
  Peptide Sequence Number=SeqID_152090
gcggaatttgaaatccttgaagcttttgacagtaggacaaagaagaaaattcttcagattttcggtgagcgctggaggcagtttaaatctgacttgactaggaaatggatacttgcagccgacaaggacggtgcggacgacattgcctgtgaaaaatatggcattagcaaggataaatgggcccagttttgtcagacccgcagagaccccttatggaagtctggaagcactgagggcatcattgaccctccatctcccatcagacgccacgtgaaatggaagatggcccgcacgaagaaaactggacagatgacgtctgaggcaacaaaggaaatagctgacaggattataatacatgattctttggacgagcaggcgtcacagggatcgttcgtcccccatggacatcaggatattctgactgctgccattgggcgactagagcaccctgaccgtgttcgtgttgttggagccggtgtcaccataaagcaatactttggatcggcttcacgaacgtcccgcagttcttcctccatgcctcctgaagacctagaacagctgacccaacaaattagagaccaactggaggagtcaatcacagaaaag

SEQ ID NO: 60406 - DNA, 175 bp, Glycine max
  Peptide Sequence Number=SeqID_152091
gtcgactctagaggatcccactcagcagagggaggtcagagttatgatcgctgggcaagacgttgctgagcagcaacatcatccatatctgagtcaaggtggtcatgttggtgcgcatgatctgcacccgtctcccggcagcggtccgggcaaaatccttacccggtatgcataa

SEQ ID NO: 60407 - DNA, 175 bp, Glycine max
  Peptide Sequence Number=SeqID_152092
gatagttattaattttgtaatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 60408 - DNA, 534 bp, Glycine max
  Peptide Sequence Number=SeqID_152093
atggcatccttcagccagcttcagtcacagatacaatctcaggcaccttctgagcctctggttggtccttgtccctccggttctcgggtgagcacaaaggggagttgtgttgatccctcaggaaacaatcctgagacgggtgactctgacagagtttatgagggatccactcttgttcataatcctgcccgcctggttgccgtggggagagtttatgagggatccactcttgttcataacactcctttgttgtctggccaagtaaaggtgagtgtggacgaggttaaagatgcagatgctcccgttcttgtatccactgctgaggttttcttagtggggcagacacttcacactttccttgcttggccgacacatctgatcaagtctttatcacacgaggttagatgggatgtcaccatgttcgggatcgttaatccagatttccccctgtacataaagcacgaagacctctccgaaatcgcacacggtggtcaatgtctcggcatatcagtgttacggttgtggattctataa

SEQ ID NO: 60409 - DNA, 891 bp, Glycine max
  Peptide Sequence Number=SeqID_152094
gatgtgcgcaaaaaggcacaggccatccagaaacagaacactagcccccacgttttgtctcgtgcgggttatgaatatttagagcagaagctcttggctgagaagacgaagaagaagctggaggaaactgcacagtcaggaagtagcgttgatggcatcatcgaccctccatccctggtcagatgccacgattcctttgaggagcaggcgacacagggatccttcgtcttccatggacgtcaggatgttctcaccgctactattggacgtccagagcaccctgaacgtgtcaccatcaagcaatactttggatcagctccacgaacgtcccacagctcttcctccctgtgtcctgaagaattgcaacaactgacccgacaaattagggaccagctagaggagtccatctcaaaaaaagtgacgcgacagctcatggcatcgttcagccagatgcagtcccagatgcaatctcagggacttgcactgcctcctgagcccctggttggtccctcaggtcctcgagtaagcacaaaagggagttgtgttgatccctcaggaaacgatcctgagacaggtgactcagataggtgcggcttgtacatcgaagcagatcctgcccgcctggttgccctggggagagtttatgagggatccactgttgttcataacactcctttgttgcttggccatgtaaaggtgggtgtggaggaggttacagatgcagatgctccagttcctgtacccactgatgagctgtgtctccagcaaaaccacctccaaagcccgatccagaggtcgatgatccgctttattgatgacattgaccatcccagagcttttcttgaggccttatcaggttacatgggatgccacggtgttcggggtctttaa

SEQ ID NO: 60410 - DNA, 579 bp, Glycine max
  Peptide Sequence Number=SeqID_152095
atgcatgaacgacaatcaattcgtggggctctgaaaaaaaatggagaatggagaattgcactaggcaatcactacgcatggctccagactcatgggtggaggatgcatgaacgacaatcaattcatggggctccgaataaaagaggagaatggagaattgcactaggcaatcactacacatggctccagactcacgggtggaggatgcatgaacgacaatcaattcatggggctccgaaaaaaaatggagaatggagaattgcactaggcaatcactacgcatggctccagactcacgggtggaggatgcatgaacgacaatcaattcatggggctccgaataaaagaggagaatggagaattgcactaggcaatcactacgcatggctccagactcacggatggaggatgcatgaacgacaatcaattcatggggctccgaataaaagtgttggcaggaccgaatggtccgccgggttttttccacctaagaagacaaacatgctttctgcaaagaaaaataaatcattcgcgagagcaccatatcttagagaaacagtatactcatgccaagggtaa

SEQ ID NO: 60411 - DNA, 603 bp, Glycine max
  Peptide Sequence Number=SeqID_152096
atggatgctcatccgtgtcaggatggcgtacaccagctggcacttaggcatggggaggtcggaattatgatcggtgggcaggatgttgctgaggagcaacgtcatccatatctgggtcagggtggtcatactggtgcgcatgattcgcactcgcctccctgcagcagtccgggcaaaatcctgccccgaccggttcctcctctggccatactcgcattcctggccctcttccaacaccatcggatatcccaggagctggctgatagcgtcggcatcgaacgggatccactgacccctaacccaggatctcatgtcacgcacgccctcctctgttggccaagcattggcataaaattcaaggactattcctggatcaaacttggccataggagtaaccagtggtgcccaccgccggcgccctatttcctcctgaaaatcagtatactcgtcgtccctgagctggacgcgtcactcccggagaaacgaccatcccttgatggcttcgaagcgctgctggtgtacagcgctcctaaagcggtgactgtcgtactccggagcggaactagttccttcggccgccttgtccttcctggacctctttga

SEQ ID NO: 60412 - DNA, 525 bp, Glycine max
  Peptide Sequence Number=SeqID_152097
atggactatggcaacgttacaccaaaagggggggaccgtattccaaaggggagacctctgttactccttaatccaattgggagacctttgttactcctcaatccagttgccatcattaaatcatggtgtaaaagcagtttgaggcgaatttccctgtttggggttcttttagaaagaaaatcccaaattagggttgttcttgaactatttcccagggggtgctctttttgcacgtaccctgcatgggaagcgccagtagaactggcgacttcatgcatggccgacacttgtcacctgctggaggaaagcgcaaacaggattggcgatttgaccatgactggcattggcgccagtggtattggcgctttgctggtctgtcccgtcaagcagcagcagcagaagtgcaggctaggcaacctaggtgcagggaaacgccattcccattggcgcttccggcttgctgaaggcgctggtgccattggcgcttcgtgcttcttctttctttataaactgcgtttggcctga

SEQ ID NO: 60413 - DNA, 519 bp, Glycine max
  Peptide Sequence Number=SeqID_152098
atggctccgaaaaagctttcggtaaagaggactaggagagacgccacggctgaagggaccagtgccgcccccgagtttgatagccaccgttttcagagcgccgagcaccagcagcgcttcgaggccatcaaaggatggtcgttctatatagagaggcgcgtccagctcagggaggatgagtacacagattttcaggaggagatagctcgccgacattggacgtcgctggtgactcccatggctaagtttgaccctgaggtagtcctggagttttatgctaatgcttggcccacagaggagggagtgcgagacatgcgttcgtgggtgaggggtcagtggattccttttgacgcagatgccctcagccagatcctgggtgacccgctagtgttggaggaaggccaggagtgcgagttcagtcagaggaggaacagggccgacgggttcgacgaggaggccattgcccagctattatgcacactggggaaggatttcgcctggaccgctgcagggaggcgg

SEQ ID NO: 60414 - DNA, 81 bp, Glycine max
  Peptide Sequence Number=SeqID_152099
atgagcaagaggctccaagaggattggactagagttgttgaagaaggcccgagggttctcataacctcaggggttccataa

SEQ ID NO: 60415 - DNA, 246 bp, Glycine max
  Peptide Sequence Number=SeqID_152100
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttgtggttgaatctgagcgagggaggaatcattcaaggagacatgatggtccaagaggaaattcaaaatctcaatcgcgtccacaacgacatatga

SEQ ID NO: 60416 - DNA, 580 bp, Glycine max
  Peptide Sequence Number=SeqID_152101
atggcccgcacgaagaagacaggggagatgacgactgaggccgcaaaggaaatcgctgagaagattgattcgtttgaggagcaggccacacaaggatcgttcgtcccccatggacatcaggatgttctagccgctgctattggacgtccagagcaccctggacgtgtccgtgctgctggagccagtcagctgacccagcagatcagggaccagctagaggagtccatcacagagaaagtgacgaggcaagtcatggcatccttcagccagcttcagtcgcagatgcaatctcaggaacttccagtgcctcctgagcctctggttggtcctggtccctttggtcctcgagtgagcacaaaggggagttgtgttgatccctcaggaaacgatcctgagatgggtgactctgacaggtgcggcttgtacatagaagcagatcctgctcacctggttgccatggggagagtttatgagggatccgctcttgttcataacactcctttgttgtctggccaagtaaaggtgagtgtggaggaggttacagatgcagatgctcaagttcctgtacccactgatgaag

SEQ ID NO: 60417 - DNA, 408 bp, Glycine max
  Peptide Sequence Number=SeqID_152102
atggcgcctactagacaccctctggacccagagaaggctctgatcacgggcctctgccagtcctacgaagttcctgtcacccccatcaagggtgacgcacatcaggccgcgggcgcaccgccaccacctcggcaggccgatccggctgggccactgggcgtggagcgttatctacagcatttggttcgccagcaggtggccaaccaccgtgggcaggggcagggttccgccccttttgtatgccctaccccagagcagtttggggctgaggtcgcatggcctagaaactggcccgatgtccaggtaggggaggagcctacaggatcccctggtgaggcggatgagtcccatatggatgaagatatgacggacctgctcggtttcttgggagggagcggatccacatga

SEQ ID NO: 60418 - DNA, 372 bp, Glycine max
  Peptide Sequence Number=SeqID_152103
ttatatccgcttttgtcgagaggtggcacaaggaaactagcagtttccatcttcctataggagagctgaccatcacattggatgatgtggcgtcactgcttcatcttccgatcataggcgtcttcaacagcttcgagcctctgcatgtggacgaagcggtgttgatgttggtggagttgctagaagtctcggagtatgatgagatgtcaccacgtgcctgtcggtggcttactacgaaggcttattcgaagggattcccagcatcgacgtaccgaacacgtataaatgcactgacgatccctgatgtatgctggatgccttatggtgagcaccgaggagttagggcgtttgaccttatttcatgctttcagg

SEQ ID NO: 60419 - DNA, 336 bp, Glycine max
  Peptide Sequence Number=SeqID_152104
atgacatcaaagattcaaccttgcgatgttgggataataagagctttcaagatgcattaccgtagaaggttttaccgcaaaatattggaagctagtgacgttgcaagaaatttggatgaatccacttttgatgaagaaactcaagacctcgagactatgatcaatcaatgtggctatcataataagatggatattgacaatctaatgaactacccaggtgaaaatgaagcatgttcggaggttcagagtttagaagatattgtgggtactatcattgagaataatgcagaggatgacggcgaagatgatacggtgtctttggagcctgttacgtaa

SEQ ID NO: 60420 - DNA, 267 bp, Glycine max
  Peptide Sequence Number=SeqID_152105
atgtctcctccacctctaggtgtggaagcaatgtcttccaaagttattttgatgatgtcaaagaatcaagagttaagcaaaggttcaagcaaagattcaagattcaagaacaatcaatatcaagattcaagactcaagattcaagaatcaagagaaggctcaatcaagataagtattaaaatgtttttcaatacattgagtagcacaagaagttttcacaaaatcattaccaaagagttttactctctggtaattgattaccagaag

SEQ ID NO: 60421 - DNA, 429 bp, Glycine max
  Peptide Sequence Number=SeqID_152106
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtgctggatttacgagcactttccatcggtccacaggtgtgttgttgacgatggttatgctgaggctagtccacgtgcttgtaggtggcttacgggtaaagcccagatgaccgggattaagggagccccttacagagcacgtattgatgccctgacagtgaccgacgtctgttggggtaccgagctcgaattcgtaatcatggtcatagctgtttcctgtgtgaaattgttatccgctcacaattccacacaacatacgagccggaagcataaagtgtaa

SEQ ID NO: 60422 - DNA, 474 bp, Glycine max
  Peptide Sequence Number=SeqID_152107
atggccacaatgatggaggccatgatgagcatgaagaagataatggaggtaaatgtggctgcagttgccgctaccagtgccgttgctggggtggacccgattcccccatctggccttaaccaaataattcatccaacctcagatatggtaggtcaaggaggcaaagaatttggaagtacgggtgccccccattatgtgcgaattcaaaacaagcacgccttcctgccatatggcttgcctttcaactacacaccacccaatgtggtgcacactcccaatgagaatgtcaataactccacccctatactcattgatagccaacaaactcaatctaatcatgcacatgtctcgcaacccatgggggagacacatgaaataccctaccacaatctagccgacttcgagcctcgcctcagatatgccactaaggggaaagcagttgctggtgtactgttagtcggcttatacgactaa

SEQ ID NO: 60423 - DNA, 183 bp, Glycine max
  Peptide Sequence Number=SeqID_152108
acagctctgggtttctgcgggaaaggaaaatgctacaatgcgaggggtatttatcttagctctagacataatattgaaattcccaacggtgagaatgctcggaattgggttgcaaacgtggtgctcaaatttcacgacgatccaacggtgaatgagtctaagatcgtcatttttctaagacag

SEQ ID NO: 60424 - DNA, 192 bp, Glycine max
  Peptide Sequence Number=SeqID_152109
atgagtgtctctaccggttcagcctcaatcagctggggcaggtttagggctgaggtcgcatggcctggagattggcccgaggcccaagcaagggaggcacctgcaggatcccccgacgatgcagaggaggcccgtatggatgaggagatgacgaatttgctcggtttcttgggaggaagcggagccacgtga

SEQ ID NO: 60425 - DNA, 628 bp, Glycine max
  Peptide Sequence Number=SeqID_152110
gagtccgagtcaatttctgattattttaaaagcatgttcgtggagatcaatgaagcggcaactggcaatggagacgactcgagtattggcgtagtcaatcaacttaaaagaaatggtgaagatgttgatgaggtgaagaccatgactattgacaactcatggctccttacaagacatagaatgttcctcgaaaaattcaaaatgagaaaaattaaacaaaaggaggctacggagcaatactacaactcaacgacgaggttcgcgaccaagatcgtggacgtggacgaggacatggaggagaaggaagatggtaggaatccacaagtaacaagaggtcgtggaagaggaaatctcatgtgtcgaggtatggacaaatcacaaatcaagtgcttcaatttgaagttcaaaaaggcggagaaagaaagtggtactttgctactcgcgtgccaaaacatgaattatggaggagagttccaaaagaaacaagtggtacctcgacaccggcacaacaacacatgtgcgcgagtaaaagcatttcgagagacaagaaccggacaacttaacatggtgcgaagcatgctcaagagcaagaagatgccgaaggagttttgggctgaagcagtggcat

SEQ ID NO: 60426 - DNA, 273 bp, Glycine max
  Peptide Sequence Number=SeqID_152111
atggtcattgaccagtcccttttccatgacttaaccaaattacccagtgacggtgtaccatttgaaggtacactgaatgatgactggaaatttgatttctctgcccgtgatgcccgccagttggtttgcaccaacaatgcggatatgaccggacgtcttcttgccgggtcattggcttttgaaagccgcatccttcactatttaattgtgcgtattttgcttccacggtcttccaaccttgcccagggcgtcaacttgactgggcacacttag

SEQ ID NO: 60427 - DNA, 285 bp, Glycine max
  Peptide Sequence Number=SeqID_152112
atggctgcacttgatttcacttatgaaagcttgtgcattcaatatcttgatgagggtgttccatatgttctcaagattggactaatacatttgctgcccaagtttcatggtcttgcagtggcaaaagattggctatactaccttgctcccaggtccattttcagctgggatgaccttaagagggtgttcttagagaaattcttccctgcatctaggaccaccgccatcagaaaagacatttcaggcatcaggaaacttagtggagaaagcttgtatgagtactag

SEQ ID NO: 60428 - DNA, 192 bp, Glycine max
  Peptide Sequence Number=SeqID_152113
atgacaatcaattcatggggctccggacttgatggtggaggacgcacgaacagcgctaggcaatcaattcatggggctccggactcgatggcaatcaattcgtggggttccagactcgatggtggaggacgcacaaacagcacttggcaatcaattcgtggggctccggactcgatggtggaggatgcatga

SEQ ID NO: 60429 - DNA, 548 bp, Glycine max
  Peptide Sequence Number=SeqID_152114
atggtcattcccaagttcaaggtgccggactttggcaagtacaaggggactactcgctccaagaaccatctaaagatcaaaaagatcgaagtggatccgaaaagaggaaaatttgatcatcctactaggacgactgagaaaactggggcaaataaagagggtgaggatgagggagaaacccatgctgtgactaccattcctgtacggccaagtttcccaccaacccaacaatatctttactcagccaataacaaactttctccttacccaccacccagttatccacaaagcgagaaagcctgtagaattcacccccaattccagtgtcctatgctaacttgcatcccatatctacttgataattcaatggtagccataaccctagccaaggttcatcaacctccatttctccgagaatacgactcaaacgcaacgtgtgcttgtcacggagaagccccggggcgttccattgagcatggtagggctctgaagcgtaaggtgcaaggtctaattgatgcgggctggctgaaatttgaggagaattgcgt

SEQ ID NO: 60430 - DNA, 216 bp, Glycine max
  Peptide Sequence Number=SeqID_152115
atggtcattcccaagttcaaggtgccggactttggcaagtacaaggggactactcgctccaagaaccatctaaagatgtactgtcggaagatgggggcatacgcaaaagatgagaaactgctgaaacatgatgcaactacaaaaagtgtgcaaaaagggggcacgaatctttcaaagaatacgcccaaagatggagagacttggcaactcaagtag

SEQ ID NO: 60431 - DNA, 327 bp, Glycine max
  Peptide Sequence Number=SeqID_152116
atgatgagaatcatgaaactggccaaatacaggctaaaggcccaaagtggagaaggacgaaggcctaagtggagaagggacaaaacctccgagtggagaaggatgaaggcccaaacttatcaaggtaatccttgtggcgtctacccagacttatcttccttcactggaagtggcgtctacccagacttatcttccttaaccggaagtggcgtctacacagacttatcttccttcattggaagtggcgtctaccctgacttatcttccttcaccggaagtggcgtcatccaaatcttcgtaacctgtatcaagcgatccgccccgtaa

SEQ ID NO: 60432 - DNA, 276 bp, Glycine max
  Peptide Sequence Number=SeqID_152117
atgatgcagacgctaagcgcgcctatgacttataggaaaagaaaggcaccctctacacctacccaagccagatttgatagatccagattcacttcccaagaggctttggagagatacactgacattgtggtgcctcataagcttttaacagagaggaatgtggtagtttactatacagagtttgatgagttcaaggtggaactcaagagacgccattgggatgaggagttgaatgactttgtggacggcaatattgatgttgccattgtaaaataa

SEQ ID NO: 60433 - DNA, 216 bp, Glycine max
  Peptide Sequence Number=SeqID_152118
atgacggacgtgtggggtgctaataccttccccgtgcgtaaatacaactcccgagcctttcacttaaaacgctacgcaatcaattcatggggctccggacttgatggtggaggatgcattaacagcgctacacaatcaattcatggggctccggacttgatgatggaggatgcacgaacaacactaggcaatcaatttgtggggctccggacttga

SEQ ID NO: 60434 - DNA, 258 bp, Glycine max
  Peptide Sequence Number=SeqID_152119
atgggcttggtccttctgtcgcaacctacccttttgcgggcgagcgaggcgaggctcacgggtaggtcttccaaaggaggaaaatgcgcggagtcgccaccaacgtttatttgtggaaaacgtcggaaaaaccgaaggaaaccggtcattaagaatattctagattcgggagttgtatttacatttgaggaaggtcgacaaaagcggggctcttgctcctacgtaccctgcatcgaagaggaaatcagacctatgtag

SEQ ID NO: 60435 - DNA, 411 bp, Glycine max
  Peptide Sequence Number=SeqID_152120
atggctccgaaaaagctttccacgaagaggtctagaagagacaccgcagcggaagggtccagtgccacccccgagtttgatagtcaccgtttccggagcgtcgagcaccagcagcgcctcaaggccatcaaaggatggttattccttagagagaggcgcacgtcgctggtgactcccatgcctaagtttgaccctgagatagtcctggagttctatgctaatgcttggcccacagaggagggagtgcgagacatgcattcatgggtgaggggtcaatggattccctttgacgcagatgccctcagccaattcctggatgacccgctagttttggaggaaggccagcagtgtgaattcagccagaggaggaacagggccgaagccttgagccaaaatcccaacttaccataa

SEQ ID NO: 60436 - DNA, 465 bp, Glycine max
  Peptide Sequence Number=SeqID_152121
atgcattttaaatcaaaccttaagaggaaatgggcccttgcagtcgatcaggatggtgtggatgacattgtctgtgagaaatacggcataagcaaggaaaaatgggcccaattttgccagactcgtagagacccttcttgggaggatgtgaggaaaaaagcacaggccatccagaaacagaacattgccccccacattttgtctcgtgggggttatgaatatttggagcaaaagctcctggttgagaagaccaagaagaagctggaggtagctgcacagtcaggaagcgttgatggcatcatcgaccctccatcccccgttagacgccacatgaagtggaagatggtccgtaccaagaaaacaggggagatgatgactgaggccgcaaaggaaatcgctgagaagatcgattcctttgaggagcaggcgtcacagggatcctttgtcccccatggacgtcaggat

SEQ ID NO: 60437 - DNA, 156 bp, Glycine max
  Peptide Sequence Number=SeqID_152122
atggtagaaatcaaccaagggacggatgcaagtggggctagggtcacgaccgaccgatcgttgccccttcccggcgctaaacaagcagagaacgtcgctgcagggcagcccagtatcctttgcgttcgcaatttcttttattattgtttgttttaa

SEQ ID NO: 60438 - DNA, 348 bp, Glycine max
  Peptide Sequence Number=SeqID_152123
atgagggatccactgttgttcataacactcctttgttgcttggccaagcacttcacaccttcccttgcttggccgacacatctggtcaagtctttatcacagcaggtagctgtgtctccgccaaaaccacctccgaagcccgatctggaggtcgatgatccgctttatctgatgacattgaccatctcagagcttttcttgaggccttatcaggttagatgggatgccaccgtgttcagggtcgttaatccagatttccctctgtacataaagcacgaagacctctccaaaatcgcacacggtggtcaatgtctcagcatatcagtgttacagttgtggattctataa

SEQ ID NO: 60439 - DNA, 201 bp, Glycine max
  Peptide Sequence Number=SeqID_152124
atgtgtatacacctgaaggttgaacgctgtgaaaattttcccggacgcccaaaatggactcgaatgaatgcacaaattgataaaagaacgacattccctttaccccgaaccgctggccaaaccctgacatatatcatgaccagccgttctacaagccttgagccaaaatcccagcttaccataaaccttgacccagggtga

SEQ ID NO: 60440 - DNA, 706 bp, Glycine max
  misc_feature (603)..(603): n is a, c, g, or t
  Peptide Sequence Number=SeqID_152125
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtnagacacgacttatcgccactggcagcagccactggtaacaggattagcagagcgaggtatgtaggccgtgctacagagttcttgaagtggtggcctaactacg

SEQ ID NO: 60441 - DNA, 206 bp, Glycine max
  Peptide Sequence Number=SeqID_152126
accatgcggcaggcatcatgactggagtaatcaaacttcatgtcatcaacaatggtgcccttaaaagtgtagaggatgacaaagatggtggaattggtgtcgaggatgctccggtggcttcgggacgtggagttctatgtgccgcagcggaggtggatgaacccttgcgcttattggatgattctgccatttggtgcagttattga

SEQ ID NO: 60442 - DNA, 679 bp, Glycine max
  misc_feature (357)..(357): n is a, c, g, or t
  Peptide Sequence Number=SeqID_152127
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcacctggagccggtgagcgtgggtctcgcggtatcattgcagcactggggccagatggtaagccctcccgtatcgtagtnatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggtatctttatagtcctgtcggtttcgccacctctgacttgagcgtcgatttttgtgatgctc

SEQ ID NO: 60443 - DNA, 276 bp, Glycine max
  Peptide Sequence Number=SeqID_152128
atggaagaatgcaagtctgttagcacaccaatgaatcaaaaggagaagtttagcaaggaagaaggtgttgataacattgatgaaggatatttatgggagcttgattggatgtctaatatgcaacaaagtggtgaagtgaacttaatttattgtaagtataaagatcaactggctgacatgtttacaaagtcactacctatcaacaaacttgaactcaaagaattggagtttgcagttccaaaagcaaggaggagtgttgaagatatacttttgtaa

SEQ ID NO: 60444 - DNA, 306 bp, Glycine max
  Peptide Sequence Number=SeqID_152129
ctgctgtctttatggctaagaataacaaaagtggaagttgaaggatatagcttatcatcgacattaagattagccattagagaaagttgtgaagcctcatgtatgctcaagtatgccggtgacattgctttatcagttggaaaaatgttaggaagatatcagagtaatccaggtattgaccactggagagctgctgaaattgagactcagactttcttaggttgtgttgacattcgtagatcaacatctgggtacattttcatgatggctggtggaatgctatttggtcatggaggagcatgttaa

SEQ ID NO: 60445 - DNA, 365 bp, Glycine max
  Peptide Sequence Number=SeqID_152130
ctccgcaacagcagtgcccttcaccatattacccgcatcagcagtgggcttatccgccgtacccaaatcaatatcagcagtggagctccccgccatggcaaccatgggctacaccaccttgtccgtatcccacagcaagaaatccaaaggaacaacccggcatccttgggcccaagccgtctcaccaagctcatgtcgccaatgcagcgccaacctcctcatatgctccaacggatattcaagctgccatgcatactctctcactttctactcctgatgatcagtggtacatggacaccggagcaacctcgcatatgacggctaacggaggattttcagacaggaataccgttaatgagatgtaa

SEQ ID NO: 60446 - DNA, 600 bp, Glycine max
  Peptide Sequence Number=SeqID_152131
atggaggcaccagctactgtggaggacattcctgcggacattcttgtggacgcaggcgcaaaggcggttgaggatcagcctcagggatttccaggtggtccgagcgacccatccgtgttgacagcgtatgcggatcacgttgcttgcagcgtatggacgggagaggagtgtcctgaattgaagttatcctctcatgggaggaaggtccacagtttaggcaggcctgtccctgccattgagggacttattgctggtacaggactaagtcctctgatcgcgtgttcggtagacaccggcgatcggggacttttgtccgcgtttgtggagcggtggcaccgggagacgtctagtttccatctcccggtgggagagctcaccatcacattggacgacgtctcctatcttctccatcttcccgttataggcgacttacacgcatttgagcccttgcacgtggatgatgcggttcagatgctggtggacttgttgatgatgtctccagagtctgctagggctgagacagtccagtgtcgcggaccgtacgtacgcctgcaatgggtacgtgatatatatctgcgtcgatgccaggcaggtcattga

SEQ ID NO: 60447 - DNA, 261 bp, Glycine max
  Peptide Sequence Number=SeqID_152132
atgacaagtagagacaaaatttggtcattcggcacccttgtgtcatccagaggcggcgggcccgatgacacgcggagataccttacggttatctgcacccttgtgtcatccagaggcggcgggcccgatgatacgcagagataccttacggttatctgcacccttgtgtcatccagaggcggcgggcctgatgatacgcggagataccttacggttatccgtataaactttcttttgctatctgtaagacagaacgcttga

SEQ ID NO: 60448 - DNA, 485 bp, Glycine max
  Peptide Sequence Number=SeqID_152133
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaggtatttacagaagccgttgagatgtttcacgttgcggctgtggttggagattcagcaaaagagttggatcgcataaagcaaattcgaaacggcgtagtgggcctgcctcggaaatacttggaagacaaggcaagggatatggcgagccaagagaagtggggcccgtttgcggatgttttagctttgctgatttatggggttgtcctctttccgaacgttgacggcttggtagacttagccgccattgatgctttcctcgcatatcaccatagcaaggaaagtccagtggtggctatcttggcagatttgttcgacacctttgaccggag

SEQ ID NO: 60449 - DNA, 627 bp, Glycine max
  Peptide Sequence Number=SeqID_152134
atgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 60450 - DNA, 354 bp, Glycine max
  Peptide Sequence Number=SeqID_152135
atggcaggagctggtgacaatggtggtgtatatcatcaactggacggatttcagtgcttattactggacgcgatgactagacaaatgcaacgtttgttgaaacctaacaatgaagagttctacaggcgaatagaaggactagagcaccaaatgaatccaaatgttgggagaccttatagtggcaacagaagggtcaatgatggatcgaaccgaataaagcggcaagacagaagtgagggagtaaaactcaatgtatcatcttttaaaggcaggagtgacccagacgcctacgttgactgggagatgaagattcagcatgcattctcatacaatgattatcctgaaaagcagaag

SEQ ID NO: 60451 - DNA, 294 bp, Glycine max
  misc_feature (12)..(12): n is a, c, g, or t
  Peptide Sequence Number=SeqID_152136
atgaccatttangaggaaacactgggttcaacaaaaagagaagaaaatcactcaaagtgtatcaatctcgcacagcgcgaggcgaacaagtcaccgacgcacaggattttggttggtaatcaaagggagaggaccactttaggtcatgggcaaggattgacattctcaccctgggtcaaggtttatggtaaattgggattttggctcaaggcttgtagcacggctgcacatgatatatgtcagggtttggttcagttcaaggataaaaaggaatgtcccacattatttccatga

SEQ ID NO: 60452 - DNA, 231 bp, Glycine max
  Peptide Sequence Number=SeqID_152137
atgactagaggaaattcatctgacttacaaccctttgatcctgagatagataggacatttcatagattagttagacatcatttggtaccttttgagcatcctaagcattctgttattggtgattttgagcattctgagaacatggcacaccctccaccctgtgaagactcacacaaacatctgaaagaattccatattgtctgctccaccatgaaaccaccagatgtctag

SEQ ID NO: 60453 - DNA, 402 bp, Glycine max
  Peptide Sequence Number=SeqID_152138
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaaggtccaaatctcggcgcaggaattagaccgccaaaggcaagtcgaaaatggggtggtcggaataccgagaaaatatttggagcgatcgacgtttttctcgcctatcataaccacaaggaaagcccggtcgtcgccattttggccatgtatgacacgttcgaccggggatgtgaaaggagcggcgcaagaattgtttgttgtgcaccaactcttggctag

SEQ ID NO: 60454 - DNA, 312 bp, Glycine max
  Peptide Sequence Number=SeqID_152139
atggggctccgaataagactagatgatggaggatgcatgaacaacgctaggcaatcaattcgtcgggcgtcggactcaatggtggaggatgcatcgctaggtaatcaattcgtcgggctccggactcaatggtggaggatgcatgtctggcaatcaattcatggggctccacataagatggtggaggatgcacaaaaagcgctaggcagtcaattcgtgaggctccaaataagatttgatgatggaggatggacgaacagcgctaggaaatcaattcgtggggctccagactcaatggtggaggatgcatga

SEQ ID NO: 60455 - DNA, 462 bp, Glycine max
  Peptide Sequence Number=SeqID_152140
atgataaacatccaaaatctcatttatggttatgggggatttcatcaacatactctccttccccggtggacgcattgtttttcactcaaaaaagcatatgctgctctaatcagttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgctttttgttaccatgactcaaaagctggtagcttgcggagacaccttacggttatcagcgcctcgtcattcagtgaccccaagtgtgattgatgagcagaggccagtgtggtcatttgcaccctttccggagatgtcaacatcttccggtcgagactttttcaagtctcacaagttatctagaactacgtag

SEQ ID NO: 60456 - DNA, 156 bp, Glycine max
  Peptide Sequence Number=SeqID_152141
gtcgacaatagcggggcttttgctcctacgtaccctcctttggagaggaaatcagacctacgtagttctttcgtatgtgtgaatcaagtgattcttttttacttgaaggatgatcattttaaggcgttggaccttaagaatgatccattttacttg

SEQ ID NO: 60457 - DNA, 684 bp, Glycine max
  Peptide Sequence Number=SeqID_152142
atgcagagacaaattatggtcattctgcacacttcgtcattcggacacagacgtgttcgatggcatgcagcgactaacatcgtcttctgcgccttttgtcatccagaggcggcgggcccgatgacatgcggtgacaaattatggtcattccgcacacttcgccattcagacacagtcatgtccaatggcatgcagagactaacgttgtcttctgcgccttttgtcatccagaggagacacagtcgtgtccgatggcacgcagagactaacgtcgttttctgtgccttttatcatccagaggcggcgggcccgatgacatgcaggaaccatttggtcctgcactttttacttttgtcatctagaggcgacgggcccgatgacatgcggagacaaattatggtcatccccacgcttttgctatctggagattcactgtccgaatggtgtttcgctcgaacgaaattagtgtcttatctttacttcccttttatctccaataaaagacaagtaaagaggggcaactgtcacaccctaatttcgtctggggaccatccgttgttgggatgtgaccctcgtttgaccactttgaggtacatggcacccatcgttaggcaattcgtgaagctccgtgacatgccggaaatcaaaagaaagcattgttgcacaatccgtaaagttccgtaa

SEQ ID NO: 60458 - DNA, 861 bp, Glycine max
  Peptide Sequence Number=SeqID_152143
atgacgactgaggccgcaaaggaaatcgatgagaagatgtattcctttgaggagcaggcgtcacaaggatccttcgtcccccatggacgtcagaatgttctcaccgctgctattggacgtccagagcaccctggacgtgcctgtgctactggagccgcagctgacccagcaaatcagggaccagctagaggagtcgatcatagaaaaagtgactcgacaactcatggcactgttcagctagatgctatccctgtttcagtcccagatgcaatcttagggacttgcactgcctcaggagcctctggttggtccctcaggtcctcgagaaacgatcttgagacgggtgatgcagagaggtgtggcttgtacatcgaagcaaatcctgcccgcctggtttccctaggaagactttatgagggatccactattgttcataacactcctttgttgcctagccaagtaaaggtgggtgtggaggaggttaaagatccagatgctcccgctcctgtacccactgatgaggtttccttagtggggcaagcaattcacagcttccttgcttggccgacacatctggtcaagcctttatcacagcaggcagttgtgtctccgataaaaccacctcaaaagtcggatccaaaggtcgatgatccactttatctgatggcactgaccatcccagagcttttcttgaggccttaccaggttacatgggatgccaccgtgttcgtggtctttaatccaaacttctcgctctacataacgcacgaagacctctccgaaatcacacacggtggtcaatgtctcagcataccagtgttacagttgtggattctgctagtcattttagattacttttaa

SEQ ID NO: 60459 - DNA, 192 bp, Glycine max
  Peptide Sequence Number=SeqID_152144
atggcttatacggataaccactcgggtatttccgcccgtcagcatgactcaaaagtcagtatgacagatcttaatgaccaaattttgtctctgcgtgccaacctacccttcggcgggagggcgacgcgtgactcgcgggatgcgtgttccacgaaaggaatacgcgcggagtcgccaccaacgtttatttga

SEQ ID NO: 60460 - DNA, 688 bp, Glycine max
  Peptide Sequence Number=SeqID_152145
atggcatcattgggtgggtaccacgaatggctgaaagttcgcatatcgaggtttaagattggctcgccaaaggacgaagaagtccaagctctcaaaagcgagttgggaaaggcaaaactcgccaaggagaagttcaagttggctgctacacacgttcggaaggagtgtgccgggttacgagaagagaatgcaattaccgcaagagcccttgaacgagaggccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtctatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggagcggtttgctcttaccttgaacgggagtcaagaacttccccgattgttagccaaggccaaggcgatggcagacacctactccacccccgaagagattcacgggcttctcggctatt

SEQ ID NO: 60461 - DNA, 141 bp, Glycine max
  Peptide Sequence Number=SeqID_152146
acttatcaaggtaatccttgtggcgtctacccagacttatcttccttcggcggaagtggcgtctaccctgacttatcttccttcaccggaagtggcgtcatccaaaccttcgtagcctgtatcaaacgatccgccccgtaa

SEQ ID NO: 60462 - DNA, 1005 bp, Glycine max
  Peptide Sequence Number=SeqID_152147
aggcctgcacgccctcacctccagaggactacacatcctcgccttgagaggactacatgtcctcaccatcagagggctgtacgccctcacctccggaggactacacgtcctcgccttgagagggctactcgccctcgccttgggtacttagttaccctcaccttgagaggactaaacgtcctcgccttgagaggactacatgtcctcaccatcagagggctgcacgccctcacctccagaggactacaagtcctcaccttgagaggactacatgtcctcaccatcagagggctgcacgccctcacctccagaggactacacgtcctcgccttgagagggctactcgccctcgccttgggtactagttaccctcatcttcagaggactacatgtcctcaccttcggctacacgccctcgccatcagaggactgcatgtcctcaccttcgtagggctacacgccctcacctttagaggactacacatcctcgccaacagagggctacacgccctcacctttagaggactacacgtactcgccaacagagggctgcacgccctcaacttgagaggactacacgccctcacctttagaggactatacatcctcgccttgagagggttgcacgccctcacctttagagggctacgtgtcctcattttcaggaccagtagtttccttttaacggttcctgggccaccccctgatattggaggatggccaactgtgcgagcacaaccagagagggaggctatcacacagctactatgcataccggggcaagatttcacccgtgccgctgcaaagagacgaggatcgcacccacaagacacccagtggacccggaaaagtccaacagggccctggggtttccagctctggttacgggtctctgtcggccctataggggatcgtgcccgcaagacacctagtggatccgaagaagtccaacagggtcttgtgatgtttcaagctctaattacgggtctctgtcagttctacgga

SEQ ID NO: 60463 - DNA, 333 bp, Glycine max
  Peptide Sequence Number=SeqID_152148
gaaaattctgattgctttatgcattctgaagctgaagcactagaccatacgaagaaaatagatacaagccatcaaagtgtgtcattggagaatgagacaagagattcaactatgctgaagatgggagattcagctaaagttgtgataaaacaagacatgaagggaagagagcataaatatgggtttaacaacaatgaacgtgagaagccagagaagaaaagggtggtggatgatgaaactggtgacaaacatcagctggatgaagtcctaaggaggcaaattgaaacaaaaaccgatgcctcaatcagagaaaatgtagctgtcacttactag

SEQ ID NO: 60464 - DNA, 275 bp, Glycine max
  Peptide Sequence Number=SeqID_152149
atggagaattgcactaagcaatcagtacgcatggctccaaactcgtgggctggaggatgcctgaacgaaaacgcaattcatggggctccgaaaaaagggatgaatgaacgctccaaactcgtgggtggaggatacatgaacgaaaacgcaattcatggggattcgaaaaagggtagagaatggagaattgcactaagcaatcactacgcatggctccaaactcgtgggcggaggatgcatgaacgaatacgcaattcatggggctccgaaaaagg

SEQ ID NO: 60465 - DNA, 237 bp, Glycine max
  misc_feature (37)..(37): n is a, c, g, or t
  misc_feature (56)..(56): n is a, c, g, or t
  Peptide Sequence Number=SeqID_152150
atgagaaagcgccacgcttccccgaagggagaaaagncggacaggtatccgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 60466 - DNA, 328 bp, Glycine max
  Peptide Sequence Number=SeqID_152151
ggcgaggcctaactcacaaaaaaaatccccagtggagtcgccaactatcgcaacgtgccctttggcgggtgagcgagggcgaggctcacgggtgcgctttccaaaggaggaaagatgcgcggagtcgccaccaacgtttatttgtggaaaacgtcagaaaaaccgaaggaaaccggtcaaaatgaaaattctaagttcgggagttgtatttacgcttgaggaaggtattagcatctctcatgtcgacaaaagcagggcttttgctcctacgtaccctccatcaaagaggaaatcagacctacgtagttctttcttatgcgtgaatcaa

SEQ ID NO: 60467 - DNA, 170 bp, Glycine max
  Peptide Sequence Number=SeqID_152152
atggagaaagtcatgataaaacatttgcacaagattaaatggcctaactctctaacaacaatcctcagtggagtcgccaactgtcgcaacctacccttcggcgggagggcgacgcgtgactcgcgggatgcgtcttccaagaaaggaatccacgcggagtcgccaccaac

SEQ ID NO: 60468 - DNA, 682 bp, Glycine max
  Peptide Sequence Number=SeqID_152153
atgacggaagaaaaagggcggcagctgatcctcgccgacggcaagcacagcgctgatgaggagcgcgaagcgatccagtacctgctcgatatgcgctgcgacgcggtgattatctatccgcgtttcctgagcgtggaagagatggatgagatcgtcgagaagtgcgagcagcccattatggtgctcaaccgccgcctgcggaaaaacagcagccactgcgtctggtccgatcataaagcctcgagccaggatgcggtggcgcagctgattgcgaaagggcaccgggagattgcgtttatcaccggctcgctggactcccccaccggggttgagcgtctctccggctacaaggacgccctggcgcagcacggccttccgctgcgcgaagggctgattgcgcaggggaagtggaacccggccagcggcgcggcggcggtggccgaactgcttgcgcgcggtgaacgctttaccgcgctggtggcgagtaatgacgatatggcaatcggtgccatgaagcagctgcacgacagcggcgttgcgacaccggaggcggtgtcggtgatcggtttcgacgatgtggcgatagccccttacatcgtgccgtcgctctccagcgtgcgcatcccggtgacggagatgattaaagagaccatcagccgcctgatcttcatgctcgacggcg

SEQ ID NO: 60469 - DNA, 300 bp, Glycine max
  Peptide Sequence Number=SeqID_152154
atggatgaaatggacatccgtgtccgtcatcctctcacgaacgcatgtttgcttattcaactgtcaccggaatgtgggtgcaagccattggtctatttgctcaagcgacctgcgctcctgagtgttgacttccaagactgttcaatcagagattactcgtcttgcacgttggtgggggtgccggatacccttcccttgtgttcaggaatcctctacaacaagagacccacggtctctaatcccttttcagaaataagaagaagagaagaagaggtctctcgtaaaagaggtagattgtaa

SEQ ID NO: 60470 - DNA, 158 bp, Glycine max
  Peptide Sequence Number=SeqID_152155
atgggatcaagtcaaaagccttcgcttaaaaagaggttctatcaagtcaaaatcaagagcttagaggacttcccagctagtgccaaacgtgtggaagagtttgaagaaattcctgggatgcccactgggaggaaggaagccatatcttttcctctggg

SEQ ID NO: 60471 - DNA, 826 bp, Glycine max
  Peptide Sequence Number=SeqID_152156
atggtggagagacctggcagcacaagtggcccctcccttggtcgaaagggagatgattaccatgatggtagacaccttgccaagggaagttcgattatgtctcctccacaagtgccaatgctaggagaatcggagcaattggggcaaaaaggaaggagggggatacccatgccatcacttcggcgcccgcatgggtcaagcccccgtagacctcttatggtacccatcagtacacgcaacatcacccgagcttctcagctcatgccgggaaatcttccaattcagtacccgtacagcctaaggtgcccgcccccatccagagggaggccccccaagctccggctccagccacgactcatctggctggcaatgcctactttggcgccagttcaacgagatgaggaactttcccccgaggccaattccagaattcaccccactcccaatgacgtacgaagacctcttgtcgtccctcatcgccaaccatttggccgtaataactcccgggaagatctaccaaccccctttcccaaagtggatcgacccaacgtgaaaaccaacccgctcgccaatcatggagggggagcggttaataccattgagtcagataggccgtgcaggtctaagcctttaaaggacgtggcgacccctaggaggtttatctttgaggccctacaaaagggaggtgtaattccccacggtgggcatgaagaggattcttgtttgttgcatcccggcgagctacataacatggaaacatgtttagcagtggaggagttgttgcaacgaatgatagatcaaggccgactggaagttggtgatgagg

SEQ ID NO: 60472 - DNA, 336 bp, Glycine max
  Peptide Sequence Number=SeqID_152157
atgaatttattgcctagcgttgttcatgtgtcctccaccattgagtctggagccccgcgaattcattgcctagcgatgttcgccaattctccattctccacttttattcggagacccatgaattcattgcctaacgctgttcatgtgtcctccaccatcgagtctggagccccgcgaattgattgcctagcgctgttcgccaattctccattctccaatcttattcggagacccatgaattcattgcctagcgctgttcatgtgtcctccgttatcaagcacggagcctctgaaaaaaaagaagaaggagtagagacgagagtcgtcatcacgtaa

SEQ ID NO: 60473 - DNA, 368 bp, Glycine max
  Peptide Sequence Number=SeqID_152158
atgtataaaactacaataacccatattggtctccactgtagtggacactggcaaatggtcgtcattttgcctaaggaaaaccttgttgtctggttttgttccttgcataacaggccagacaactaccttaaaggaataattaatagtgctttgaaaggacttgatgatactccacaacctaaatccaaggctggtgctaggtggattgttgttaagtgtaatagaaaaaaaggaagcactgagtgcgactattacgtcatgcactggatgtccacgatattcttaggaagttttaggaataattgggaaacgtattttaatgatgttagaccattggaagcaaagagattgaaggcgtttcacatcca

SEQ ID NO: 60474 - DNA, 393 bp, Glycine max
  Peptide Sequence Number=SeqID_152159
atgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcgtgtcggcatctgaggcagactctacggaggatagcggcccgagggagatggcgatcagcggaggctcttcatcatatggaagtgaagatgatgtaaggggtgaagagtctagtgaggaagtctacccccatgaagaaggtgacctcttaatggttagaaggctccttggag

SEQ ID NO: 60475 - DNA, 696 bp, Glycine max
  Peptide Sequence Number=SeqID_152160
atgaaagataagagggatgaggaagaaaaactagaaaaacaaaagaaaaagaaggatagtaaggccttgtcttcaaaggccaaggggaaggaaaaagaggaaaaggattcttccaagaagattgttaagaaggaaaatcattttgccacaaaaggtgatattaaaagagcactcattcttaaacaatctttctaccttctcctatcaagggaaacatcccttaccaccgccatacctcttaggcttgagtttatccctcaagtaaaggagttgttggatgagggtttggttcgcaagagcttaaatccttgtgctttgttggtgcccaaaataggtattattaggcaccaaatccctatgataggtggtatgatgaatgtgttgagtggtgaaacactcttttgtaaaatcactcatgcacccaacatcttcatgatttgtgtacataggaactcattaggtagtgatcaaggccttcccatggaccctaagagaataaaggtcattcctaagtggcctactccaccaacaccactcattgagttggtgaggaactatattctctcatgggaagatgaccaggaaaggggtgctgaggaaagaatccatgagtttcaagaacctctggatttgaggtcaaatccttttcaagggggagggaatgatgcaatcctaccccccaagggcattggatag

SEQ ID NO: 60476 - DNA, 324 bp, Glycine max
  Peptide Sequence Number=SeqID_152161
atgatttcaagattgagtcaagaacaattcaagaatcaagagaaatttgatttcaagattcaagaaaagatgaattcaagattcaagagaagaaatcaagaagacttcacaagggaaggtacatcctttgtggtacaagtagagggtacatctacttgggttgttgtgactgagaacaagagagggtacatctcttgtggatcagttctagtggagggtacatccactaggttgttcaaagagaacaagggagggtgtcgcaatgtgcccttttgcgggcgagcgagggcgaggctcgcgggtgcgctttccaaaggaggaaag

SEQ ID NO: 60477 - DNA, 173 bp, Glycine max
  Peptide Sequence Number=SeqID_152162
atgacgttagtcactgcatgctattgggctttgagtcttacggatagcaaaatgagaccttttcgcagtctcgggcggaagaggatgacatctccggggaagatagcaaatgaaactttttcacagtctcagtcgaaagacgatgacatctccggagaagttcagatgatgac

SEQ ID NO: 60478 - DNA, 683 bp, Glycine max
  Peptide Sequence Number=SeqID_152163
aggtcatttgctcaagattgatgctgataatctcaacgcattccttgagacagctgtgggccatcctgggaagattctcaagaaagatctgactacactagctcaggtgtggagtgttctctcatactccaacttggcccccacatcacatacttctgatttgatagtggagagagctaggctgatctttggcctagtctctcacatggatatgaacataggagcgcttatctctggccagatgacttctacagcccagtctaacacttctagacttgggtttccagctctgatcaccgcattatgtagatccagaggggttgtctctgatagcctcacttttgagcgcctgagcccggtcattaacttggcctacatcaggaaaaactgttggaaccccaaggctctaacaatttctatccgaggggttaggagggtgagggctaggccagctgagctcccttccacttttgcggctcctactccagcatccatgtcagtggtggcgcctctaggatctattccctcagtcgagcagttcaaagagatggtagtctggtctaggaatcaaccttctcttcacaaggaagataaaggtcccacagctcaggtaccacagaatatggaggatgagttctctgaggccaccattccagagccatttactgcaggggaggaggcag

SEQ ID NO: 60479 - DNA, 495 bp, Glycine max
  Peptide Sequence Number=SeqID_152164
atgacatcaagcaaaagggcaagaacagatgacatcccttcatcatccaacctagctcatccaacaacagccatggaaccagatgtccagcactcacatactgtaatccctatgctgcaaagtttatttagggggcagttgatgatcatgtataacccacaagagttggctcacaataggccaatcatatctatggagcattttcttgaaaaagtggcctggcctgaagctcagcttccattggagaaatcccatgagcttgttcctcctgagcccacaccaacaaggactaagccaattccagctgaaccacaacctccagtagtggatccacctctttctcctgagctcgaaatattgtctcctccaccagctccagctccacctctgataatcgtctctgatgaatcatctgatgaagctgctacccctcctgattcaccatcttgcaacatagatgatggtgctgacttttctgattggatgaactgctga

SEQ ID NO: 60480 - DNA, 642 bp, Glycine max
  Peptide Sequence Number=SeqID_152165
atggcattgccaaaagaaagaataggcatcttattgagactgctcggacattattacttcatgccaatgtacatgtccgacattggggtcttgataagcttgttgctcgagccatcaaatgtgttttccttggatattccaaattacaaaaaggttaccgatgttactctcctattcacaatcgtttatatctctgcagatgtaacattttttgaagaaaaaccatacttttctccctctatggttgagtccaatactcttcaagaagtttttcctattccctatcttggtccatcaccttctttgcaagaatcagagtcaactgtagattctaccatagatattcctaataatcctccacttgagcaaactcaaagatcacccatcgtatatcaacctcgtcctcgaattcttgtcgtagaacttgaaggtaatgaaagaccagttgaatcatgccctagtccaacggacaacccgaccatggacctacccgaagagaatcttgacttgctcattgctcttaggaaagatactcggtctacacgtaatccttatcctatttataacttcttaagttatcatcgtctctcatatttgtaccattcttttgtttcctctttatcttttggtttctcttcctaa

SEQ ID NO: 60481 - DNA, 46 bp, Glycine max
  Peptide Sequence Number=SeqID_152166
gttgtcgtcccttgtgacggacgcgtggggtgctaatatcttcccc

SEQ ID NO: 60482 - DNA, 468 bp, Glycine max
  Peptide Sequence Number=SeqID_152167
atggctccgaaaaagctttccacgaagaggtctaggagagacgtcgcggcagaagggtccaatgccgcccccaagtttgatagccattgtttccggagcgccgagcacctgcagcgcttcgaggccatcaaaggatggttgtttcacagagtgagacgcgtccaactcggggaggatgagtatacagattttcaggaggagatagctcgcagacattggacgtcgctgctgactcccatggctaagtttgaccctgaggtagtcctggagttttatgctaatgcttggcccatagaggagggagtgagagacatgcgttcatgggtgaggggtcagtggattccatttgacgcagataccctcagccagttcctgggtgacccgctagtgttggaggaaggtcagcagtgcgagttcagccagaggaggaacaggaccgacgggttcgacgaggaggccattgcctag

SEQ ID NO: 60483 - DNA, 873 bp, Glycine max
  Peptide Sequence Number=SeqID_152168
atgaccaatgcattgaaagaggctattaaaaaagagttgtcaaataaaggatcccaagaggcactccaaattcagccggacatacaacaactaggtgcgcgtgtcagcacacagggaagtaatgctgttaccaatgcgcaggcttcacaagaacatgatgctgatgccataccattgatgggactgtttgtgcagcgtaacgatggtacacaaaggttggtggccatggggaaaataatggagggggattcaatcatacacacagtggcatatgcagatgatgttgtcagggtaagtgtagaaacagttattgatcctgaggctgaggtcccctatgccacctcagaaatacaatatgtgaagcaggccgtcaatacatttgtagcttggcccacacaccttgtgaaagctgtattagatgagcatccacaacgtattccacacaacgaggatgcacatgtgccgaagccggctaatgtggacgcagatgatccgttgcgtgaattgatgaagtacagtttccatatttacgacaagccacttgaaatcagctttgatgggagctttcttggaattgtagatgcatctacatcgatattcatcacatattcatatgttattgaaataatagcaggagacaaaagtctaaacatatctgtcatacaattatggttaatgtatatgcatgagtggagtcagatattcagtcaaggtttcatacgcagcgaatgcgaacaatatcttgaaagatggcttaaggaatctgaccgagaggtgtacattggaccttacttccatcatgtaatgacaaaattgaagaagaccttgtctcctaaaactaaggcagttgcaccaaagtggattgaagtaaag

SEQ ID NO: 60484 - DNA, 153 bp, Glycine max
  Peptide Sequence Number=SeqID_152169
atgactaaagcacgtcaaaagggggtacggaaagtaaacgaaatgaaaataaaaggaaaagagggagaagcttgccaccgagctcgcccaggcgagctaggttgtgccttttggaggaacttcctagaaggcccaagtgggcctgctttctag

SEQ ID NO: 60485 - DNA, 363 bp, Glycine max
  Peptide Sequence Number=SeqID_152170
atggcgatacatttatacaaaacttctaccccaagcacacgcaatggagccgtagacagtcaacatcgttgtggtaaaggccgtaatgccagaggaatcattaccgcagggcatagagggggaggtcataagcgtctataccgtaaaattgattttcgacggaatgaaaaaaacatatatggtagaatcgtaaccatagaatatgaccctaatcgaaatgcatacatttgtctcatacactatggggatggtgagaaaaaatatattttacaccccagaggggctataattggagataccattgtttctggtacagaagttcctataaaaatgggaaatgccctacctttgagtgcggtttga

SEQ ID NO: 60486 - DNA, 840 bp, Glycine max
  Peptide Sequence Number=SeqID_152171
atgtacgaccagttagatgaggcttgtaggaccaccacccgacagcttgcggggtacttgacgctatttcagtgctggatctatgagcacttccctagtgtgcatcagtgcgtgactgacgacacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggagcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtagcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggagacccagtgctgatgggacgatcagggctcgtcagagacgccgcacggaccattga

SEQ ID NO: 60487 - DNA, 147 bp, Glycine max
  Peptide Sequence Number=SeqID_152172
atgcacatgttcgaccagaatacttgtttactccctcttccaaattggtattacttgtttttatataggagtggtcttaccggcaagcgcaccgggtcgccaaatgttcccgtgttctatgctgaggacaaaaatatcaaacactga

SEQ ID NO: 60488 - DNA, 1155 bp, Glycine max
  Peptide Sequence Number=SeqID_152173
atgacaacaaaatttgatcttattgttgtgggtggcggaattctgggaacattccacgcttatcatgcactaaaaagaaaccttaaagtagctttggtagagaaaaatgcacagcctcagggagctacggtaagaaattttgggcaggtggttccatcgggaatggatcttaaatggcaaaatttcggaagagagagtctggccatatacaatgagctgcaatcccaaacagatctaacaatacgaaaaaacggttctgtttaccttgcttccagtgaagaagaacttaagcttatcaatgagctttatgacatcaaccggaaaaatggttacgagtctgttcttctctcaaaaaacgattgtatgaagaaatttgatggacttcgttcagattattgtaaaggcggattattctttccggaggaactttctatagattcgggggaaatgatcgtcaaacttcataaacttttacaggaaaaactggatttaaagatctataataatacgaccgtaattgaaacgtatgaagataataatcaatgtgttgcccagacatcagacggacagcagttacaggctgcaaaaataatcatttgcggaggtcatgagtttaaaaccttataccctaatgtattcaatgaaagcgatttagtggtcacgaaactgcagatgctacaaaccaaagctcagggtatttattccttacagggaaatatccttaccgggttatccatcagaagatacgagtcctttcaggaatgcccttccttccaggaaatcaaggcgttagaaacccctgattctttcgaaaagagatatggggtccatattctatttaagcaggctcttgatggatctatcattttaggcgattctcatgaatatgcaagtgcaaaggattcggatgccctgggatatgacctgaatatggaaattgatgagtttatgatcagcgaggccaaaaagatcattgatcttccaacctatgaaattcagagaagatggtttgggatctattctcaatgtaaaacaaaagatattttcgaacataatccatctcccaatattcatatcatcacaggtatcggcggcaagggtatgaccgcaagcggtggattctcaaaatttaatatagataaaatatacgcataa

SEQ ID NO: 60489 - DNA, 384 bp, Glycine max
  Peptide Sequence Number=SeqID_152174
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccggcaattgtagatagagaacgtgctaaaggctcctattccttgggcccctatctgttctcaaaattgttggctgagatcccattggagcagcatttccattaa

SEQ ID NO: 60490 - DNA, 186 bp, Glycine max
  Peptide Sequence Number=SeqID_152175
atgaaaggtcagggttcttctcggtgtggggtttcaacggagaacaacggcggtttgtggtggctaatggtggttgtgggtgatggagaaagagcttggaacgttggaaatggttttggaagaaagaaaggagaagaaatggcgtttttcctaagctacatggattacaaggctcaaaacgcataa

SEQ ID NO: 60491 - DNA, 403 bp, Glycine max
  Peptide Sequence Number=SeqID_152176
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtacccggtaggcgctgcaccatgatggttttctttgcgcctaaatga

SEQ ID NO: 60492 - DNA, 222 bp, Glycine max
  Peptide Sequence Number=SeqID_152177
atggcaaagggaaaaagtattgacatccaatctcctccaccattttataagatttgcggaaaacatgcaaaatatttcaagtctaaggcacaaatgtgtattcgccagaaagctcctttacaagttaatggttggagtgaaattagtaaagatgatgtagatgaaatgtggcgacatatgaaggaaagaagcttgacaaacaaagctaatcgaagcaagtaa

SEQ ID NO: 60493 - DNA, 384 bp, Glycine max
  Peptide Sequence Number=SeqID_152178
atgacaagcagagacaaaatttggtcattctgcacccttgtgtcatccagagccgtcgggcccgatgatacgcggagataccttacggttatccacacccttgtgtcatccagagtcgctgggcccgatgatacgcggaaataccttacggttatccgcacccttgtgtcatccagagccggcgggcccgatgatacgcagagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggtggcgggcccgatga

SEQ ID NO: 60494 - DNA, 846 bp, Glycine max
  Peptide Sequence Number=SeqID_152179
atgtctcctttccttgtgagggatttcggcgcgcaaaatttcaaggctatacaaagaatccataaggcatgggaaaccccgttaagaaaagatcaagaacttaggggcattcgtaatggcatcattggttgctaccatgaatggctgaaagttcatatacgaggtttagattggctcgccaagttaaaagtcgtcagcgaagagagttttgaggcaccggaggaggacgaagaagtccaagctctcaaaagtgaggtaggaaaggcaaaacttgccaaggagaagttcaagttggccgctacacacatccagaaagagtgtgtcggattacgggaagagaatgcaactaccacgagagcccttgaacaagagaccaagagggctcgcaaggaagagtatggccgtaacaaatttcgcggagctttgtggggtagcaacagtgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggtctagccacggcccacgagcatagggtcgcggacgagtatgctcaagtatacgcggaaaaaaaggctagaggaagggtgatcgactctttacaccaagaggaaaccatgtggatggatcggtttgctcttactttgaacgggagtcaagaacttccccgtttgttagccaaggccaaggcgatggcggacacctactccgcccccgaagaaattcacgggcttctcggctattgttag

SEQ ID NO: 60495 - DNA, 78 bp, Glycine max
  Peptide Sequence Number=SeqID_152180
atggctctttctttcacagaagctggaacaggaaagagtgaggagctcaagtatgctagagacatagctacactataa

SEQ ID NO: 60496 - DNA, 427 bp, Glycine max
  Peptide Sequence Number=SeqID_152181
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgaaaatacagagaataggagagacaattctcctccaagggtttccctttcctcaaagagccaaggctcagttggggatcctctag

SEQ ID NO: 60497 - DNA, 502 bp, Glycine max
  Peptide Sequence Number=SeqID_152182
agcagaggttggtccttcaggtgctcatgttagcacaaaggagagttgtgttgctctctcagggaacgatccagagacgggtgactcagacaaatgcgggctatacattgaagaaaattcttcccgcctagttgccctaggaagactatatgagggatccacagcagttcacaacatccctttgttgcatgaccaagtcaaggttggtgttgaggaggttaaagatgcggagactctcattcctgtacccactgacgaggttatgtgggatgctaccatgttcggggtgtttaatcaaaacttctcgttgtacataaagcacgaagatctctctgaaattgcacacggtggtcaatgtctcagcatatctgttatacagttatggatttcgccagacaactatcttaagggaataattaacagtgctttgaaaggacttgatgatactctacaacctaaatccaaggctgctgctaggtggattgttgtggggatcctctag

SEQ ID NO: 60498 - DNA, 492 bp, Glycine max
  Peptide Sequence Number=SeqID_152183
atgatcggccctctcgatgagtcaatctcttgctttttcataagggtggacccttgggtacacgccctcgctttcagaggactacacgtcctcaccttcagaggactgcatgtcctcactttcagagaactacacgtcctcaccttcagaggactacatgtcctcacctttagaggactgcatgtcttcactttcagaggactggacgtcctcaccttcagagggctacacaccctcaccttcggaggactatacgtcctccccttgagaggaatacacgccctcgccttcaaagggctacatgcccttaccttcagaggactacacgtcctccctttcagagggctacccgccctcacctttagaggactacatgtcctcgccttcaaagggctatacgccttcgccatcagagggctacacggcctcacctttagaggactgcacgtcctcaccttcagagggctgcacgccctcgccttcagagggtga

SEQ ID NO: 60499 - DNA, 183 bp, Glycine max
  Peptide Sequence Number=SeqID_152184
atgctcaatggaatgcccccggggctcctccatgataagcacacattgcgttcgagcaagttagcatgtgacaccggaatttgggggatggtctttgtggataactgggtggtaggtaaggagaagggttgttattggctgagtaatgacattcttgggttggtgggaaacttggccgtatag

SEQ ID NO: 60500 - DNA, 553 bp, Glycine max
  Peptide Sequence Number=SeqID_152185
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctgaaacgttgaaccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60501 - DNA, 463 bp, Glycine max
  Peptide Sequence Number=SeqID_152186
gaagcggaagagcgcccaatacgcaaaccgcctctccccgcgcgttggccgattcattaatgcagctggcacgacaggtttcccgactggaaagcgggcagtgagcgcaacgcaattaatggatgaagctgagcttgtcaaagagatagttaaatgtgtgtggatgaggttgaatcatgcgcaccaagttaactccaaagggcttgttggagttggtaaacgaattgtacatgtagaatcattgctgcaattagaagccgcggatgttcgtattattggaatctggggcataggtggtattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60502 - DNA, 282 bp, Glycine max
  Peptide Sequence Number=SeqID_152187
atggcaagtagtggagtttacgtagcgatgtgcccccgccctttccatcttggatttgcccaaacgactcctagagtgaacgacttcctcttgctttgtcccggcctactcattgtgatgcaaagaaagatcgtcacctccttgatatccagaaagaaccggcgtgaaaaagctccatttcacaggttagcggcggaaagggcaatgccggcttcatcgacgaggaatgcttccaaccagcctaagcgtgatagctgcacccagagcaagcaacctggatag

SEQ ID NO: 60503 - DNA, 216 bp, Glycine max
  Peptide Sequence Number=SeqID_152188
atgatgacattcaagaatgatttcaagattgagtcaagaacacttcaaggatcaagaggaaatttgatttcaagaatcaagaatcaatgtgttttgatgcaatcctaccccgcaagggcattgggtagaagactccaagtagattgggctagagatccaagggaatgccctagggttctcatgagccttagggtagatttcgagcccatgggctaa

SEQ ID NO: 60504 - DNA, 327 bp, Glycine max
  Peptide Sequence Number=SeqID_152189
atggaggccatgaaagagcaaatggccacaatgatgaaggccatgatgagcatgaagaagataatggaagccaatgcggttgcagttaccgctaccagcgttgttgctaagctgaacccgacgcccccatctggcctcaaccaaatgaatcatccaacctcagatatggtaggcaaagatttaggaagtacgagcggcctccattatgtgcaatttcaaaacaagcacgccttcccgccaaatggcttgccttccaactatacaccacccaatgtggcgtacactcttggtgaggatgtcaataactccatctcccatactcattga

SEQ ID NO: 60505 - DNA, 324 bp, Glycine max
  Peptide Sequence Number=SeqID_152190
atgcacaatgataaaccttttggaggaaaggtcattgtttttggtggtgatttctgtcaaatactaccagttgtgccaagaggtagtcgctctgatatcatgcatacaagtctaaatgcatcatacatatgggatcattgtcaagtttttaaattgacaaagaacatgcgtttgcaaaacaatgttgtcgataccagtagtcatgacctccaacaattttctgattggctactagacgtaggtgatggcaaacctaacgatggttatggtgaaatcaccattcctgatgagtttcttatcaaggactttaatgatcctatctag

SEQ ID NO: 60506 - DNA, 695 bp, Glycine max
  Peptide Sequence Number=SeqID_152191
atggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaataggtctgctaaaacaatctactttcataatttaggtcgattcgatggcattttcctacttaagcaccttgcattatatcatcctaattacacggtcaccccccttatgagagacaatagactctacgaggtagctgtctattctaaaaaaaggctattatttacattccgagactccttacatctactccccggcaaactagatgaccttgctaagaatctatgccctgagttgggttctaaaggatctatttcctatgaggatgaattctcaatgcctgggggtacaccagtctggcatactgatttagaatatatgacattagataacatgtttgggttcattgaagcatatgtagaatgcccaaaaagtataaagaaaccatttcttccctatcgggataataaggatggcactcttatctttcctacaggcacctttgtaggggtttactatagtgaggagctcaagtatgctagagacataaggctacactataataccaatttgtggatacctcttcgaggagatggaaa

SEQ ID NO: 60507 - DNA, 195 bp, Glycine max
  Peptide Sequence Number=SeqID_152192
atggagaaaaatgaagaaacaacaatggaagagaagctcttgtgctctgattaccacttgatggaagcttgcttgtggggcttctatggaggctggatctttgagcttcaatggggtcctttaatggtgattttccaccatggagatgcaccggaagacaaaggaaaagaggtgacaggaggtgccatccattaa

SEQ ID NO: 60508 - DNA, 159 bp, Glycine max
  Peptide Sequence Number=SeqID_152193
atgttggctactggtaatcaattactgccttctggtaatcgattaccagagagtaaaactcttgatggacctggtggcaaagtggagagcatggcggctaagaaggatgggcttgccaaggtagttgctaatttagaggtggcccgacttaaggagtag

SEQ ID NO: 60509 - DNA, 762 bp, Glycine max
  Peptide Sequence Number=SeqID_152194
atgaaggaattctatgccaacctctatgaccccgaggacaaatcacctaagcatgtgagggtgagaggtcatctgattaaatttgatgaggatacgcttaatactttcttaatgacctctattattgtggaagagggggaatcactctgtgcttattccagatttgcactcctgaggcctgatcctcaggagttggctgctaagctctgtatcccgaggaggggattcaagcttaatgttgatgggcagccgatgatgattttgaggaagaacatgaccaccttagctcagacatggagtgttctttccttctctaacttgattcccacctcccacacttctgatgtcactcttgacagggccagactcatttatggcattattatgaagatggatatgaatgtggggtacctcatttcccaccagatctccctcactgctcagcatgatacatccaaacttggattcccagccttgactacagctttatgtagggctaggagagttcagtctgactctagatccttggagagcctgagtcctatctttaatttggcttatattaagaagaactgttggaatcttgatgatccaacagtaactttcagaggacccaagaaggccagagggaagagatctgaggccccttccacagcaccatcagaggcaccagcacctttttcttctacacttcctccttcttcctccatagatattctagtgattcctccagcaccttcacagataccactaccagtgtaa

SEQ ID NO: 60510 - DNA, 268 bp, Glycine max
  Peptide Sequence Number=SeqID_152195
cgcacccgtgagcctcgccctcgctcgcccgcgaagggcacgttgcgacagtgatgacaaaaagctcaaagatcaatcaaagaacaagtcaagtgaatcaagaataattcaagagttcaagataagaatcacaaagaattcaagaactcaagaagaaagtctagagacgagaatcaagattcaaggttcaagatctcaagaatcaagatcaagattcaagactcaagattcaagaatgaagagaagactcaatcaagataagtattag

SEQ ID NO: 60511 - DNA, 441 bp, Glycine max
  Peptide Sequence Number=SeqID_152196
atggtagaagtctccacagaggccattgcctccctcgcccagtattatgatcagccgttaaggtgcttcacctttggggacttccagctatcacccatggtggaagaatttgaagagatcctaggatgtcctctaggggggagaagaccatacctcttctcagggttctatccctcattagctagaatttctaagatagtccaaatctctgtgcaggaattagaccacaggaagcaagtcgaaaatggggtggttggaatatcgagaaaatatttggaggcaaaagcaagaatcttggcaagtaaaggcgagtgggccccgttcatagatattctcgcactgttgatcttcggaggagtcctctttccaaatgtggatgagttggtggacctagcaccaatcgacgcttttctcgcctatcataaccacaagggaagcccg

SEQ ID NO: 60512 - DNA, 511 bp, Glycine max
  Peptide Sequence Number=SeqID_152197
gacgcgagtagcacattcattgcatggcccagacatctagtgaagcctataactgatgattcaaatcataatgcgcgtttgccagttggacgtcttggtgaggctgaggttgcagtggaacctgatcctccagtggaagtgccgtgggaggcgacgcaatttggacttcctgatgttggggcaaaatttttcatcacacatgctgatctaacggaaataatatcaggtgacaagtgtttgaacatatctatcctgcagctgtggaccatttttatgaataactgtggtagaagcaaagttgatcagtcactatatggtctgttggagcctcaatctatacacaatgctaaggacagacgtgaacaatgccaagaatacattcaaacatgggtcaaggaatcacaaaggcagttgtacttaggggcttacttgcatcagaagaagccagatattaacatcaaagccacaattaacaggttctattcaaatatacaaatgatggtctgtggag

SEQ ID NO: 60513 - DNA, 267 bp, Glycine max
  Peptide Sequence Number=SeqID_152198
atgtcaaaaatagcctcgcccttgatcagggtaagtgcattgcgcactctaaaattcgcattcttcacaatagctatttctacttgctatgcagccaattctcaagagagcagcgcagcaaataaaaaggaagtaaatagtacttctcgcgcggaggtcatggccgatctggcactctggcgtcgtgccggagtcgaccgctatgaagtactgtcgacttcgaatatcttcgccttcggaatggtgaggaattccaggaagaactga

SEQ ID NO: 60514 - DNA, 228 bp, Glycine max
  Peptide Sequence Number=SeqID_152199
atgtatggtgttgcttgtcaatgttatgattcaacaagcgattctcctcaaatttcagccagcccgtatcaattagacttcacactttatgcttcggggtcatacaatgctcaatggaatgccccagggctcctccacgataagcacacgttgcgttcgagtcgtatcctcagaaaaatggaggtggtcttcgtcattggaagtgcggtagacaggctttgtggttga

SEQ ID NO: 60515 - DNA, 525 bp, Glycine max
  Peptide Sequence Number=SeqID_152200
atgacctcctcaaatcccttgtttcctaaaggaaattccattcacagacaacccatttttaatggagaggccatagatctaaatatatgggaagcaatagaattaggaccacatatacccactataagagatgtaagcacaatcactacaacccaaaaaccgagagatcaatggacagaagaagataggagaaaaatccagtatgatctcaaagccaaaaatatcatcacttcagccctagggatagatgagtactttagagtgtcaaattatactaatgccaaggatatgtgggatactctccagttagcccatgaaggaaccacaaatgaacacgagatggaacttcaacgcctcaatcagaatgaagaaaatgagaaaaagaagagaagcatagcccttaaagcctcatcttcaatacaagaagaaaacgaagaagaagattcagatgatgaagaagatttttctttctttgttaagaaatttcagaaattcatcaagaaaagaagaattgacaggcgttag

SEQ ID NO: 60516 - DNA, 370 bp, Glycine max
  Peptide Sequence Number=SeqID_152201
aatattgctaagtagcaatgtcatctatgtaagagtggtcatgttggtgcgcatgatccgcactcgtctctttgcagtggcaacggttggcgctcctccaatatcaggtgagggtgcagcccatgggaggaaccgtgtaaaaggaaactactgcccactgaaagtgaggacacgtagtacctctaaggtgagggcgtgtagccctttcaaggcgaggacatgtagtcctctagaggtgagggcgtgtagccctctcaaggcgaggacatgtagtcctctgaaggtgagggcgtgcagccctctgttggtgaggacgtgtagtcctcccaaggcgaggacgtgtagtcctcacaacggtgagggtaactag

SEQ ID NO: 60517 - DNA, 249 bp, Glycine max
  Peptide Sequence Number=SeqID_152202
atgggtaaagcagaggaggtgcaagagaaggtgaaggccgatatggagaccatgaaagagaaaatggccacaatgatgaaggccatgatgagcatgaagaagataatggaagccaatgcggttacaattgccgctaccagcattgttgctaaggtgaacccgatgcccccatctggcctcaaccaaatgaatcatccaaccttagaaatggtaggcaaagattcggggagtagggacggccccccatga

SEQ ID NO: 60518 - DNA, 735 bp, Glycine max
  Peptide Sequence Number=SeqID_152203
atggtgcccggcatcaccggcgacaaaccgctgccaaacccggtggccagcaggtgccacggattgctcatccgcagccggcgcttggcttcatccatgggtgcccggctccgcgttgaaatgatcgaacccagcccagtccagctctaccgcctcatcgtcgcgataatagcggatgccttcagacagcgggccaatttggccgatacaggtgtagtcggccccgaggtggctcaacgccacttccagcgcgccgcggttgatctccggcacggtgaagcacagttcgtaatcttcaccgcccgccagcgcccagcgcagcgcctgttcggcatcggcgtggctgctcagcgcctgcgacatcggcagctcgtccagcacgatgcgtgcgccacagtcgctggccttaaggatatgcttcagatcggaaatcaggccgtcggagatgtcgatcgccgagctggccagatcgcgcagcgcctgcccctgcaacacccgcggctgcggccgcagatggcgggcgaccaaataatcgcgcgccgtcgtttccgtcaccgccaaacgatcctgcaggatcgccaacccggcggcgctgtcgcccagcgttccggtcacatagatccagtcgccgatgcgcgcgccgctgcgggtcagcgcccgaccggccgggatcagcccctggatggtaagcgtcatgctcagcggcccgcgcgtggtatcgccgccgatcagtaa

SEQ ID NO: 60519 - DNA, 676 bp, Glycine max
  Peptide Sequence Number=SeqID_152204
ggtggacccttgggtactagtaccctcaccttcggaggactacacgtcctcccctccagaggactacatgtcctcgcctttagaggactacacgtcctcgtcctcagaggactgcacgccctcaccttcagaggactgcacgtcctcgcctttagagggctacgcgtcctcattttcagtgtgctccatatccacaccttaagagaatttaagtttcctttcaaccgttcaattcctgggccaccccctgatcctggaggagggccaattatgcgagcacaactagaagaggaggctatcgtacaaccactatgcatactggggcaagatttcacccgtgccgctacaaagagacgagtgcgcaccaacatgaccactcttacacagatatggatgatgttgctacttagcaacattctacccaatgactgcaatgccgatctgcccctgtggaagtatcagttggatctttcccacaagacacctagtggacccggagaagtccaacagggccccagggtttccagctctgattacgagcctttctccgattacgggcctctgttaaccgtcgcccccagcaagttcatcaggccccctattaaccgggctttcatcaagaagttctgcgcccccaggcaggcgcagggcgagacaccacagcagcctagggatg

SEQ ID NO: 60520 - DNA, 426 bp, Glycine max
  Peptide Sequence Number=SeqID_152205
cattcaggcatcactcccaacaaagttgccaatgctgccgaattaagcaatgatgttcctaagcaggaccccttgcgtgagttgattaagacccttgttgacatttatgacaagcctgttgagtttgtgtgggatcttactgaatttgggattccaaatgtaaattcatcgttgttcttaacgtatattgatgtcagcgaaataacatcaggcgacaaatggttgaacatagccatacttcaattgtggaccatgtatatgaatgagtggagtaatggcttgggttatcaatcggtgtatggattccttgagcctcaatctatacacaatgcaaaggacagacgtgggcaatgtgaagaatatatcgaaaaatggcttaaggaatcgcaacgacaactgtacattggagcttatttgaatgagtaa

SEQ ID NO: 60521 - DNA, 522 bp, Glycine max
  Peptide Sequence Number=SeqID_152206
atggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttgataccttacggttatccgccccctccctttgccattcagacacagtcgtgttcgatggcaagcagagaccaagtttggtcattctgcacacatgatacgcggagataccttacggttatccgcccccctttgccattcagacacattcgtgttcgatggcaagcagagaccaagtttggtcattctgcacacatgatacgcggagataccttacggttatccgcccccctttgctattcagacgcagtcgtgttcgatggccagcagagaccaagtgtggtcattctgctcacatga

SEQ ID NO: 60522 - DNA, 156 bp, Glycine max
  Peptide Sequence Number=SeqID_152207
gatgttctcgccgctgctattggacgtctagagcaccctgaatgtgtccgtgctgctggagccggtgtgaccatcaagcaatactttggatcggctccatggacgtcccgcagtgcttcctccttgcctcctgacgaattgcagcagctgacctag

SEQ ID NO: 60523 - DNA, 375 bp, Glycine max
  Peptide Sequence Number=SeqID_152208
atgaagggccgggaagccgccgctgtcgccgccgccgctcaaatgctgttggcctgcaatggccagagcatcttcgtttatggcaacgcgataaagaaatctggctgtatcccgcaagaactggaagcgttaatcggcagggttcgtttttctcgcattggattcgtcatcgctgaaacacataacaaaggctaccgctggcaacatgaagcggaagcgagctcgatgctgccggtggcggcgctgttcgccgatggtgaaatgcccgagcgagtgatggacgtcgccgctgcgccgggttccaagaccacgcagatagccgcccggatgggcaaccacggagcgatcctggccaacgaattttctgccagccgg

SEQ ID NO: 60524 - DNA, 529 bp, Glycine max
  Peptide Sequence Number=SeqID_152209
atgtttcaccctcaaactgttttagattcaaatgactatctaatctatcgtagaagaaatgatggtcgtaccatttcaaagaatggagttattattgataatagatatatagtaccttacaatgcaaaattgccgaggaaataccaagcacatataaatattgaatggtgtaatcaaaatacttccattaaatatctatttaaatacataaacaaaggttatgacagagtcactgttgttgttgtttatgatgctaatggtgcacttgagaatcctatcactcaaaatgatgagattaaagaatatgtagattacagatatatttctccttgtgaagctacttggagaatttttggttttccaatacatgctagaaagcctgttgtggagagattacattttcatcttccagggcaacacagtgttctgtatgaagacgatgatgatatagatgatatcctatcaaagccaagcatttcagattcaaaattcttagcttggatgaatagcaacaaatgtttttcagaag

SEQ ID NO: 60525 - DNA, 572 bp, Glycine max
  Peptide Sequence Number=SeqID_152210
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaagaatggtaagaatgcattgcatgtggtcacagctaaatacaatagcctcattcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcaggccgaccgttgcgccttatccggtaactatcgtcttgagtccaacccg

SEQ ID NO: 60526 - DNA, 443 bp, Glycine max
  Peptide Sequence Number=SeqID_152211
atggccccaaggaagcttgcctcaaagagatctaggaaagacaaggcggttgaaggaaccagttccgctcccgaatatgatggacattgttttaggagtgctgagcaccagcagcgcttcgaggccatcaaaggatggtcattccttcgggagagatgtgtccagctcagggatgacgagtatactgacttccaggatgagatagttcgccggcggtgggcatcgctgtttacccccatggccaagtttgacccagacgtagtcctcgagttttatgccaatgcttggcctatagaggagggtgtgcgagatatgcgatcttgggtgaggggtcagtggatccctttcgatgcggatgccctcagccagttcttgggataccctttagtgctggaggagggccaggagtgcgagtatggccagaggaggaaccaggccgatgg

SEQ ID NO: 60527 - DNA, 231 bp, Glycine max
  Peptide Sequence Number=SeqID_152212
atggctgaagaacatcaacacagggttacccttgaagattactccagtagttctgtgccacaattctttacaagagaagctaagaggtggctccattcattcaaaggcaatagtttgaagacatgggaggaagttgttgagaaatttctgaagaaatacttccccgagtcaaagactgcagaggggaaggcttctatttcatcattccaccagttccctgatgagtcctag

SEQ ID NO: 60528 - DNA, 327 bp, Glycine max
  Peptide Sequence Number=SeqID_152213
atggcaagcttcttcttccgcgctttgaaatttggttcccttctcctccacaggtattggcatcctccattgactagctttgttcgtttcttccaccatccagacgaaggtccttccgcgagaagaacctttttcaacgcatgtgggaggggcagttggatattgaagcagaagaaggagttcttccacgggaacctatggaagaaaggggagaaggttcttccgcgcgttccggcggaagaacgttcccaaggttcttccataggttcccgtggaagaactctttcgtcggcttccatatccaactgcccctccaacatgcgttga

SEQ ID NO: 60529 - DNA, 314 bp, Glycine max
  Peptide Sequence Number=SeqID_152214
atgagggctgcatcgcctgcagcctccagagtgaactataagtcctcgcctgaaggactacacgtcctcgccttgagaggactacacgtcctcaccatcagagggctgcacgccctcacctccagaggactacatgtcctcgccttgagagggctgcacgccctcaccttgggtactagttaccctcaccgtcagaggactacacgtcctcgccttgagaggactacacgtcctcaccatcagagggctgcacgcccttacctccagaggactacatgtccttgccttgagagggctacacgccctcatcttgg

SEQ ID NO: 60530 - DNA, 813 bp, Glycine max
  Peptide Sequence Number=SeqID_152215
atggatttcttttctgatgagagtttcgaatgcattcaagcatttcaaaactcaaatctcattccctttatgtctttaaaactgcctgtgtattctgaattggtaaaagctttttattctaaccttgaaattcaagaaagtaccttgatttctgaggtctatgggataaagatggtcattgaccaatccctcttctatgatttgacccaattgtctagcaaaggtgtgccatttgaaggaacactggatgatgattggatatttgatttttctgtgcatgatgcctgccggttggtttgcaccaacaaagcggatatgaccggaaggctgcttgccggttcattggctcttgaaagccaaatccttcattatctaattgttcatatcctactccctagatcttcaaaccttgcacaggtttctgaagaagatctaatagtcatgtgggcctttcataccggccgacaaattgattgggcacatctagtccaatatcgcatgcataaggcattgcgattaaatgctcctctaccctatccacacttagttactttgttccttcaacattttaacatccctcttgattctgaaccttatgttccaatcaagagatctttcttgatcggtgcttgctgtggttgcctcctttggtttgatggacttcaaacctatgttggtgagaggtttgactccttggaacgtcaagtggacacacgattcgaggagatgaactcaaggattgcaaaggttgaagaagatgtcaccattattcgtgactactttgatttacctccactaccaccatcagtttag

SEQ ID NO: 60531 - DNA, 642 bp, Glycine max
  misc_feature (50)..(50): n is a, c, g, or t
  Peptide Sequence Number=SeqID_152216
ggagtgatgctgtaccgaatgacagagagctgaatgggaaagctggatancagttgtgtgcagtgctatggcaatctgttgaaccggatgttttggagatccttagatcattcaaaacatgtagctctttttggaagaaagcacaagagatatttgccaacgacatacaaagtttgtttgatgcaacccagaaagttgctgctctcaaacaaaccagccatgatatgattgcgcatgtagggaaagctagagcagcagtggaagaactgaagagatttcttgcagcaaaatcgttggaggaagtgaataggaagctggacaagttctacatggtccttatcttgagaagtctacattcagattttgatcatgtgcgtgatcaaattcttgcaggtgaccaagtcccgtcaatggactccctcattactagacttcttcgcgtgcctcaagccttgaaagaagaaaatttagctgaaagtgtggaaacatcagctatggctgcatctcgtggaagagggggagtagctcaggtagctcagaccgaaaaatcagagcctaagttctctgatacagagtatcaggagtatctaaagctgaaatccgagaaatccagcagtcaggcttcatcttcctctgtaccat

SEQ ID NO: 60532 - DNA, 708 bp, Glycine max
  Peptide Sequence Number=SeqID_152217
atggttagaacacgaggtttaagtcgtgcgttaggagctggtagaggtagaggcattagtgaggatgcgcatgaggctgatgttcctcggcgtcgcaggcctactgcttcagcacgcaggcaacgggttcgtctgcgtgaggacatcactgagagacatgaggatgtgcctcagttgcatgaggatatgacaggcgccgccgatgctgttcagacagagggagtggctactgatgggagcttggggtcacctgctgcagatgagggatttcccggtggaccacacgacccatcgattttgaccgattttgctgagcatgtcgcacacagcatctggagtggacaagaacgatccgatctgaagttggtctcccacggtagaaaagtagataaaattgggagaccagcgcctgagatcgaagggttgattgttggcaccggattaagtctactgatcaggtgttctgttatcaccactgatcttggactcatagccgccttcgtcgagaggtggcatcgcgagactaacatgttccacctgccagtaggcgagttgacgatcatgttggatgacgtggcgtcactcctacaccttcccatcactggcacgctgcatacgttcgagccgcttgttacttcagacgccattagtctactgacggagcttcttaaggtcagtcatgaggaggctacatttgagacccaatag

SEQ ID NO: 60533 - DNA, 312 bp, Glycine max
  Peptide Sequence Number=SeqID_152218
gtgagggcgtgtagccctctcaaggcgaggacgtatagtcctctggaggtgagggcgtgcagccctctggtggtgaggacgtgtagtcctttcaaggtgagggcgtgcaaccctctgatggtgaggacgtgtagtcctctcaaggcgaggacgtgtagtcctctcaacggtgaggaggtgagggcgtgcagccctctgatggtgaggacgtgtagtcctctcaaggtgagggcgtgcagccctctgatggtgaggacgtgtagtcctctcaaggcgaggacgtgtagtcctctcaacggtgagggtaactag

SEQ ID NO: 60534 - DNA, 957 bp, Glycine max
  Peptide Sequence Number=SeqID_152219
atggctacctcaccaaaagaaacttcagctcctggttcaccctctgcaccatcaaaccaggaacgacctgaattcaatattcagcccatacagatgattcctggtcaagcccctggagtgaagatttctgaaaaccctagcattgcaacaagtcctagggaagtagacctggagatggataagaagatccgcagtattgtgagtagcattttgaaagacgcctctgttcctgatgctggtgaagatgttccaacatcctccaccccgaattactctcttcaccctgtgaagaggatcatcagaggaagaagatcaagccacagaggagacccctgcaccaagggcaccagaacctgcaccaagggcaccagaactgctccaggtgacctcattgatctagaagaggtagaatctgatgaggaacccattgccaacaggttggcacctggcattgctgaaaggttacaaagcagaaagggaaaaactcccattaagaggtctggacgaatcaagactatggcccagaagaaaagcactccaatcactcctacctcatccagacgaagcaaagtcacaattccttccaagaagaggaaagaaatttcctcatctgattctgatgatgatgtcgaactagatgtctcgacatcaaagaaggccaagaaatctgggaaaaaggtgcctggaaatgttcctgatgcaccattggacaacatctctttccactccattggaaatgttgaaaagtggaaatatgtgtatcaacgcagacttgcggttgaaagagaactgggaagagatgccttggattgcaaggagaccatggacctcatcaaggctgctggactactgaagacagtcaccaagttgggagattgctatgaaagtctagtcagggaatttattgtcaacatttcctctgacataacaaacagaaagagtgatgagtatcaaaaa

SEQ ID NO: 60535 - DNA, 739 bp, Glycine max
  misc_feature (3)..(3): n is a, c, g, or t
  Peptide Sequence Number=SeqID_152220
ggnttgcattaacaacgatcccgcacttgctataagacagttagggtaccccatgaggggagcaccgatagaagaaagcctctctcctttccttgtgagagattttggtacacaaagtttcaaaattatacaaagagtccataaggcgtgggaaagcccgttaaggaaagataaagaacttaggggcattcataatggcatcatcggtggttatcatgaatggctgaaagttcatacacgagggttagattggctctccaagttgaaaattatcaatgaggagaacttcgaagctctggaagaggatgaagaagtccgagctctaaaaaccgaactaggaaaagcaatacttgccaaagaaaaattcaagttggtcgctacagacgtccggaaagagtgtgccgagttacgagaagaaaatgcagctaccgcaagagcccttgaacaagaaaccaagagggctcgccgagacaaattccgtggagctttgtccaaaagaaacttgtctcagcgtttatgcgagacagaggccaacatgttatccatcgtcagcaagtacgaagaagaactaaatctagccacgacccacgagcataaagtggcgaacgagtatgcccaagtgtatgcggaaaaggaggctagaggaagggtgatcaactcgttacatcaagaggcaacaatgtggatggaccgatttgctcttaccttgaacgggagtcaagacttccccgattgctag

SEQ ID NO: 60536 - DNA, 557 bp, Glycine max
  Peptide Sequence Number=SeqID_152221
ggaagctgagtgtgaagtatgcaattctgcataggattggcgctgcaaactgggtacccaccaatcatacttccactgttgccacagaatcttttgctgtcaaattacccattgccttccctactgtattgtgtggcattatgttgagtcaacaccccaatattttaaactacattgactctgtgatgaagagagaatctcctctatccctgcactacaaactgtttgaggggacacatgtcccagacattgtctcgacatcagggaaagctgctgcttcaggtgctgtgtccaaggatgccttgatagctgaactcaaggacacatgcaaggtgctggaagcaaccatcaaagccaccacagagaagaagatggagctagaacggctgatcaaaaggctctcagaaagtggcattgatgatggtgaagcagccgaggaagaagaagcagctgagcaagaagaagaagaagctgaggaagaagaagaagaaaccgatgacgaagatgcagcagaggatacagaatccgatgatgatgattctgaagccaccccatga

SEQ ID NO: 60537 - DNA, 204 bp, Glycine max
  Peptide Sequence Number=SeqID_152222
atgttcaaatgtaaatgggttgacagcaacatcgatgtacgcaccgatgatataggatttacgctggtagacctaaagaaacttggttaccacaatgaccctttcatcatggcagaacaagctagacaaggcaaaacaattggtgttaatgaagaagataatgattcatacatggacacctatgttagtcctttgaccacataa

SEQ ID NO: 60538 - DNA, 356 bp, Glycine max
  Peptide Sequence Number=SeqID_152223
atggggaatttcatgtgtctcccccacggtttaggagatatgtgtatgatcagtttggggttgttggctctcaatggatatgggagtggggttattgacattcttattgggagtgtacgccacattgggtggcgtatagttgagaggcaagccatatggccagatgggggcatcgggttcaccttagcaatagtgctggtagcggcaattggcttccattatcttcctcatgctcatcgtggccatcatcgtggccatttgctctttcatggcctccatgtcggccttcatcttctcttgtatctcctctacttcacccattactctagatctagcacaagttcagtgagggcacc

SEQ ID NO: 60539 - DNA, 654 bp, Glycine max
  Peptide Sequence Number=SeqID_152224
atggcagagccatcaaagaagagaaagggatcatcctccaccgctaccgctgctgcccatcgccgtcacgacccatccggagcacccacagcacctattcctccttctttgtcatctccaagatcatcaacactgttttcatccgatgatcaacgtctacggtacctttctcagttttcttctagaataatcttagaccctaagtacctagacgtagagttctttaatgatgaaacgtttgattgctatcaagtgtttcaaaattctggtcttgttgatttcatgtcattaaaattgccatattatcctgaacttgtaaaggtcttctactgcaatttaaaaattcaggatggtattattatgtatgaggtgcatggtacttctatgatcattgatcagtcacttttcttttctttgactcatttacccagtcaaggtgcaccttttgagggcaccattgttgatgactggaaattcgattatttgagtcatgatgctcgtcgcatggtctgcaatgatcaagctgaaatgaccggtagattgttggccggaattttgcttcctcggtcttcaaatttagcacaagcctctgaggaggatttgattcttatgtgggcttttctaaccggtcgtcagatcgactgggcccatttg

SEQ ID NO: 60540 - DNA, 366 bp, Glycine max
  Peptide Sequence Number=SeqID_152225
atggtggcacggataatgctcaggcacggttatgagcccggaataggtctgggcaaggacagcctcgggaatgccgatgtggtcgacattaggggaaacccgtacaattatgggttggggtatgaacccgggaagccgggaagaaggaatgcaccgtcaagactccgggcagatagagcatggcccggccatgttagccagtgtttcaccagtgtcgggataatgttcgaggaagaggtggcagcaataggagaggagtctccacaagatccgcaaagtttcatgcgaccatgccatcccgattcccaagtggggaactggcgcgtgataagccagtcggaggtctatatcgctgattcaatgtaa

SEQ ID NO: 60541 - DNA, 653 bp, Glycine max
  Peptide Sequence Number=SeqID_152226
atgggtgagggggccgatgggtttgacgaggaggccattgcccagctgttatccacaccggggcaggatttcgcccggaccgctacagggggcggcaatgtcttgtctagtgataataactctaatctccctatgccgaagtgtccgctggtgtatgccatcctggcacggatgagtgtccacgtggctcagttgattgctgacgccatctatttatttgcaggtatgccacccaccaggcaccctctagactcggataagtctaacagggccctagggtttccggcattgatcacgggcctctgccagtcattcggggttcccgtcacccctagtaaggtgatccgatcgctgatcacccgggccttcattgagaagtattgcatgcctaggcaggtgcaggatgatgcacctcaagccgcagacgtatcgctaccacctcatcaggctgatcccgctaggtcactaggcatggagcgttatctacagcaattggttcgccagcaggcggccaaccaccgggggcagcccgaagaattgcctgacgcccatgcaggggaggcacctgcaagatcccccgccgatgcagaggaggcccgcatggatgaggagatgacggacttgctcggtttcttgggaggaagcggagcccc

SEQ ID NO: 60542 - DNA, 324 bp, Glycine max
  Peptide Sequence Number=SeqID_152227
atgtgttatgacaaagttctcaggcggttagtccttttaaactttgtgaatggggaaacaaaagatatctcagtgcggaaactggaagtcgatttccagagagtaaaaactctgtctctgcgtgtcaacgggctcacttgcctctggttgacaaaaggtgcggataaccataaggtgtgtccgcgtgctaccgggcccttgggtcacgatagcagaaatgagacttttttgcggtctcggtcggttgtcgctgacatcttcgggaagggtgcagatgaccacattggtctctacgtgtcaacgggctcgcttgcctctggttga

SEQ ID NO: 60543 - DNA, 679 bp, Glycine max
  Peptide Sequence Number=SeqID_152228
atgttgaaaccgatatacgatcaatatgaggttttaaataacgaatataaagctaaatcgctcgcagatcagcaagatcctaaatatatcaagtctttggaggatcgtgcaaatgcgatacagcagcagaccatcgatgcgaaattggactatgtggccaaaaacccgaagagctatatggctttaatggcttttaattcaacgttaccccctgaatttgatgcactcaaagccgagaagatatttgctacactcgatcctagcttgcaaaattccatcctgggtaaagacttggctaaacgtatagcgttagtcaaaaaaacaagcgagggggtagaagcccaggatttcacacagcctgatgttgatggcaagcccgtgaaattatccgattaccgtggcaagtatgtcctgattgacttttgggcatcctggtgtgcgccatgtcgacgggaaaatccgaatttggtaaaatcctatacaaaataccaaaaacaaggatttgaaattctaggcgtatccatggataaagccgctgataaggcgaaatggttaaaagcaatccaagatgatggacttacgtggaaacaagtgggagatctcaagggatgggaaaatgaagcggggctaatgtacgatgtgaaggctattcccatgaatttcttggtagaccctaatg

SEQ ID NO: 60544 - DNA, 174 bp, Glycine max
  Peptide Sequence Number=SeqID_152229
atggtttttcacttaagacttgtaatgagcttcaaaacaaagaaagggaaacataggctcaaaggggctatcaaagaaattaattcaaggtgggctcatttgcaagaagtatcaacaagattcaagccaaggctattgtgcaagcactcaatgggggcaaaacacatcgaataa

SEQ ID NO: 60545 - DNA, 474 bp, Glycine max
  Peptide Sequence Number=SeqID_152230
atggtggcaggaaatacaaccatagaagaacctagggaacagtggagtgaagaggaaaggaaattatttcaatacaatttaaaagccaaaaatataattaaatctgttttagtgatggatgaatactttaggatatcaaattcaaaaacatttccaaatgaagatcttatcaataaagttttgagatgcttaagcagggaatggcaacctaaggaacatgaaatggaattgatgagattgaatcaacatgaggagaatgataagaaaaagaaaggaattgctcttaaagcttcatcttcaacacaagaaagaagtaataaggaggattcgattgaaatagacgaagatgatgatcttagtctatttgtaaaaagattcaacaaatttctaagagtcagaggaaatcaaagaaaagggcagaagattcatcctctactccaaaatgttatgaatgcaatcaacctagacatctaa

SEQ ID NO: 60546 - DNA, 121 bp, Glycine max
  Peptide Sequence Number=SeqID_152231
atgttccctcatgggaagatctccatcaaagggggaaggagcctagagtatgaagaacctcaggatttgaggtcaaatcctttccatgatggaggggatgatgcaatcctaccccccaagg

SEQ ID NO: 60547 - DNA, 273 bp, Glycine max
  Peptide Sequence Number=SeqID_152232
atgaaagactcgggaatacgtatgtctctaaaaacagtccagtggagtcgccaactgccgcaacctacccttcggcgggagggtgacgcgagggctcatgggtgtgtcttccataggaggaaaatgcgtggagtcgccaccaacgctaataagaggaaatcgtcggaaaaatcggaaaggtgtggtctacgaactttaagtgtgaaaggttcgggagttgtttttacgcacggggaaggtattagcaccccacgcgtccgtcacaagggatga

SEQ ID NO: 60548 - DNA, 339 bp, Glycine max
  Peptide Sequence Number=SeqID_152233
atgcggggttaccttatggttacccacacctttcgtcaaccaggggtgttgcaacatgcccttttgcgggcgaggctcacgggtgcattttccaaaggaggaaaatgcgcggaatcgccaccaacgtttatttgtggaaaacgttggaaaaaccgaaggaaaccggtcaaaaagaaaattccaagttcgggagttgtatttacgtttgaggaaggtattagcacctctcacgtcgacaaaagcggggcttttgctcctacgtaccctccatcgaagaggaaatcagacctatgtagttcttttttaagggtgaatcaagcgattcttttcacttggaag

SEQ ID NO: 60549 - DNA, 294 bp, Glycine max
  Peptide Sequence Number=SeqID_152234
atggtcatctgcaccctttccgaagatgtaggcatcttctggtggagactttttcaagtctcacaagttatccagaactacgtagaggcggcgggcccgatgacacacagagacaaaatttggtcattctgcacccttgtgtcatccagaggcggcgggcccgatgacacgcggagataccttacagttatccgcacccttttgtcatccagaggcggcgggcccgatgacacgcagagacaaaatttggtcattctgcacccttgtgtcatccagaggcggcgggcccgatga

SEQ ID NO: 60550 - DNA, 312 bp, Glycine max
  Peptide Sequence Number=SeqID_152235
atggggcttcgaataagatttgatgatggaggatgcacgaacagcactaggaaatcaattcgtcgggctgcaaactcaatggatgcccgaatagcgctaggatttcaattcgtcgggctccgaactcaatggtggaagattcatgtatggcaatcaattcatggggctccaaataagatggtggaggacgcacgaaaagcgctaggcaatcacttcatggggcttcgaataagatttgatgatggaggatgcacgaacagcgctaggaaatcaattcgtggggctccagactcaatggtggaggatgcatga

SEQ ID NO: 60551 - DNA, 267 bp, Glycine max
  Peptide Sequence Number=SeqID_152236
atgttgaatcccacaaagtgcactttcggggtcaagtcgggaaggttgttgggttttatcataagccaaaaagggatagaggttgatgaatggagaaggaagatagagaggagatgccacttcaaggagaagataggtctagaagaagctcaccaccataggaggccatggataagagcttggaggaagaaggagatgaatgaagggagagggaaagaagagcacaaaattttgtgctctaagagagtcctgaaatctgaagtttaa

SEQ ID NO: 60552 - DNA, 387 bp, Glycine max
  Peptide Sequence Number=SeqID_152237
atgaacaacatgatcatcgtgcaacacactgaaattaaggcatcttttaagacaagtacacatgaggttagacatgtttttaaagttaccttaatacaagaaactacttggcatggtatcaagttatctagatatgttgttggtagcataccacttgacacaatccatatgttttggcggaggctaagttttttaggccaaggtttatctgagcctaacgtcaccataactgaagagatgaaagccatatccaagcgctttgaagagcttgatgtatgtggcaaagtgactctaaagactaaacttcgggaaattgtctaccctgatgtaaattctatatgtgctccttcagaaaaggtgaaaacaaaaggtgctcaaaagaaatag

SEQ ID NO: 60553 - DNA, 432 bp, Glycine max
  Peptide Sequence Number=SeqID_152238
atgtctcggaacttcacaaattggctaacgatgggtgccaagtacctcgaagtggtcaaacaaggatcacatcccaacaatggatggtccccggaccaaattaggcaagtagcctggcctaaagctcaacttccattggtgagacccaacgaggctgcttcgcctgagcccacacctatacaggtcaattcagagccagttaacccacaatctccagtggtgaatctaccttcttcacctgagcttgaagcagttcccccatctcctcctttgattgttattgctgacgcatcatcagatgaagcagttgcccctcctaattcaccagctgcagaaatagctgaccccactatttccccaattggaggaattgctgatctttctgatttgtcatctagagaagttgttgctctcactgattccccagtttaa

SEQ ID NO: 60554 - DNA, 486 bp, Glycine max
  Peptide Sequence Number=SeqID_152239
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccatgctactgttggttgaaattcttgcttgtgacacaggagtatgcaacttgtgcaacgggggtgtgaagttcgttcgtgataacgatcgaaataagtaa

SEQ ID NO: 60555 - DNA, 261 bp, Glycine max
  Peptide Sequence Number=SeqID_152240
atgaccgatttatttggcatcgatttcaatacaccaaattcagcatcatcatatttagctactttacaacagttcgatgcaccacattcgtttggagaacaaggtcaaagttcttcagctgcaacaaccaacattgaaaatactaacatagaacaacaacatcatcgtgacgtaggagaaccactcatactggaaagaagaaatccgcgacgtaatcggcgtccaccaccttatgggactggtcatcgtcttggtcattga

SEQ ID NO: 60556 - DNA, 405 bp, Glycine max
  Peptide Sequence Number=SeqID_152241
atgaggggagcgccaacagaggagagtctctcgcctctccttgtgagggatctaggcgcgcaaagtctcaaggttatacaaagagtccacaaggcgtggagaagtccgttgaggaaagacaaggagcttaggggcatccgtaatggcgtcatcggtgattggctctccaagttgaaagttatcgatgaggagaacttcgaagctccagaggaagatgaagaagtccgagctctaaaattagagctagggaaggcaagactcgccaaggagaagttcaaatcagccgctacacacatccggaaagagtgcaccgagttacaagaggaaaacgcagccactgtaagagcccttgaacaagaaaccaaaagggcccgcaaggaggaacatggccgagagaaattctga

SEQ ID NO: 60557 - DNA, 405 bp, Glycine max
  Peptide Sequence Number=SeqID_152242
atggtagaagaagatgcactttctcttgacaacattgaatgtggtgtatgtgctgagtacaccgatgccggtgtatatggaaggcgaaactctggatcaaacaaggaagcgttcgaaatgggagaacgacgattacatttgtcgtggacacattctgaacggcctgttatggagcaatataatgaactgctgcggattttgggtcagtttactcaacatgatttgaaaatggatgaatccattgcagtttcatctataattgataaactgccttcttcttggaaagacttcaagcataccttgaaacataagaaggaagagttgactctggttcaactcggtagtcatttcatgattgaggagtcgctgagggctcaggaaattgacaaagtcaatgataaaatc

SEQ ID NO: 60558 - DNA, 330 bp, Glycine max
  Peptide Sequence Number=SeqID_152243
atggagaattgcactaagcaatcactacgcataggctccaaactcgtgggtggaggacgcatgaacgaaaacgcaattcatggggctccaaaaaaggggaacagaatggagaattgcactaagcaaatcactacgcatggctccaaactcgtcggtggaggatgcatgaacgaaaacgcaattcatggggctccgaaacaagggaagagatggagaattgcactaagcaatcactacggatggctccaaactcgtgggtggaggatgcatgaacgaaaacgcaattcaaggggctccgaaaaagggttagagaatttagaattgcactaa

SEQ ID NO: 60559 - DNA, 309 bp, Glycine max
  Peptide Sequence Number=SeqID_152244
atggaacatgcggatttggggatcccacggtcatgtagctccgcatgccaccagactcttgggacacgtaaagagacaaaacttccaactgatcagagcaacatatgctttttggatgaaaaacaatgtgtctatcggggaaggagacacttcgtttctaaacgaccatttagaggaaacactaggtccaacaaagataggagaaaatcactcaaagtgtatcaatctcacacagtgtgtggcgagaaagtcgctagcgcacaggattttggttggcaatcaaagggagagggccactttgggtcatag

SEQ ID NO: 60560 - DNA, 491 bp, Glycine max
  Peptide Sequence Number=SeqID_152245
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccccataattccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 60561 - DNA, 91 bp, Glycine max
  Peptide Sequence Number=SeqID_152246
atgggttctccacctgcctccactcctcctcctccttttcctcctcctacttcggacgactcagcttcgacgtctgccatgaagcggacat

SEQ ID NO: 60562 - DNA, 111 bp, Glycine max
  Peptide Sequence Number=SeqID_152247
catctgaacacaagggatgggttgtccctatgtggttcagactttgtaaaggattttacaaagatagtggaaatctcaagaataagtgggttgcttgagtactggacgtag

SEQ ID NO: 60563 - DNA, 1146 bp, Glycine max
  Peptide Sequence Number=SeqID_152248
atggaaacaatgttgcctcagaaccaagcagaggaagcaatagtcacaacaagccttaacgagacagagagtgaagttggtatgagggaagaagagaaggagttgcaacaacaagaccactccatgttcaacatcaagagcttcctctggcatggaggctctgtttgggacgcatggttcagctgtgcttcaaatcaagtggctcaagtgcttttgacactgccctattctttctctcaactgggcatgctatcaggaatcttgcttcagattttctatggaatcttgggaagttggacagcgtatctaatcagtgtcctctacatggagtaccgtaccagaaaggaaaaagaaaatgtcagtttcaagaaccatgtcattcagtggtttgaagtgcttgatgggttgctgggtccgtattggaaagcagtgggcttagccttcaactgtactttcctcctctttggatctgtgattcagcttatagcatgtgcaagtaacatctactacataaatgaccacttggataaacgaacttggacttatatctttggagcttgctgtgccacctctgtgttcataccctcctttcacaattaccgtatttggtcttttctgggacttggaatgaccacttacactgcttggtacttggctattgcagctcttattcatggccagggtgacaaatgttgcagagagattatgcacgccatgtggaagccacagaagttcaagtacatatacttgctggccactttgtatgttttcactctaacgattccttctgctgctgccgtttactgggcttttggtgatgaacttctcaatcattccaatgcattctctctcctccccaaaaatcgatttcgtgatgctgctgtaatcctcatgctcattcaccagaatgctgctgagaagcctcctttctttatgccaagctggactgcaatgtatgtcttcaatgcattcattgtggtgtgggttttggtggttgggtttgggtttggaggatgggccagcatgaccaacttcgttaagcaaattgacacatttgggctctttgccaaatgctaccaatgcaagcccccaactccaccacccatggcagcagcaccacctcctcatgcccatcatcatcactga

SEQ ID NO: 60564 - DNA, 873 bp, Glycine max
  Peptide Sequence Number=SeqID_152249
tcgggtaacattgcatcttgcaagaaaactccatcagatgttgtcgaagagctcaagagatatatggctaacaaaaaaagtgggaccacttatagtagtattggtagtggtaatgtgccaaatataagatattttgaattttatgaaccaattggatgtgatgaaagtgaagatgagtttgaggactcttgtaatgctactgttttggccacaaagacaaagtgtgagactaaaaaaggaccaatggacaggttttgtaagaatccagaaaatgcaatcaatcagagaaaaatggaaatgttgaggcaaagaaacatacgagagtcaatggataagaataaagtcttgaagaatatggttgcaaacattggtcaatgtgggccacatttgcccattccaagctatcatgatattagagtttcactcctaaagaaggaagttgaatacactgaaaatttgatgaaaggccacacgaaacactgggtcaagtatggttgtactattatgttcgattctgttgatggctctaattttgtgaagacagatgaaaagttttttgagttgcttgatgctattgtggaggaagttggagaagagaacattgttcaagttgtaactaataatgagagcaactatgttttagcggggaaagaagctgtaaaggtagtgctcatgccttctttttggaatagtgtggtttacactcttaaagtcatgggtccacttgtcaaagtgcttcgtcttgtggatgatgaaaggaaaccatccatgggttatatctatgaagcaatggacaaagcaaaagaaataattaacaagtctttcaacaaccacgaaagcaagtacaaagatgtgtttgcaatcattgattaa

SEQ ID NO: 60565 - DNA, 306 bp, Glycine max
  Peptide Sequence Number=SeqID_152250
atggatgaagatgatgataatgatgctagaaatgatttggtatttaatgatgatgatgcactaaattgggcaactgtgtatgagactttgggtgttggagatcctaggatgtatactaggtggaagcaaaaagcagtccaagaaaatgatgaggatctagagtttgaggatatagaacttgaatctaaagaagaagaaatcatgattaattttgaggagtttgatggagaagagggagaggaagatgctccactaccttatgataacaatgaagaggattatgttgggattgaagaagatgattag

SEQ ID NO: 60566 - DNA, 219 bp, Glycine max
  Peptide Sequence Number=SeqID_152251
atgaaggatattgctacggagaactttcagcaaatatacaaagcatatgagattctttcagatctgaataaaaggcaaatatatgatatctacagcatggagggattgacctctggtttggaacttggtccaaagcataatggagttgaagagatcaaggcagagctcagaggtagtgccttaagagaacaatataaaccaggagttgggttgttatga

SEQ ID NO: 60567 - DNA, 381 bp, Glycine max
  Peptide Sequence Number=SeqID_152252
atgacaaaggattacggaataacaaaaagcattgtaatccataataagcatcaaacaaaggagcccatgataatgctagagagagaaagagagaaggagattctagagagagaggaccttgtacttgagaatctgcgcggcgaagaactcgacctcgaagtaggcggggacggggaggcggcaatcgaaggtgtgggtttgctggaattggacgagcagatagacggtgaaagagatctgcaaatttgggaccaaaaggaatgtttgaagtgtttgaattttcaatcagttttgaaaagaattcacaactaccaagtgttctctgatggaaatgagttttggaaagaaacttctgaatcagagattcagtgtatgcaatga

SEQ ID NO: 60568 - DNA, 1437 bp, Glycine max
  Peptide Sequence Number=SeqID_152253
atgagtgtcattgctcttcagcgccaggtgaaattggcgagccttgagaactcctgcaagttggtcgttcaagcttgtgggaatgatgacttccctttcttgagggattcctcaaatagtccacccttctttttcatgtatagatgtttgtttgaggtctttggtctcattctccccttgactgctttccaatgtgttctgcttgagcacttgaatatggcctctgctaaactccacccaaacagtatcgcaatagtgagggcctttgaaattttatgccctttcttcaacatccaacctagtgtgctggataatttctttaaggttctgactaccaatgccatggctaatgtgcatgtcatgtatgttgcctttgtctatgcaacactccgtacttgtggtagtatgaatagagtagaaggcatgaaatcatctcagtttgatttcaacctagttaaaggtcttgtcatccatctggtggggaatccatgtgctttgtggaccttttcccctgatggtttaagaagtatgtttgacttcccattggttgaaagtcttgttaaccaatctaggcgtaggttgcttgacctgttgagtttctcctctatggttatcaggagaaaagtaagtgtgacttcctcccgattgaaggtcttgtcatgcaatctggtgatgggttgccttgacctgcgagattctcctctgatggttatgaggagtaaatatgacttccacctgattgaagaacttggtaaaagaaagggctcaacaagggtgaaccttggatttgtcgagccttggactgaggacgtgttggccctgggttttgtcaagcctgactcaccaagggcaaaccttgggttctgcaagctctttggaggatcaaccaaggaattgtctgatctgggttttgggcgtcatgctcttgcatgcatgccacttgtcgtgggtggcagtaccagagacatagcgccgactcgcattgctttggtggctagggagcgttttccggggtgttgtgaaccttcttttgaattgatcaccatcaaggatggcacagtagctagccgtctgttccaggcatcgggcttcgtcctccgtttcctagatgatagtcttgaggtgtttgaccttcttattgttgaccagcttgaagacttcttagctccgatttctcttactagcttcagacctgcaatgagcgcttcatactctgcctggttgtttaaggctctgaagttgatctttagggattgctctagggttgagctaatggcttcgtcgactactaagagatacatgaataggggtgctctaataactattatgtatagtgctttccagtcgctcagcatgactcaatctcttagcgagcaacgcacacttagcaccaagaagtatggacaagtctggattgtgaaggcacacttagcgtga

SEQ ID NO: 60569 - DNA, 1272 bp, Glycine max
  Peptide Sequence Number=SeqID_152254
atggtgtccttcagttggacagaattcatggtagtccaaaacttggtgccagggatgttctacaaggtttccaaagggtggcacaagtttgcaggaatgggagttcctatctcaggaggtaatgatgggaaccgagtgttagaagcagttaagacagttattgtcaaaatgaatttcaatgatgaagataaaaattgtcgcgttggcagttgtgggggatatcttgcaccagaatatgcacttctgggacaacttacaaagaaggcagatgtgtacagttttgggattctcatgcttgaaataatcagtgggaaaagtagtagcatagctgcatttgaagaggattatttggttttggtggaatggggtggaacttgcattcagttccgcataagaggtgagattctcgcaactcactactcattagcaagtattctgagttttggcctcttctggctagcttggaagctgaaaggagaaaataggcttctggaccttgttgattcagaactaagtgaatatgatgagagtgtggtgtaccggttccttatagtggctctattttgcacccaatcagcagctcaacatagaccaagcatgaagcaagtattggaaatgctttccaaggaagttcatctcaatgagaaggcattgactgagcctggaatttacagatggcacagcactggaaagaagtgtggttctttgaatgagacatcatcttctcaagcaatcaattcatccagatctttgggttgcttccgacagaggttgttggcaaaaatccatggcttgagcgttgtgatcatagaatgtagcacgacaccatggtcgagcgatggatgtggtgtggtgagggcggttggtttatattgcactccgaagcgttgggctaaggtgaagaaggagtcaatggatcgtgggggtcacacttgtaccacgatcagaggtaccaatgtatctttcaatgttcaggggtttccagtcgggagtagattaaaggttgctcgtggtggttataagaggagagttaagtgtgactttcctgagtatatgtctcgacatgggtgggtggggatggggagcgaggtggagatggtggtggtaggggcaacggaggtgacagttggggattgccacaacccgagcatgtggggccccacgagtcgagtacgcgctgagtttcacgagccatacggtacaacaatcatttatgttcttccagacacaaaatataacaacactctacaaaggtttagcttagttggttga

SEQ ID NO: 60570 - DNA, 444 bp, Glycine max
  Peptide Sequence Number=SeqID_152255
atgaaactgctttgcaagcattacttgacttcaattattgtattagaaggaaacgagctaaccggtggtgctttgcaacctatgcatgatcttaatcaaggacttcaattacttgctgaaattggaaaccttgctaacctgacccttatagcattagaaggaaacgagctaaccggtggtgttcctgatgcattagggtactttgatgtgtctcataatgctttgtcagggaccctgccagttgaagtgagtaagctacgtaatcttggagagttggtgctgtctgaaaacaactttgctggaaaaactgattacaacagaaaagctatagctcaacaattgacaaagctggctaagagccccccgcaagctgggagtggatgttcattagtcccagcttggaacaaaggccctgaaaaacagatggagatagagctttggtaa

SEQ ID NO: 60571 - DNA, 1746 bp, Glycine max
  Peptide Sequence Number=SeqID_152256
atggctgaaagggattatgctttggaaatatggaggcttcttgaccccggggcacatcttataggttcaaagcaagtccttaatcgtgtgatttgtgtcaaatcaggctcccgaaaatccttactaaatgttttccaagatggtgtgtgccatcccaaaatggcaatggtgattgatgatcggtcaaaggtttgggaagacaaggaccagcctagggttcatgttgtgcctgcctttactccttattatgctcctcaagcagagacggccaatgctgtcccagtcctatgtgtagcaagaaatgttgcatgcaatgtcagaggttgttttttcaaagagtttgatgagagtttattacaaagaattgctgaaatcttctttgaagatgatattggacttttacctctccctccagatgtcagcaactacttgatgtctgaggatgtaccgaatggtaatgctaatgcccccatcagtgaaggaatcaatggtgcagaagtggaacgaaggttaagccaacctgatgataaattttcggttgatttagtcacccgacccatgacaaacagtgttgaattcagacatgaaacctctcagccaactgctgaacctggtttgcttggacctcctgtcaagcatgacggcaactctgttgatcgtgattatgacatgagaaaaggacttttaggcatgaggcatggtccagatataagaggtcaaatttcagctgaacctcctctgatatcaaggccacctaatcaaacatcaccatctttaattcagccatttggaggtgggttggtagaagatgatattgccagcagaactcagacaaatagttggccttctgcatcttttaaagaatctaatgtaataaagtttgataagcatcaggctcaacagaaaccattttctcatagtgtcataggttcatctcccaatgttttacccccacaagcatcacaagtaaagactgaagaggcaacttctgtttctgatttgcagaggcatattgctccatctaagtctcagctatcatcggaggatgggatatctcagaatcatgccacttctaacagcaaagattttcaaaatgaagctggaaaagtgaacttcttaccctctctatctatccaagtgctgcaagaaattgggaggcgatgtaactctaaggttgaatttaagactattttaagcaccagcaaagacttgcagttttcagtggaggtactattcactggcgagaaaataggtgttggtatggctaggacaaggaaagatgctcaacaacaagctgcagagaatgctcttcgcagcttagcagaaattatcagcaagcatggctcaagggagaagtatgtggcacatgtggagccacaatgtagagctgtggataaagattttgacaagctttctcttggacgtgacaatggtttcttgtgggatgtggtcaatctggaatccagtgaactgcaaccagaagatggagtgcctagagaaaatgcttctgaggctttggatgctgagactaggtcaagtacccctaatgccattaatcagcaaatggacaagcgtgtcagctccccgaggagtttcaagaaacaagatttaccattggtgcagcaactggagaattggccatctgaattctgggaacggcatattatcgttttatacgcaaaaggttttgatgtaatttgctcgtgcaatatctctgccgtagcggttgtagatatgctgaggtaa

SEQ ID NO: 60572 - DNA, 285 bp, Glycine max
  Peptide Sequence Number=SeqID_152257
atgaagagagctgtagaagaagaacccgtcgtcgagaagaaggcgccgttgaagatggcttgtaaaaccatcaacgaggaggaagaaccacgtcaacgcggaaaagaatcactttgcagctttgttttcagttgtcacgtagtgtggagaagaaaagaaaatggatttgagtttcgtaagcgtggagaagaagagaagcaaatggattttgttgcagtgttgataactcttcttactgttatccagactttttatgtagtcctcaactatcatcgtccaaattaa

SEQ ID NO: 60573 - DNA, 660 bp, Glycine max
  Peptide Sequence Number=SeqID_152258
atggggacaagcagttttctatggaactgtactaaaaaattcatcacagccgggatcgtcactgtgactgtgactgatcattttgtgacagttattccagttcgaggcggatctatgtctcccacatttaatcctaaagctggttctcatatgggagatgtttttgatgactatgttttggttgagaaattttgccttaggaattacaagttttcacatggcgatgtggtggtctttcgctcccctctaaatcacaaggagacacacgtaaagagaatagctgcattacctggtgaatggtttggcactcatcataacaatgatgtgattcagattccattaggacattgttgggttgaaggagacaacaccgcttctagcttggattcaaattcatttggaccaattcctttggccctaattcggggaagggttacccatgttgtgtggcctcctcaaagaataggagctgtcaagatggaaaggatagttacttacctatttgttgattgggttgctagtgtaaaccttgaatccctcaaatgttggttacattctaagcaaggtaacctaaagaaggatgctggtccgaatgtgataccagctttctcgagtagttgtccagatgtcacgatgatgagcagcaatggtgattactag

SEQ ID NO: 60574 - DNA, 297 bp, Glycine max
  Peptide Sequence Number=SeqID_152259
atggagtggtttttccgcatatctcacacattcatgataccaacccaggcaggtgaccagtcgagagatgcactagctgcagaccctgaggactacatacagccgcccagcccccaggttccagtgacatttgacccccctccacatgtgaggttggagcgtgtgctcaaccttaggatagtcactgcaggcacaaagttatatgacattaggcaggactgcctgacgatcgcgagagggggacccagtgctgatggaactgtcagggctcgtcagagacgccgcacggaccattga

SEQ ID NO: 60575 - DNA, 519 bp, Glycine max
  Peptide Sequence Number=SeqID_152260
atggcgtatgggaggtcatacctgcagatgaggtgtttccaggagaatttctccacctcgttggccgtaattttctacaatggtcttgcttctatccacttggccaaggggagctcagactgtgaagattttcaggaggagtgcatggcacatctaaaaactcttggcattgtctacacctcctggcattttagccagggtgttgttaaccctcttttaaatagctcaccatcaaggatgacatgggtcatccataatttcctcagtgactatggtgggagtttggagcatctcttggatgatagtcttgaggtgcccgaccttcttggtactggccagcttagagaacaagtctgctctggtgttgctctccctgggaatgtactacattttgaaacattcaaaattgtcaataagagttcttgcaatgtgatagtacttgagaagcattgtttccttggtatagtatatgttggcaacctatccttggacaagctgggagttcgtgtagcaccgtag

SEQ ID NO: 60576 - DNA, 213 bp, Glycine max
  Peptide Sequence Number=SeqID_152261
atgggaggcggtgatggcagaagaagaagggaagtggctgggtggtgcgggttgcggcagatgatgaatgagagcatcgattttgtgcatgagttgttgaatagtgaagaagaagaagtaacaagagcaccaatgttagcactccctaaacttcgaggcaccagcaacctcttaaggagaagaagaagacacagggaagaagaggcttcctaa

SEQ ID NO: 60577 - DNA, 498 bp, Glycine max
  Peptide Sequence Number=SeqID_152262
atgaagccttggaagccgagatatgaagcggtgaggacgattaaaaagagggcccttaggaaacatggtgctggtggaggtgaagcagcgatagagctggtggttcatgtggtgggtccgctcgatcttgaacttgtcgggttgaatggaagagtgataaccgctgattatgactatatgtggggcccgaaaagagcaagattatttgggaagacaggaataatcaagaaaagcaagctaattaaagaaaacaggactaattatggaagcagaataaggaaaacagagaggaaaacatggttaagtaattcgaaaagctcctcctctaacaaaggtgtgagtggtgccggggtgaaggatgcagaggagggagagatcaaaatcagggagcttgaaggagaggagtttggcaatgatagtggagcagaagagggaggcgagggtttggaggaagtgaaggtgagagtcaaagtgaaagagaggatttggaggaagtga

SEQ ID NO: 60578 - DNA, 486 bp, Glycine max
  Peptide Sequence Number=SeqID_152263
atgtggcacgatgacatttctgtaattataaaagagttaaacaaggacggaacaagaagcagcaacagcagcaacgtgagttcacttccttccaacagcttcaccatcaccgacccctccatcccgggacaccccatcgtcttcgccaacccaagcttcctcaagctcacgggctactccctccgcgaagtcctaggctggcccgcagccatcttctcgggcccattaacatcccaaaaatttgtaatcgaaattcatgaaatcgttagagaggagggaaacgcgcaggtcattttgctcaactaccacatagatgatatgccattttggatgcttttttgtgtttcccctgttttcagcagtgacggtggcgccgtcgtgcactttgttgttgtacaggtaccgcttcagaaaaaggaagggtccggagtgagggatttcgggtttgggttcgggcccattcgtgcactttgttgctcaacatga

SEQ ID NO: 60579 - DNA, 162 bp, Glycine max
  Peptide Sequence Number=SeqID_152264
atgagaattattttcccttcagttcccattggctttggtagtgatcttgttcctaggcctgctgttggagtgtttccttcaagtggcgaaaacaacagaattaaagtccatttgtcacaaagcgaatggagaactggaagcgatggggatagcagctactag

SEQ ID NO: 60580 - DNA, 135 bp, Glycine max
  Peptide Sequence Number=SeqID_152265
atgttaggaacattgaggccacaatttgtgctgtttgggtcttccattgttcaatacagctattatgaaggttggggtgctactctttctcacttgtatgctcgtaagaggatgatcgatattgattttgactaa

SEQ ID NO: 60581 - DNA, 771 bp, Glycine max
  Peptide Sequence Number=SeqID_152266
atggtaggcccgatgagacctaagattgtgctctttggctcctctatagttcagatgagtttcgataatggtggttggggtgctattctggcaaatttgtattctagaaaggcggacataatattgcgaggatactcaggttggaattcaaggcaagctttggatgttttggatgaagttttctctaaggatgctcatgtgcaaccatcattggtaattgtgtactttgggggtaatgattccgttcaccctcacccatctggccttggtcctcatgtgcccctccaagaatacgttgcaaacatgaggaagattgctaaccatcttaagagcctctccgatcatattcgcattatatttctcacctctcctcccatcaatgaagaacaaatccgcaaaaagctcagtgcaacccaatcaggaagaaccaatgaatcctgtggagagtatgcagatgccttaatggagctttgtgacgagatgaatatcaaggccattaatctgtggtctgcaattcagacaagggatgactggttagatgttagtttcacggatggagttcatctatcagcagagggaagcaaggtagtggtgaaggaaatattaaaggttctaagagaagtagattggaagcctagtctgcattggatgtcaatgccaactgaatatgcagaagattcaccatattatcctcccaatcccgatggaacaacaaccataaatgtgtcctactgtatctcacggaagtggttgcaatgggatgatctgtag

SEQ ID NO: 60582 - DNA, 477 bp, Glycine max
  Peptide Sequence Number=SeqID_152267
atggcctctaggaagaggaaaactaccacctccagaccccgagagccctatgataccaccagattcattttcgagggcgcctgggagagatatgaccagaatgttcactcccaaagcattctttcagaaaggagagccatattatacatttcggagtatgatgagttccgttgggagctcgagaggcgtagttggcataaagccttgaccaggcagcctgatggtcacattgatgtgaccttggtcaaggagttttatgccaacctctatgatccagaagataagtccccgcgacaagtcagagttcagcgcaagttgattaagtttgatgctaagtctttgaacaccttcctagagacccccgtagttttggagccaggggagcactacactacctacaccaggagcgccctggaagctcctaaggaaggaccttaccactttagcgcaaacctggagtgtcctatcctattctaa

SEQ ID NO: 60583 - DNA, 174 bp, Glycine max
  Peptide Sequence Number=SeqID_152268
atgagggaggaatattgtacgcagtcttacccttgtatatgcaaagaggctgtttccggattcgaacccatgaccaacaagtcaccaaggcacaactttaccgctgcaccagggctcgccctcaatgatgaatttttaaacattacatgttgtggttctaactggatttgctaa

SEQ ID NO: 60584 - DNA, 183 bp, Glycine max
  Peptide Sequence Number=SeqID_152269
atggtcgagaatcttcgcgtaattactcacggaaacgttacggaagcgccttggcttggattttcttcacggaacaaaataggggaggagcttgccacccagctcgcccaggcgagcaaggttgcttcctccagaagcaacaaccttctggaggaagaatctggaaggcccaagtgggcctga

SEQ ID NO: 60585 - DNA, 839 bp, Glycine max
  Peptide Sequence Number=SeqID_152270
ggttgcacgccctcacctccagaggattgcacgtcctcgccttgagagggctacccgccctcaccttgggactacacatcctcgccaacagagggctgcacgccctcacattcagaggaccacatgtcctcaccttgagagggctacacgccctcaccttgggactacacatcctcgccaccagagggctgcacgccctcacctccagaggattgcacgtcctcgccttgagagggctacccgccctcaccttggagggctacacgccctcaccttgggtactagttaccctcaccgttgagaggactacacgtcctcgccttgagaggactacacgtcctcgccttgagaggactacccgtcctcaccatcagagggctgcatgccctcacctccagaggactacatgtcctcgccttgagagggctacacgccctcaccttgggtactcgttaccctcaccgttgagaggactacacgtcctcgccttgagaggactacacgtcctcaccttcagaggctacacaggattgcacgtccttgccatcataggactacactccctcgccttcgaaaggcgacacgtcctgaacttcagagggctacacgccctcgcctttagaggactacgcgtcctcactttcaggaccagtagtttccttttaacggttcctgggccaccccccgatattggaggagggccaactgtccgagcacaactagaaagggaggctatcacactgctactatgcatactggggcaagatttcacccgtgccgctgcaaaaagacgagtgcggatcatgcgcactaacatgaccactcttacacagatatag

SEQ ID NO: 60586 - DNA, 645 bp, Glycine max
  Peptide Sequence Number=SeqID_152271
acattggtggcgactccgcgcgtattcctttcgtggaacacgcatcccgcgagtctcgcgtcgccctcccgccaaagggtaggttgcgacacaagggtttgtggtttgtgctcctctgcttaccaccatacagacctttgcccttccatgcagcaacctggagcaatcgagcagcctgaagcttatgctgcaaatatttacaatagacctcctcaacctcagcagcaaaatcaaccacaacataacaaatatgacctctccaggaacagatacaaccctggttggaggaatcaccctaacctcagatggtccagctctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagactagagcctccattcagagcttaaccaatcagatgggacaattggctacccaattaaatcaacaacagtcccagaattctgacaagttgccttctcaagctgtccaaaatcccaaaaatgcagtgccatttcattga

SEQ ID NO: 60587 - DNA, 357 bp, Glycine max
  Peptide Sequence Number=SeqID_152272
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcgtaaccaccacacccgccgcgcttattgcgccgatacagggcgcgtcccattccccattcaggctgcgcaactgttgggaagggcgatcggtgcgggcctcttcgctaatacgccagctggcgaaagggggatttgcggcaaggcgattaagttgggtaacgccagggttttcccagtcacgacgttgtaa

SEQ ID NO: 60588 - DNA, 183 bp, Glycine max
  Peptide Sequence Number=SeqID_152273
atgggagaaggtcaagaggttctgaacgtgagaaccaaaactcctttcgctaagcgcctgcttctcgctaagcacataatcgttcatgtgctaagccacgagtttcaagcgcttagtgcacaaccctgcttagcgccactcatggttgctgagctcaatcacttgcggcaatatgcgcgctaa

SEQ ID NO: 60589 - DNA, 98 bp, Glycine max
  Peptide Sequence Number=SeqID_152274
atgaactcgctaagtgcgcctatcgcgctaagcgagttcatcttttggggatgaacattcatctccctgatgagttgcctgtggctaagcggggatga

SEQ ID NO: 60590 - DNA, 345 bp, Glycine max
  Peptide Sequence Number=SeqID_152275
gatttagaggcagcaacaattccaaaggaagaacctctatcttctgaggcatcttctagttttcctattgcagaacattctcatttagatcctagtgaagactacatcatggctgaagagccaagaagagttactctggaagactattcaagttctaatataccacaatttttcaccagcattgcagaacctgaagttcaagcacaaaccattacttatccaccatcattgattcagttgattcagaataatttgtttcatggattaccaaatgaagacccatatgcacacttagccacttacatagaaatttgcaatactattaggttggctggagtgccttaa

SEQ ID NO: 60591 - DNA, 1224 bp, Glycine max
  Peptide Sequence Number=SeqID_152276
atgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 60592 - DNA, 276 bp, Glycine max
  Peptide Sequence Number=SeqID_152277
atgaaaacaagacaacgattggtacctcaaaagccttacactggggcaatgaggggcaccgtgcatgagcctcaagtgaacataggggccgatcaaaagttctctcccatcgatgtttttaacaaaaaaggggggggggggagacccaaggatttcaatggattgattaaacatcaaacgactccattgccgtcactccaaaatggtcaaatgactaaatcaaacagaacaacactcagagggagttctcggagagatttgcaaaagataggataa

SEQ ID NO: 60593 - DNA, 270 bp, Glycine max
  Peptide Sequence Number=SeqID_152278
atgcaaagaagatcttttgcgggtgatttgattcccattgatttggagattaacgccacttgtagaaggcgtaatcaggagagaattagaaaatttttgcaggacttagaggcagaagcaattccagaggaagaacctcaatcttttgaggcatcttctagttttcctattgcagaacattctcatttagatcctagtgaagactacatcatggctgaagagccaagaagagttactctggaagattattcaagttctaatgtgccataa

SEQ ID NO: 60594 - DNA, 366 bp, Glycine max
  Peptide Sequence Number=SeqID_152279
atgcatgctttgttagggtcattcaatagtgggaactggtctgattctaaagcccttgatagtacgggactaagttgttgtgctatcacgagggattgggtcatattttcataccagacgcctatttatcgaaatagcttgccagataacagaagttccctgagagttcgatactcggttcttaccgttttatactacttgtgcgatctagtatacttgtcggtttcaaacattgcactgagcctggcaagagaccttagcaagctgatctcgcgcttagtgcactgcttcgattcacgttctcttccatattccttcttcacactaagcgcacggaagccgcacttagcgatggatacgcgctaa

SEQ ID NO: 60595 - DNA, 300 bp, Glycine max
  Peptide Sequence Number=SeqID_152280
atgaggttaaagcttccctttgggaaagtgattgaggtatcaagccctagggaagaatatgaagagagcccgtccatggccatcagtctgaagggggaggaatatgatgaactacagggacgtcaatatggccaccgattgaagcctggaatgaggaattccaagatagtgcccgaaatccggcgcaagaattcacgaccaaaacaagcatggatcttgaaggacgagctaaaggcttttgactttggagaaattgtgtcccaacagtatggaagcgagactggactagcagcgatatga

SEQ ID NO: 60596 - DNA, 495 bp, Glycine max
  Peptide Sequence Number=SeqID_152281
atgtcctcaccttcagagggctacacgccctcgccttcaaaggattacacgtcttcaccttcagaggactacacgtccttgcctttggagggttgcacgccctcgccttcagaggactacagaggagtgcgcgtcctcacattaagaggactacacgtcctcaccttcaaagggctacacgatctcacctttagaggactacacgtcctcaccttcagagggttgcacgccctcacctacagaggactgcacgtcctcaccttcagagggctacacgccttaccttccaagggctacacgccctcgccttcaaaggactacacgtcctcgccttcagaggactacataccttgccttcagagggctacagtctgtgcccttcagaggactacatgtcctctgcctttaagggtgcacgccttcaccttcaaaggactacacgtcctcgccttgaggactacacgccctcactttagagacttgcctcccggttga

SEQ ID NO: 60597 - DNA, 96 bp, Glycine max
  Peptide Sequence Number=SeqID_152282
atgggcctgaaatctaccctaagtaaggtgaggtctgaaaacccatttccttggcatcttcccatgaaggaacatggttcctcaccaactcaatga

SEQ ID NO: 60598 - DNA, 345 bp, Glycine max
  Peptide Sequence Number=SeqID_152283
atggtgtcgctgacctgcgtcgcaagcgcctgggcattggcatttggccgggctgaccagcgcgctgttgttcaggacacgcgagacggtagccacagaaacgcccgcctgacgggcgacgtcacgaatggtgatcatattcaccatccttcaaaggattgcagcaactcacagacaccccctgtgtttagcaaggtggctattttggcagtgagagaaaggggactacgtgaagaagctcacactcatgaaaacgcttacatccgttttgttaatgattgtgatccagatcgttatctggatgtatttttcaatgatatccctgaagcacgtgcggttaactga

SEQ ID NO: 60599 - DNA, 604 bp, Glycine max
  Peptide Sequence Number=SeqID_152284
gggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaatgaggtcaggaagctagggaagcctctggtaatcgattaccaagggatcgtgatgacggcgcagctaatccgtgatcgagtagagatggagtgcctagagggagcttgggagaccctcgaaggcaacacgaggtgccgatttcggggcaccattcggttcacggctacttcttttgtaacgtcatccgaggaagaccctgaggaagacctggaggagctacctcctgagcctgctgtggatgcccttgactttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 60600 - DNA, 228 bp, Glycine max
  Peptide Sequence Number=SeqID_152285
atgacctgtaaggttccatacccttacggaaagaaaacaagtatcgttacgaaattcgtaaagtttcgtaacgttacggaaaaagaatcaccaaaaaagcaaatagcaaccaggcccacttgggccttccaggatgttcctccagaaggcggttgcttttggtggaagcaacctggctcgcctgggcgagccgggtggcaagctcctcccctattttcctataaatag

SEQ ID NO: 60601 - DNA, 465 bp, Glycine max
  Peptide Sequence Number=SeqID_152286
atgccgctggcgattcaggttcatcatgccgtttgtgatggcttccatgtcggcagaatgcttaatgaattacaacagtactgcgatgagtggcagggcggggccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60602 - DNA, 188 bp, Glycine max
  Peptide Sequence Number=SeqID_152287
atggacgcttatccatgtcaggatggcatacaccagctgacacttcggcagggggaggtcggagttatgatcgttgggcaggacgttgctgagcagcaacgtcatccacatctgagtcaaggtggtcatgttggtgcgcatgatctgcacccgtctcccggaagaggtccggggaaaatcctaacccg

SEQ ID NO: 60603 - DNA, 453 bp, Glycine max
  Peptide Sequence Number=SeqID_152288
aggactacacgtcctcgccttgagaggactacacgtcctcaccatcatagggctgcacgccctcacctccagaggactacatgtcctcgccttgagaaggctacacgccctcaccttgggtactagttaccctcaccgtcagaggaccctctacacctcctcaccatcagagggctgcacgccctcacctcgagaggactacataactgcatgtcctcgccttgtagggctacacgccctcaccttgggataccctcaggaggactacacgccctcacctttagagaggctacgtgtcctcattttcaggatcgcacccacaaagacacccagtggacctgaagaagtccaacagggccctggggtttccagctctgggatcgcgcctgcgagacacccagtggacccgaagaagtccaacagggtcttggagttgtcaagctctaattacgg

SEQ ID NO: 60604 - DNA, 740 bp, Glycine max
  Peptide Sequence Number=SeqID_152289
atggtgaaagttggaacctcttacgtgccgatcaacgtctcattttcgccaaaagttgggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60605 - DNA, 153 bp, Glycine max
  Peptide Sequence Number=SeqID_152290
atggctcatgactacgtcggagttctggataacttcaaagagacaaatattccaactgatttagagcagcatatgcattttttgagtgaaaacaatgcgtctaccggggaccaggagagttctgctgatgaaatcaacccaagtttaccataa

SEQ ID NO: 60606 - DNA, 348 bp, Glycine max
  Peptide Sequence Number=SeqID_152291
atggggacaaatcaaatcggatatcaagtcaagattaagggcctagatgtcaccagccttaaggagttgggacggttgatgggatccctccagatgcaagccttccgcaaggcgtacggaaagattttagatttgaccatagcggaggtattcacagaagccgttgtatccctcacccaatactatgaccagccattgagatgcttcatgtttggggacttccaaattgtaccgactgttgaagaatttgaggagattctaggatgtcctcctgggggaagaaaaccatatcttttctccgggtttcttccctccttgagcaagattgcagctgtggtcagggattcg

SEQ ID NO: 60607 - DNA, 605 bp, Glycine max
  Peptide Sequence Number=SeqID_152292
atggacgtcctgagcttcagaggtctacacaccctgcccttcagagaaatacatgtcctcgccttcagaggactatacgtcctccctttcagaggaaccacacgtcctcgccatcagagggttgcatgcctcttgaaccttcagaggactacactgtcctcaccttcagaggactacacaggactggacgtcctcaccttcaagagggctacacaccctccccttaaatactacacgtcctcgccatcagaggactaccgtcctcgtcactttcagagggttgccctcatcctcgtcctcatcatgagagggttgcacgccctcgccttcagagggctacatgcctcacctttagaggactacacgtcctcgcttttagagaaccacacatcctcaccatcagagggttgcactgcccttgccttcagaggactgcacgtcctcaccttcagaggactacacgtcctcccctttcaaggactacacgtcctcgccttcagaggaatggccattctcaccttcagagggctacacaccctcaccttcagagaaatactgtcctcgccttcagaggacttcacgtcctcaccatcagagaaccacac

SEQ ID NO: 60608 - DNA, 432 bp, Glycine max
  Peptide Sequence Number=SeqID_152293
atgaaagaaataaaaagagaaaaacatgtctcctataatagtcatgactcttgcaagagtttaagtgaagaacttagtgactattatagagggaggcataggtcacatactaaacatcaatcccaaagaagagaaaaggatagaaggcctcaagaggttaacattagcctcccatatttccatagaaaagataatgttgaggtctacctagattgggaaatgaagagagaaaatttccattggctatccttagcttccaagggtatgccctctattgatggacttctcttgttagggaaagaagaattcatgaggatcctccagcagagtattggaatgatcttgagagtgcccttaggaaaaggcacattcccaactactatgatagggaacttatggacaagctccaaaggcttagacaatgaagtatga

SEQ ID NO: 60609 - DNA, 618 bp, Glycine max
  Peptide Sequence Number=SeqID_152294
atgctgtttgtggaagatgtgctcatgcagcaacctggcagtcatgtggtattcgatgtgaaatcgacacgccatttatcgccatggatacgcaagcatggtggaaaaccagtgatctggaaaaccgggcactcactgatgaaagccaagatcaaggaaacgggagcggccgtgggtggcgagctctccggtcacctgttttttaacgacaccaaagcaggaaagccacgctggtttggctttgatgacggactgtatagcgcagcacgtttgctagagatcgttagccgcagccctaatgccagcgcagtattggaagccttaccagacagcgttaacacacctgaattgcaaattgccatgcaggaaggtgaaccagacgccttcatcacaacattacagcacgctgcacaattccctgatgcgattgaaattatcactgtggatggattgcgcgtggaatataccgacggctttggcctgatccgtgcatccaatacaacgccagtgctgaccctacggtttgaggctgagactgcatcagctttggcgcggattcaacaagcattcaggcaagtgcttggcaataccagaccagacttgaaaattcctttttaa

SEQ ID NO: 60610 - DNA, 261 bp, Glycine max
  Peptide Sequence Number=SeqID_152295
atgaaagtgaaggttattctatggatgaatgctctcctagaacctaagcttttgaatcctagaaaaaccatgaatttttggcagcctagccccattacaagcctagaaagtccttcggattcattttgtggaaagaggctaagttttgaagtacaaaaagtagcagttgggttaagcgtgtatccaccgctaagcgcagcttcagcgtgcttagcgcaaaggagaatctggaagagcatcaacatcaaggccacgtgttaa

SEQ ID NO: 60611 - DNA, 204 bp, Glycine max
  Peptide Sequence Number=SeqID_152296
atgggaatagaaatacacaaaacacaatgtggaccaccatgggtacatagaatgaatcgaaaagcttggttcgaggggaggtggttgccgcccagctcgcccaggcgagccaggttgcttcctccagaagcaacagccttctggaggaatcttctggagggcccaagtgggcctgggtgctatttgcacccccatttttactaa

SEQ ID NO: 60612 - DNA, 378 bp, Glycine max
  Peptide Sequence Number=SeqID_152297
atgcataaggcattgcgattgaatgctccattgccatttccacatctagtcactctcttgcttcaacactttaacatccctcttgattctgaaccttatgttctaatcaagagatccttcctaataggcacttcagtcattgcatcctttggttatcaaaaagagcatgatggctcttgggtgaagaaaggtgctcgacatattttggacaggtttgatggtcttcaaaccgttgttggagaaaggtttgacagtttggaattacaagtggacatgcgcttcaatgagatggagtcaagaatcaccaaggttgaagaagatgtttcttatattcgttcaagctttgatctaccaccgctgccaccaccatcatcttag

SEQ ID NO: 60613 - DNA, 336 bp, Glycine max
  Peptide Sequence Number=SeqID_152298
atgggtaaagcagaggaggtgcaagataagatgaaggccgacatggaggccatgaaagagcaaatggccacaatgatggaggccatgatgagcatgaagaagataatggaagccaatgcgattgcagttgccgctaccagcgctgttgctaaggtgaacccgatgcctccatctgatctcaaccaaatgaatcatccaaccttagttatggtaggcaaagatttgggaagtatgggcggcccccatgatgtgaaaattcaaaacgagcacacctttcccgccatatggcttgcctctcaacttacaccacccaatgtgacgtacacttcccaatga

SEQ ID NO: 60614 - DNA, 246 bp, Glycine max
  Peptide Sequence Number=SeqID_152299
atgtatgatagcacgaaattcccttttgaatgcaagtgtgtacataatgaaatggccccgaggaaacttgcctcaaagagatccaggaaggataaagcggccgaaggaactagttccgctcccgagtatgatagtcaccgctttaggagcgctaaacaccagcagtgcttcgaggccatcaagggatggtcatttctccgggagcgacgcgtccagctcagggacgacgagcataccgatttctag

SEQ ID NO: 60615 - DNA, 279 bp, Glycine max
  Peptide Sequence Number=SeqID_152300
atggtgtcaaaatgggtttttcaaaggaagcgtaaaaacatacaatggtggttccaaagtcagaaaagatgcaaagataagcttaaaataccaaggaacaagcttaaaatcacagttacctcgaagaaaactgcgaaggttacattgggcttcgttctctatcgaaaccgcgagacaaacttggaagattccgctttgattgaagggttcctctcggtgtggggtttcaacggagaacaacggcggttcatgatggctactggcggttgtgggtggtga

SEQ ID NO: 60616 - DNA, 378 bp, Glycine max
  Peptide Sequence Number=SeqID_152301
atggctactccacctgcctcgcctcctcctcctcttcctcctcctcctgtagacgcatcaacgtctccttctacaccacctggggcagaaagacctgtggtcaatgtcaatcctgctactggcaaggccgacggtccccacaagaagaaattaagaacatatttggggattgtcgctcgtgataaggtcgacgtgacatatgagacctggaaggaagcggaatttgaaatccttgaagcttctgacaccgacaaggacggtgtggacgacattgtctatgaaaaatacgacattagcaaggagaaatgggcccagttttgtcagacccgcaaagacccctcgtgggaggatgtgcggaaaaaggcacagaccatctag

SEQ ID NO: 60617 - DNA, 234 bp, Glycine max
  Peptide Sequence Number=SeqID_152302
atgggcaggaagatcttagagcaggttattactggctcactatggaaagcgattgctgcgtccatatgtcattggagccatcgaacccaaagcttcgaacggtcatcgcttcattctcatggcgatagattatttcaccaagtaggtcgaagtggcttcttataccaatgtcacgaggagtgtggtggtcagattcataaagaaggaactgatttgtcgatacggactccctag

SEQ ID NO: 60618 - DNA, 626 bp, Glycine max
  Peptide Sequence Number=SeqID_152303
atggccctcactttatcacagtccacgcaaaatgtatccaagcctgtcaataacggaattctctctcgatattcgacactcttagcagtcaaaattcttaagcattttcgaccttgccacggaaatgttctcatgttgacagacaaactatgtgtgaagtacgggcgccgtgtccatttgtctgaagcatcaacactgcgtttcatatcgcggcatacgtctataccagggccaaaagttttatgttcctttactcatcatggattgacgtatatcgtgttggaaagaatcaagggggacatcattggtagtggctgggttcaccaaaatgaggagtccaaggccaagcttctttcacagttggcaaaaatggttgctgaaatgcgggaactccagcctcctgctgatatcgtggtcgcttccgttgatggtggaccactcttcgattgtcgtgtgccgggacgttctttacacttcggcccatttaatacagtccaagacttccatcggcatttacgaatgggcatggaatttgatcccggccttgacccccagatccaggatcttatcaaccaacaaagcaaaacctggccatcggtcttcacccatggggaccttagcagcct

SEQ ID NO: 60619 - DNA, 267 bp, Glycine max
  Peptide Sequence Number=SeqID_152304
atggagaaggaagagagagatgagacgccacttcaaggaaaaaaaggtgtgaaagataagtgtttcactcaatttggagtgcttcttagtccaatagctcttaaggtggttggccccttgcttcttgactcaaattcttcaagatatggcaccaatcctcctttccaattccctatatggcaactcacaagcaaggaaacaaagagagaagcaataaccaaagaccaaaaaaaaaatgaaatgaaagctaaaccaatagagttttaa

SEQ ID NO: 60620 - DNA, 246 bp, Glycine max
  Peptide Sequence Number=SeqID_152305
atggaatttcctcacatgaacgcaacaatcgttcttcgtagtgagccagtaataccccaccctcagaatctttcgggccatggcatgtccattggcatgtgccgcaacctactctttgatgggggtgcgaaaaggccaaaacaatgggccaaggcgtccgtctccaagggagaaaacgaacggagtcaccaccaatttttattcgaggaaaacactagaaaaaaccaaaaagacaaagctctatag

SEQ ID NO: 60621 - DNA, 459 bp, Glycine max
  Peptide Sequence Number=SeqID_152306
atggtgaaagttggaacctcttacgtgcctttctctcctcgagccttgggcctgccagtttgcgttcctcctgtgggccccagcccagggcttcatcaagcttattcgatatccgtcacctcaggtttgggcaaaggcccgcgctggcaagtgagcggtaactcacatgcgttgcgcgtaaccaccacacccgccgcgcttatgcgccgctacagggaaacgcgtcccattgctgcattcaagaggcgcaactggcgcgagggcgatcggcggctcttgcgtattacccagggcgctaaagggcggagtgtcaaggcgattatatgttgggtaactgtgccagggtgtttcccagtcacgaagcttgtggaggagaaaaaagcgacggccagtgaatatgtagatacgactcatatagggcgaattgtgactccaccgtcggtgtgcggcacgctctag

SEQ ID NO: 60622 - DNA, 799 bp, Glycine max
  Peptide Sequence Number=SeqID_152307
atggatccattgagtcaactgctgctgctgcataacccgcagggcagcatagataagaactgcgtgctgagcggtgagtggcaactgccgcacagcgccgggcacctgtgcgcagtgcgctggcatacggtcacaggcggcccggtcatgctggatatgcccgtcactgcgggtgtcgaactcactgctggcagcgtcatatttctgccgcaaaacgccgcgcatcgtatttatcagcgccatacgcagccaacccagctggtatgcggcctgctggaactgcccgcgtcggcgcatgctttcctcaccgccctgcccgaagtgctaatgctggcacccgaccccacaagcagcgatgggcgctggctggctgcggtgctgccgttcatcacccagagtgctgacgcactgccaactgctggtgatgccgcacttcgcagccagcagattggcagcctgttcacactggcggtgcgtcatgggctctcaactcacgcagcgcaccctggcttactctccgtggctctgcatccacgtcttggccctttaatcacccaactgtgcgccgcgccggaaaggccgtggacggtagaagccatggctcagcaagtgtttatgtcccgcgcttccttcgcgctgctgttccgccagctcagcgctaccacgccgctggccgtgctcaccgcccttcgtctgcagctggccgctcagcgactggcgcgcgaaacagccccgttaatcaacattgctctggccgtcggttacgccagcgaatcatcctttcacaaagcgtttgtcc

SEQ ID NO: 60623 - DNA, 570 bp, Glycine max
  Peptide Sequence Number=SeqID_152308
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggaagtacgggcggcccccatgatgtgcaaattcaaaacgagcacgccttcccgtcatatggcttgcctccaaactatacaccacccaatgtggtgtacattcccaatgaggatgtcaataactccactcccatacccattgaaagccagcaaccccaaactgatcatgcacatgtctcttaaaccgtggaaagagacccatgaaattccccatcacaatctagacgacttcgagccttggctcggatataccactgaagggcaagcagttggtggtatacccctacgaaaccctttggagggccctcagtatcacccacaactgcacctcttgcattccacagcggttaaaaaccctcatgactatggcaggaatgggacagttggatcatctagaggaaatgctcagggccattga

SEQ ID NO: 60624 - DNA, 1089 bp, Glycine max
  misc_feature (1047)..(1047): n is a, c, g, or t
  Peptide Sequence Number=SeqID_152309
atggggacaaatcaaaccagcaagaggttttaccaagtcaaggttaaaggcctagataccaccagcatcaaggaattagggcggttgatggaacctctccaaatgcaagccttccgcaagacttacgaaaagatcttagatttgaccatagcagaggtatccatagaggccaatgcgtcactcacccaatactacgaccaacctttgagatgcttcacgttcggagacttccaattggtaccaaccattgaagaatttgaggagattctaggatgtcctctcgggggaagaaaaccatatcttttctccgggtgtctcccctctttgagcagaattgcaactgtggtcaaggattcagcaagaggtttagaccacgtaaaacagactcgaaacggcatagcgggcctaccacggaagtacctagaagacaaggcgagggatatggcaagtcaaggagattgggtcccgtttatggatgtgttagcattgctaatttttggggtcgtcctctttccaaacgtagatggtttggtggacctagcagcaatcgacgctttccttgcataccaccatagaaaggagagtccggtggtagctgtcttggcagatttatttgacatatttgaccgaaggtgcgagaagagtagcgcacagatcatctgttgcttgcccgctctctgtgtttggttggtttcgcacctgttccagcaagacgctaggcatccatgtagaacaatcaattggttcccccgatggaaggaaggaaaagagggagtccttttctcatgtaaagggtacccaaacattccgctaataggaacgaggggttgtattaactacaatcccgcgctcgctataagacaactagggtaccccatgaggggagcaccgatggaagaaagtatgtctcctttccttgtaagggatttcggcgcgcaaaatttcaaggctatacaaagaatccataaggcatgggaaaccccgttaaggaaagatcaagaacttaggggcattcgtaatggcatcattggtggttatcatgaatgnctgaaagttcatatacgaggtttagatggctcgccaagttaa

SEQ ID NO: 60625 - DNA, 420 bp, Glycine max
  Peptide Sequence Number=SeqID_152310
atgaagcacttcactgacaccctcatcagtgccaacataatagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60626 - DNA, 336 bp, Glycine max
  Peptide Sequence Number=SeqID_152311
atgcacatgcccaacaagaacgctaatcacgtcgttcccgttacctttgagggtcagcaaccccggcctatagggagcgctcgtgaagaacctcgggagcatgctcaaggtgacttcaacccatactcccctttcaccactgagggaccggcatttaatgctatgcctcgacccaatattgtgggagctcctcaaccccgccctctacaaccgctgcatttctcagtaggggggccacctccggcagtggaaaggagagagaaacttgatctcatcgagaagagattaagggttgtcaaagggtttggtgattaccctttcactgacatggcataa

SEQ ID NO: 60627 - DNA, 240 bp, Glycine max
  Peptide Sequence Number=SeqID_152312
gttacaggttgtaccatctgtggtgaggctcatgaaacaggccaatgtattcccactgaagaaaacactcaagaaattcattatatgggaaatcaacaacaacaagggtatactcaaggaggatttttaggcttccaacagggtccctataatcaacaaggacagtggaggacaccctggcaaccagttcaacaaagaccagagtgggccttcaaacaggcccatccaacaagggcctaa

SEQ ID NO: 60628 - DNA, 462 bp, Glycine max
  Peptide Sequence Number=SeqID_152313
atgtggggctgccttatggttagctgcacctttcgtcaaccaggggcaaacgaccccgttgacgtgcatagactaacatcatcttctgcaccttttgtcgtcctaacccgtgaagtcagggttaccttatggttacccgcacctttcgtcaaccaggggcaaacgagcctgttgacgcgcagagacacccgcacctttcgtcaaccaggggcaaacgagcccgttgaaacacagagactaacatcgtcttctacaccttttgccatccagggacaacgagtcaggtgttactctcgttgtccggaaacattcaatcctgacgatgcgcgagattcttctctgttgggcagggacgatcgagtgcaatggcgtagggaagtgtcatggttgtccaactttgtcgctttcgagacactaaagtttgttgacgcttttgatgccttttcttttctttctgaatga

SEQ ID NO: 60629 - DNA, 1020 bp, Glycine max
  Peptide Sequence Number=SeqID_152314
cgctacgccgcctacgccggggtgaagaaagagcaggtgctggtcagccgcggcgccgatgaaggcatcgaactgctgatccgcgccttctgcgagccgggcaaagacgccattctgttctgcccgccgacctacggcatgtacgccgtcagcgccgaaactttcggcgtggagcgccgcaccgtggccgccaaagaggactggcagctggatctgccggccatcgcagacagcatggacaacgtgaagctgatctacgtctgcagcccgaacaacccgaccggcaacctgatcgacccggactcgctgcgcaacctgctggagctggccaaaggcaaggcgatcgtcgcggtggacgaagcctatatcgagttttgcccgcaggcctcggtggccgggtggctgagcgactatccgcacctggctatcctgcgcacgctgtcgaaggcctttgcgctggccggcctgcgctgcggctttacgctcgccaacgaagatctgatcgccctgctgctgaaggtgatcgcgccttacccgctctcgacgccggtggcggatatcgcctcgcaggcgctgagcgaagaaggtatccgcaccatgcgtcagcgcgtcaccgacatcgccgccacccgcagctggctgcagcaacagctggaaaaatgcgcctgcgtcgagcaggttttcgccagcgacagcaattacctgctggcccgcttcaccgcctcaaggcattatcttacgagaccaaaacaaacagcccgggttgtccggctgcctacgcatcaccataggcacccgcgacgaatgtcaacgcgtggtggacgccttgtccgccctgcccggcgccaaccagactcgccaggagccaatgtgagccaaaaaatcctctttatcgatcgtgacggcacgctgatcgccgagccaccggaagatttccaggttgaccgcctggacaagctggcgctcgagccggacgtgatcccttccctgctggcgctgcaacaggcggggtatcagctg

SEQ ID NO: 60630 - DNA, 390 bp, Glycine max
  Peptide Sequence Number=SeqID_152315
ttagtcgctacagacgtccggaaagagtgtgccaggttacgagaagaaaatgcagctaccgcaagagcccttgaacgagaaaccaagagggctcgcaaggaagagcatggccgagacaaattccgtggagctttatggggcagcaacaatgagctcaagcttggaagggaagagatagaccagtcacgagcacatagcatggtcttgaaagaggagttagctgcttgcttaaggtccaagacaagcttgtctccgcatttatgcgagacagagaccaacatgttagcgatcatcagcaagtaccaagaagaattaaatctaaccacggctcacaagcacaaagtggcggacgagtatgcccgagtgtacgcggaaaaagaggctagatga

SEQ ID NO: 60631 - DNA, 224 bp, Glycine max
  Peptide Sequence Number=SeqID_152316
ggatcgcgcccgcaagacatccagtggacccgaagaagtccaacaaggtcctagggtttccagctctaattacgggcctctgtcatttctacggagtgcccgtcgaccccagcaagttcatcagacccctattaatcgggctttcatcaagaagtactgcgccctcaggcagacgcagggcgagacaccacagtagcattaggatggccggtagcgggcaatag

SEQ ID NO: 60632 - DNA, 396 bp, Glycine max
  Peptide Sequence Number=SeqID_152317
atgcacgtggctcaactgatttctgatgccatccactatttgcagggatcacgcccacaagacacccagtggacccagaggagcccaacaaggccctggggtttccagctctggttacgggcctctgtcagtcctacagggtgcccgtcccccccaacaaggtcatgccatcgtgacataggtaagtatcttctctcaagaagtctgcgcccccagacaagcgcagggcgagacaccacagcagcctggggatggccggtagcgggcaacagacgcaccgccgccacctccaaagcccctcagctcatctacaaaagctggagtgttgcctatgacccgtggtcgaccagcagacgactaagtccaaagccaaaggacacacctagttgctcatga

SEQ ID NO: 60633 - DNA, 336 bp, Glycine max
  Peptide Sequence Number=SeqID_152318
atggtcattctgcgccctttgtcattcaagagcagcaagtcgagtgataaacgcgcagagacaaattatggtcattctgcgcccttgtcattcatgagcagtgagtcgagtggtgggcggagacaaattatggtcattccgcacaccttttcgccatccagaggcgatcgtgtccgatggcgcgcagagacaaattatggtcattctgcgcctttccatccaggcccgatcgtgtccgatggcgcgcagagacaaattatggtcattctgcgccttgtgtcaaccaagaggaacaaattcggcagtatcaagatgatgttggtcgttcggtgctga

SEQ ID NO: 60634 - DNA, 329 bp, Glycine max
  Peptide Sequence Number=SeqID_152319
tcgggaaacctgtcgtgccagctgcattaatgaatcggccaacgcgcggggagaggcggtttgcgtattgggcgctagcggagtgtatactgggttactatgttggcactgatgagggtgtcagtgaagtgcttcatgtggcaggagaaaaaaggctgcaccggaagatacttaacaggcaagtgagagggcccgcggcaaagccgtttttccctaggctcctcccccctgacaaagcatcacaaaaatctgacggctcaaatcagtgttgggaaaaacccgaacaggactataaagataccaggcgtttcccccctggcggctccctc

SEQ ID NO: 60635 - DNA, 237 bp, Glycine max
  Peptide Sequence Number=SeqID_152320
gccgacgaggaggtcgaggttgcagaggccgacatcagcattgattgcgacaacaaagaagccgaggtgcgcgagggaaaggacagtgttggccatggtggtggtcttgcccatgcctcccttgccagaggtgataaaggcgatgcgaggggtggagccagagagcttgggcttgtggattttggatgggaggaagaagaatgtggagttgggggtggtggtggcgctaggaagaag

SEQ ID NO: 60636 - DNA, 354 bp, Glycine max
  Peptide Sequence Number=SeqID_152321
atggcattgaataaggctagattagttgctacaccaaggaccttacaatcaagaatggaaggtatagattatgaagaaacatatgctccagttgcaagattagaagccattagaatgcttttagccaatgcatctataatgaattttaagcttaatatcaaatggatgttaaaagtgcttttctatgaatggcttaattcaagaagtatccatcttgaaaacctccagatttctttgaaaggaattgaaggagcaagagggagaatgaatatcctggggttacaaatcaaagcaaataatgatcttcaagagagtgggaagtttcaagaagatcatcccctacaacattcttga

SEQ ID NO: 60637 - DNA, 510 bp, Glycine max
  Peptide Sequence Number=SeqID_152322
atgggtaaggatcgcacccacaagacacccagtggacccggaaaagtccaacagggccctggggtttccagccctggttacgggcctctatcagtcctacagggtgcccgtacccccccggcaaggtcacgtcatcatagggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcattgggatggccggtagcgggcaatagacacaccgccaccacctctagagttcacctcagctcatccgcaaaaaggttagagcgttgcctacaacacatggccgaccagcgggctaccaagtccaaagccaaaggtaagcaaagtactaggtcagtgaccgacaagtcataa

SEQ ID NO: 60638 - DNA, 195 bp, Glycine max
  Peptide Sequence Number=SeqID_152323
atgaatgttttgagtggtgcatccctcttttgtaaaatcactcgtacacctaacatcttcatggtgtgtgtacatagggacccattaggtgttgagggaaggagcccagagtatgaagaacctcgggatttgaggtcaaatcctttccaaggtggagggaatgatgcaatcctatcccgcaagggcattgggtag

SEQ ID NO: 60639 - DNA, 438 bp, Glycine max
  Peptide Sequence Number=SeqID_152324
atgaccatgattacgccaagctcgaaattaaccctcactaaagggaacaaaagctgcaagggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60640 - DNA, 288 bp, Glycine max
  Peptide Sequence Number=SeqID_152325
atgtattttttgaaatcagtcactggtaatcgattaccattaagattccaagaagactctccaactcttagatgctacaagtgcaaccaacttggtcacatcaaagcaaatttcccctcaaaggagcaatggcctgagaagaatgagaagaaaagtcatgaagaaagaagatccaagaaggcgtatattgcgtgggatgacaatgactcatccgacggtttggagaaggagatctaccttctatccaaggactatgagagcgatgagaacatctctcaagaagattaa

SEQ ID NO: 60641 - DNA, 327 bp, Glycine max
  Peptide Sequence Number=SeqID_152326
atggcaagttcgtcatcatctaatcattatgatgtggcatttggaccattagaggatgatttattgtggatgcaaaaaagccatatatcacaacatatttggaatggtgctaatcaaaggacgttaaaaattcgacgagccacaccactgtataatcatagagaagcaccacccgaggaaattattcctttattacaagtttcaggtttgtacccgatagcagttgaaggcaaccaacaagggcttgaaagatttgctcgagcttggatcttaagattcatagaaggcgtgatgtttgttgacaaagtagcaaaagggtgccaatga

SEQ ID NO: 60642 - DNA, 449 bp, Glycine max
  Peptide Sequence Number=SeqID_152327
atattgagctggtagacgaggaagaagcacagattggtgctgatcgttctagtgcaacctctaataaatctgagatttataaggaggaagcaagaaatgcaacacagaagcataaaccaaagagggtggagagtgtcaatgctaatgcagaagcctttgctgaagcactagaacatacgaagaaaagagatacaggtcatcaaagtgtgtcattggagaataagacaggagattcaactgtgctgaagataggagattcggctaaagttgtgataaaacaagacatgaagggaagaaagcataaatatgggtataacaacaataaacgtgagaagacagagaagaaaagggtggtggatgatgaaactggcaacaaacatgagttgtacgaagtcctaaggataccatctaaaacaaaataccgatgcctcaatcagagaaaaatgtag

SEQ ID NO: 60643 - DNA, 276 bp, Glycine max
  Peptide Sequence Number=SeqID_152328
atgtcacatacttccaaagatgtggaagtgcttgacagttggcttcctccctttccagatttcatacagtgtggttggagtccctcttctaagtatgactctgttgtggatatagcatgctgtgttcatggctcaatgtatcagcaggaattctttggcaggtctgaacagccgctatctaggtaccaatcttccttagctgatgctctaagtgaagtatgcaacaagactgaccttgtgttttggaccttcacatcatcttctgttgtggtgtga

SEQ ID NO: 60644 - DNA, 195 bp, Glycine max
  Peptide Sequence Number=SeqID_152329
gttcattgcgaaggatgtcaggggatgactcaagatttaggagcgattgctgaggatttggagcgggtcatcaacctcaggatggtcactgagggcactgacttacatgacatcatgactcgttgtctgaggagagctagaggtgacactgcaaatgaaagtcttaggccgcgccagagacgccgcatagattag

SEQ ID NO: 60645 - DNA, 381 bp, Glycine max
  Peptide Sequence Number=SeqID_152330
atgcattatccacccacgagtctggagccccgcggggggttgccagcgctttttgccaattctccattctccacttttatacggagccccatgaatttattgcctagcgcttttcatgcatcctccacccacgagcctggagccccgcgaaattatttcctagcgctgttcgccaattctccattcaccacttttatccggaaccccatgaatttattgcctagcgctgttcatgcatcctccaccaacgagtctggagccccgcgaatttattgcctagcgctgttcgccaattctccattctctacttttatccggagccccgggaatttattgcctagcgctgtttgccaattctccattctcaagtttgatccgtag

SEQ ID NO: 60646 - DNA, 267 bp, Glycine max
  Peptide Sequence Number=SeqID_152331
atgaacaaagatggcaccaactcccaaactaatgtagtaaaaagtgttgaagatgaagatgttgtgtttttggcaataaacaatgaggttgctaaaacaaaatgggtgatggattttgctgcctcgaagcacatttgcatagatcgagagatgtttgatactttgaaaaccgatggagaattcgaccatttcaagttagggaatggtaaaaaaatgaagtttggcataggaagtgtgaggatgaagctccatgatggtgttgtttga

SEQ ID NO: 60647 - DNA, 312 bp, Glycine max
  Peptide Sequence Number=SeqID_152332
ggcaaagaaggcctccttctgggggggccagagccatcagtgagataccactctggaagagctagaattctaaccttgtgccaggacatacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 60648 - DNA, 519 bp, Glycine max
  Peptide Sequence Number=SeqID_152333
atggctctgaaaaagctttccacgaagaggtctagaagagatgctgcagcggaagggtccagtgccacccccgagtttgatagtcatcatttccggagcgccgagcaccagcagcacttcgaggccatcaaaggatggtcgttccacagagagaggcacgtccaacttagagaggatgggtatacggactttcaggaggagatagctcgtagacattggacgtcgctggtgacttccatggctaagtttgaccctgagatagtcctggagttctatgctaatgcttggcccacagaggagggagtgcgagacatgcgttcatgggtgaggggtcagtggattccctttgacgcaaatgccctcagccagttcttaggtgacccgctagttttggaggaaggccagcagtgtgagttcggccagaggaggaacaaggccgacgggttcgatgaggaggccattgcccatctgttatgcacaccggggcaggatttcgcccggaccgctgcagggaggcgg

SEQ ID NO: 60649 - DNA, 243 bp, Glycine max
  Peptide Sequence Number=SeqID_152334
atggcggtgcgtctgtttcccgctgccgatcatcccaatgctgctgtggtgtttcgccctgcgcctgtctggggcgcagtacttcttgatgaaagctcgattagtagggggcctgatgcccttgctggaggactgatagaggcccgtaaccagagctggaaaccccagggccctgttggacttttccgggtccactggggggagattggcactgcggtcgctgggcagaatgttgctaagtag

SEQ ID NO: 60650 - DNA, 114 bp, Glycine max
  Peptide Sequence Number=SeqID_152335
atggtggacttgcggcgacgaataccaaagcctcccactttgggtgaggggatgttgggttctatgaagataaacaatccaccacaagaagcggatacattggttcggttttga

SEQ ID NO: 60651 - DNA, 339 bp, Glycine max
  Peptide Sequence Number=SeqID_152336
atggggaccaccacgggggaggagcttgctacccagctcgcccaggcgagcatggttgcttcttccagaagcatcctccttctggaggaagaactggaaggcccaactttcgaagaagttacgaaaactcacggattgcgaaaaatacctcctttcgatttccgtcacatcacggaattttcacggatcacgagtaatcaacatgacaatacaaaaaaagtgatcaaggggttcccacagacacaaagaataaaggtcattcttgagtggcccactccaccaagtataagggaaatttggggattccttgacttaacaaacttttacaaaaggggttga

SEQ ID NO: 60652 - DNA, 504 bp, Glycine max
  Peptide Sequence Number=SeqID_152337
ttaatcgctgatgccatctatctatttgcaggtatggcgcctaccaggcaccctctggacccggataagtgcaacagggccctgggatttcccgccttgatcacaggactctgccagtcgttcggagtccccgtcgcacctagcaaggccgcagacgtgccgccacctcatcaggctggtccagccgggtcatttgatacggagcagtatttgcggcatttggttcgccagcaggcggccaaccaccgggctcatgtacagacccatgattgtctttaccaaatgagcctcagcttgcagagccagggttttacttcttttccgtgccctactccggaccagttcagggcagaggtcgcatggcctggagattggcctgaggcccgggcaggagaggcgccgacagaggcaccagtagaggctcccgacgaggcagatgagacccgcgaggacgaggagatgaccgatttactggatttcttaggagggagcggggccacatga

SEQ ID NO: 60653 - DNA, 390 bp, Glycine max
  Peptide Sequence Number=SeqID_152338
atgggtaaaggcagcaaagagcgccgcctgccaattgggcgcaacgcggtggcgtggatcgaacactggctggatttacgcggcctgttcggcggcgatgacgacgcgctgtttttgtcgaagctgggtaagcgcatttcagcgcgcaacgtgcagaagcggtttgccgaatgggggatcaagcaggggctcaatagccacgtgcatccgcataagctgcggcactccttcgcgacgcatatgctggagtcgagcggcgatctgcgcggcgtgcaggagctgctggggcatgccaatctctctaccacccaaatctatacccatctcgattttcaacaccttgcctcggtgtacgatgccgcgcatccgcgcgctaaacgggggaaataa

SEQ ID NO: 60654 - DNA, 609 bp, Glycine max
  Peptide Sequence Number=SeqID_152339
atgcaggaatcgctgacgtttgtgcgcaattatcatccggcgctgagccagtttgatgcccatgcgcttaatcaactgcgacaaacgctattgtcctcagaacctgagatttatcacgatgtcaccgtctggcgccaccgcgcgctggagttagggatgcgtaatgccgggctctccgccgccgaggcgaaagccggcgccgatgcggcgatggaaaacttcgcccactggcgcagtcgcgtcgacgtgccgcaggagacgcacgatacgctggcgaagctggcgcagaaatggccgctggtggctatcaccaacggtaacgcccagccggaactgttcgggctgaatgactatttccgtttcgtgctgcgcgcgggtccggatggccgctccaagccgtttgccgatatgtaccatctggcggcggagcgtctggatttgccgctcgggcagattctgcacgtcggcgatgatctgaccaccgacgtagctggcgctattcgctgtggaatgcaggcctgctggatcaagccgcaggacgcctctctgatgaaaaccgccgatagccgcttgctgccgcatattgaaatttcagtgggatcctctaga

SEQ ID NO: 60655 - DNA, 342 bp, Glycine max
  Peptide Sequence Number=SeqID_152340
gtatggcgcctaccaggcaccctttggatccagataagtccaacagggcctgggatttccctcgctgatcacaggactctgccagcagccaaccaccgggcacatgtgcagacccatgattgtctgtaccagatgagcctcagcatgcagagccagggcttcgcttctttttcatgccctactccagaccagttcagggcagaggtcgcatggcccggagattggcccgaggcccaagcaggggaggcacccccagaagctcccggcggtggagaagaggcccacgaggacgaggagatggccgatttgcttgacttcttgggagggagtggagatacatga

SEQ ID NO: 60656 - DNA, 448 bp, Glycine max
  Peptide Sequence Number=SeqID_152341
atcggaggtatttggccccctttagggatttgggttttagatcctcgggaaatcccttttcttaatacccctattctcctttcatccggagcagccgtaacttgggctcatcatgctatactcgcggggaaggaaaaacgagcagtttacgctttagtagctaccgtttcactggctctagtattcactggctttcaaggaatggaatattatcaagcacccttcactatttcggatagtactcttttcttgatcatatgtggtattcgccaatatcttggtcatctgaccaaggagcatcacgttggctttgaagcagctgcatggtactggcattttgtagacgtggttcggttattcctatttgtctctatctattggtggggagatggttctggaactcaacggaaagaggcttttaaggggtgcgcccttaacccgattccgg

SEQ ID NO: 60657 - DNA, 966 bp, Glycine max
  Peptide Sequence Number=SeqID_152342
atgtttgtatcctcctatttccacaaggcattcaaaattgtcgaaactgatgcttcagacataggttatggtggcatcctcaaacaaagagtccatggccaagatcataatacatcaagggcacctcaaattcattacctgactaccttacccgtgaattcttacagaaaagtggtaatgcctcctaaggcatcgagaatctccctaaggggaggaaggagtacaggcaaaggagccagactggctcttccagagccaaccatcaagaaatcatcaacctcttctgggtcatcaacccaggctgggtcatctacccagaaaaccaatttagaagggtcatcaacccaaattgcttcaatcaaacctgagccatccactcaggaatctcccaaaccggcaaccgccaaacaaacatcagccgactatgcatggccaattgaaacccttcaggcccttcaagacatgggtctaaccaaatttccaaaaataatcaaaaaatcttgggcagacattgcctcagaatctgatgatgaatctgaatcaaatctacaaacaatgatccaaaatgcgtcaatgaccaaaacagccaccaatactaaaggaaaactacctttagccaaagctcaaacaccaaccaccaaacaaactaacaattatatttataaaaataaattgttaactgttttgcagatggaacctaaattttgggacaaaaatcccttcaaggcgacggccaaggctttcccaccaggatttcactacaaaccaaccaccatcctgaagacaagaactttttatgaattgattttggtagattcaaactcagtatctatcaaacatttcaaagatccaaaagaccaaacattaaacacccactcgacaatccaaatactaaaagttcttcaaccaagacactttggttcggacttgaacaaaggaatgagattttcagttccatttgatccg

SEQ ID NO: 60658 - DNA, 761 bp, Glycine max
  Peptide Sequence Number=SeqID_152343
gcgagctaagcggaccatgtctcgctaagttgccaatggcctccaagaaacgtaagagcattggggcaaggccaactgctcaatatgatactagatggttccatttgcttgatgcttggaaccgttatacagataatgtcttggggaggaatattttgccagaaaggaaggttgatatataccacacggagttcgaagacttcaagacagagttggagaggcgtaatcttcacaagcgcctcaccaacttggctgataggactattgatcttgctttggtggaggatgttaatctctacagctctgagggtccttcaccaaagcaagccagagttagaggtcaccaggtgaagatagacgcagacagtctcaacacatttttagagactcctgaggggttcatcctgaatgctgagggccatcctgagaggattctcaggaaagatttgactacattagcccagtccaacctggctcccacatctcacacctctgacctgacagtggatagagctaggttgatctttggcttagtctcttgcatggacatgaacataggagcgctcatttctggccagatgacttctatagcccaatctaactcttctagacttgggtttcccactctgatcaccgccctatgtcgagccagaggggttgtctctgacagcctcacttttgagcgcctgagcctggtcattaatttagcctacatcaggaagaactgttggaatcctgatgatctaacagtttctatctga

SEQ ID NO: 60659 - DNA, 291 bp, Glycine max
  Peptide Sequence Number=SeqID_152344
atgtcagtctctgcatgctatcaggcttttcatcttacagatagcaaaaagaatgtttatacggataaccactcgggtatttccgtccgtcagcgtgactcaaatgtcagctttttgtcttacagacagcaaaagaaagtttatacggataaccactcgggtatttccgcccgtcagcgtgactcaaatgtcagtatgacagatcttgtgtgcgcggaagatgacgtaaatctccgcgtgtcaacgggcttgtcggccgcgattgacgaaggatgcagaagacgacgttag

SEQ ID NO: 60660 - DNA, 288 bp, Glycine max
  Peptide Sequence Number=SeqID_152345
atgggaaagcgcagaaagttgaatatcattcagaatgatggtcaatcacaagcaaaagagcaatcaattgaaagctctactgaagtgaaccaaaataacaactctatacttgaagaaaatgcacaatttgaagaagaacaacacatacaagaagatagtcatgttcagtctcatacttctcttgaaagtgcaagtgaaagttcaactaaagataaaaagagaactagaggttatacacatatgctagatgtgtgggacttgccagatggagaattcatacttgttgaa

SEQ ID NO: 60661 - DNA, 234 bp, Glycine max
  Peptide Sequence Number=SeqID_152346
gcatgttccaaaatagatccttccaatgttgattgcaataatactacgcatcctgaatgtcaatctctgtctgtcatagctgaccatgatccggttgccggattgcctttaacgcccaaaaaacggatgtcatctgatgaagttgatgatgagttagggagcttgcaaattttcccagcccaactatcgtctaacaaattaacaagacattctcataagagccaatttagctga

SEQ ID NO: 60662 - DNA, 390 bp, Glycine max
  Peptide Sequence Number=SeqID_152347
atgggtggttgtgccatactattgcagtcatgggcttggtacctcatgtcttttattgcaccaagagtcccacgatccgaaacaacttatccattggctaaaagatggagtggtggtagattagaatatagggtcacacttcatggtgacttgggacaagtgttgaacaaacacatttggaaatttcacatcctcagtcattgtactccttcccctgttcatcaaacttttggccagactggtgagtcagtcagcgcaactagccatgaatgcatgaccaatttatttggcgtcgatttgaatacaccaaattctgcggcatcatatttagcttctttacaacaattcgatgcaccacattcgtttggagcacaaggacaaagttcttaa

SEQ ID NO: 60663 - DNA, 174 bp, Glycine max
  Peptide Sequence Number=SeqID_152348
atggaggttaaacttgggaggattgatggggacccagtgttgagaggaacaaggatatgggctacgtgggagtacgtgagctcagttggaggtgggcaacaggggatggtgggtttatgcgcgcattgtggatgtggaaaacttgttgtgcaccatcgctcgaccgccacctag

SEQ ID NO: 60664 - DNA, 213 bp, Glycine max
  Peptide Sequence Number=SeqID_152349
atgttcagccgtcttgattttcaaccgtttttcaacgttcttcgttcgttcttcatcgttcttcagtcttcaaccgataaaaacaacttaaccaaatactttgttcacaaagaactacgtaggtctgatttccttaacacaattgaggaatacgtaggagtaagggaaacaccctcgtcaaccgcaaaagataaaaaatataaaaaggaataa

SEQ ID NO: 60665 - DNA, 327 bp, Glycine max
  Peptide Sequence Number=SeqID_152350
atgcatgagacatcgggatttagcagtccaagagacaacatagaacataggaatgttgttagatctcccacaggcaacctagttcctctagacttggaaactgaagccaccttaagaaggaacagagctgagaggagaaggaagttgttgcaagataggacagtagcttccattctagaagaagaagctcaatcttcagactctacatcatctgattcactatcatcaagggaatcagctatatacttaccagaagcctctgtcatggctgatgaagaccagcaaagggttacccttgaggattattctagtagctcagtgccgtaa

SEQ ID NO: 60666 - DNA, 240 bp, Glycine max
  Peptide Sequence Number=SeqID_152351
atgaatattgaagaaatcattcatgttactccatttgatgaatctaatgctcttgtcaagaaagaatatgcatgccatattggaatctttgaacaagtttatcatggacaagattctaaaggaaaagggaaaggaagcaatgaacagatcctccagaaagaagccaaatcaaataatgaacttccaaaagaatggaaagcccctcaaaagatcaagtatcctcttgatagcattttctag

SEQ ID NO: 60667 - DNA, 210 bp, Glycine max
  Peptide Sequence Number=SeqID_152352
atggtgaaagttggaacgtcttacgtgccgatcaatgtctcattttcgccaaaagttggcccagggcttcccggtatcaacagagacaccaggatttatttattctgcgaagtgatcttccgtcacagctgtccctcttgttcagctaatgacggggtgaagcgccccccccccccccccatcgttaatgatactgcaagtatattatga

SEQ ID NO: 60668 - DNA, 384 bp, Glycine max
  Peptide Sequence Number=SeqID_152353
atggcatcattgacatccgttatactggaaagtctcttggtttatttcactcacgctgagaagcacggtgttgaagtcgttagtatgttaataatactagtttgcaaattaagtatgtgtcatatcctaatttcgtccggggatcatctgttgttgggatgcgaccctcgtttgaccacttcgagctacttggcacccatcgttaggcaatccgtgaagttccgtgacatgccggaagttaaaaggaagtggggtgcaaatagcaaccaggcccacttgggccttccaggaagttctccaaaaggcggtgccttctggaggaagcaacctagctcgcatgggcgagctgggtgtcaagcttatccttccttttcctataaatag

SEQ ID NO: 60669 - DNA, 216 bp, Glycine max
  Peptide Sequence Number=SeqID_152354
atgtgcacgtgtgcaatttttggtagccagaatgctttgagtatgcatgaaatggccccgaggaagcttgcctcaaaaaggtccaggaaggataaggcggccgaaggaactagttccgctcctgagtatgacagtcaccgctttaggagcgttgtacaccagcagcgcttcgaggccatcaagggatggtcatttctccgggagcgacgtgtctag

SEQ ID NO: 60670 - DNA, 869 bp, Glycine max
  Peptide Sequence Number=SeqID_152355
gagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggctcaccaaaacttgtcctttcagtttagccttaaaccggcgcatgacttcaagactaactcctctaaatccaattaccagtggctgctgccagtggtgcttttgcatgtctttccggtccagcttggagcgaactgcctacccggaactgagtgtcaggcgtggaatgagacaaacgcggccataacagcggaatga

SEQ ID NO: 60671 - DNA, 267 bp, Glycine max
  Peptide Sequence Number=SeqID_152356
atggtgaaagttggaacctattacgtaacgatcaatgtctcattttcgaaaaaagttggcccagggcttcacggtatcaacagggtcaccaggatttatatattctgcgaagtgatcttccgtcacagctgttcctcctgttcagctactgacggggtgggcgcgtcccattcgccattcaggctgcgcaactgttgggaagggcaatcggtgcgggcctcttcgctattacgccagctggcgaaagggggatgtggtgcaaggtga

SEQ ID NO: 60672 - DNA, 318 bp, Glycine max
  Peptide Sequence Number=SeqID_152357
atgcaggggctgacacagtcttctgcaccttttgttcctccgggaaccacaaagtcagttacatgcggaaacttcgaggtcgcccgcgactctcgtcgaccgaggggagcgaaattagtgtcatacactgattttcgggacctttgcttgatgacatgcgaccatctttggtccttgagcgaccagtcatggtcacccgtgactctcgtcaaccgagaggaaacgaaattagtgtcatacactgattttcggggacttttgcttgatgacaagcgaccattctttggtccttgtaaggtgcttggcacccatcattag

SEQ ID NO: 60673 - DNA, 255 bp, Glycine max
  Peptide Sequence Number=SeqID_152358
atggcaatcaattcatggggcttcagactcaatggtggaggatgcatgaatggcaatcaattcatggggctccgagtaagatttgatgcgcaaggcaatcaattcgtggggctccgaataatatttgatggtggaggatgcatgaatggcaatgaattcatggggctccgaataagatttgatggtggaggatgcaccaacagtgctaggcaatcaacttgtggggctccggactcgatggtggaggatgcatga

SEQ ID NO: 60674 - DNA, 1440 bp, Glycine max
  Peptide Sequence Number=SeqID_152359
atgctgccattggttctgacccgcaaaattttcgctgctgtagccttcggggcccctgtactggcggccgttgcgcctgcgcaggccttcaccgacaacagcgacgtctccgcaacaccgtttgccgatccggcacgtttccagaaaatcgctgatgaattaccggcgctgggctatcaggacgatacatcggcgttcagtaaaaagctggcgggcattgccaaaagcatcggcgaggccagccagaacagcgacagcgataccacgctgggtcagcaggccggaatctgggcgtttaaccattttcgtgatgaggttgccacccgggtggcggatgaagggcagtcgctgctgtcgccttatggccaggcacagatcgatctcaacgtcgatatggagggcaacttcagcggcagcggggcttcgctgctgacgccatgggccgatcgctacaattacctcacgttcagccagctgggcgtgcaccagaccgatgacgggctggtgggcaatgccgggctgggacagcgctgggtggccggcagctggctgctgggctataacggcttcgttgatcggctttttgacagcggcttgcagcgcgcttcgctgggcaccgaggcctggagcgattacctgcgcttatccgccaactactacacaccgctgtccggctggcgcaatcgcaacccgttccagcagcagcggctggcgcgcgggtatgatgtcactacccagggctatctgccgttttaccgccagctgggcgtgtcggtcagctggcagcagtatctcggcaacaatgtcgatctgtttaattccggcaacagctaccacaatccttcagcgctgacgctgggcgtctcctacacgccagtgccgctggtcaccgtatcggccagccacaaaaccagtaatgaaggcgagagccaggatcagctcggcttacgtctcaactaccgctttggcgtggcgctcagtcagcagctcaatccggataacgtcgccgccgcgcgttcgctgcgcggtagtcgctatgatttggtcacgcgcagcaatacgccggtgctggagttccgccagcgtaaaaccctgtcggtattcctcgccacgccgccgtggcagctcaatgcgggcgagagtttgccgctgaaactgcagatccgcagtgcacatccaatcagtaaagtcagctggcagggcgatacgcaggcgctgagcctgacgccgggtgccgatcccaacgatccacagggctggagtatcattatgccggcgtgggatgcgtcgcctgaggcgaacaacagttatcgcctgtcggtgacgctggaggacagcaagcaaaatcgcgtgacttccaactggattacgctgcaggtgcagccgccggtgatgctggagcaggggggcgaaaaccgcttcgacctgctggcgccataa

SEQ ID NO: 60675 - DNA, 201 bp, Glycine max
  Peptide Sequence Number=SeqID_152360
atggcaaaggggtgcggaatgaccaaattttgtctccgcatgtcacatgacctcagggtcagtgcggataaccgtaaggtgtctccgcaggctaccagctcttgggtcatgacaacaaaaggtggtgtggtcgacaaaagcgaggctcttgctcctacgtatcctccaatgaggaactcagacctacgtagttctggataa

SEQ ID NO: 60676 - DNA, 165 bp, Glycine max
  Peptide Sequence Number=SeqID_152361
atgctgacatctctaggaaaggtggaggtgacgacgttagtcactgcatggcgtctccgcgtgccaacggactcacaggtcacgatagcaaaagttggggcggtcgacaaaagcgaggcttttgctcctacgtatcctcaatttgtgatgaggaactcagactga

SEQ ID NO: 60677 - DNA, 331 bp, Glycine max
  Peptide Sequence Number=SeqID_152362
atgtggggtgctaataccttccccgtgcgtaaatacaactcccgaacctttcacttaaaagttcgtagatcgcgtcttttccggtttttccgacattttcctcaaataaacgttggtggcgactccgcgcgtattcctttcgtgcaacacgcttcccgcgagtctcgcgtcgccctcccgccgaagggtaggttgcgacaatgcttacccaaggttttcggaaaatttacggaagccccggaaaccatttttcaaaaacgtggaggagttttccgcctagttgcttcctccttaagcaacccaacttccaaaatgttccggaagggcctag

SEQ ID NO: 60678 - DNA, 627 bp, Glycine max
  Peptide Sequence Number=SeqID_152363
atgggtgaagtagaagaggtgcaagagcaaatggagtccgacacggaggccttgaaagagaaaatggccacaatgatggaggccatgatgatcataaaggagatactggaggttagtgtggcttaccgaacccgtgctaaagctagagtaatgggtaaagtagaggaggtgcaagagcagatgaaggctgacatggaggccatgaaagagcaaatggccacaatgatggaggccatgatgagcatgaagaagataatggaagccaatgcggttacagttgttgctaccagcgttgttgctgaggtgaacccgatgcccctatctggccttaaccaaatgaatcatccaacctcagatatggtaggcaaagatttgggaagtacgggcagcccctattatgcgcaaattcaaaacaagcatgccttcccaccatatggcttgcctcccaactatacaacacccaatgtggcatacattcccaatgaggatgtcaataactccactccgatactcattgagagccgacaacctgatcatgcacatgtctctcaacccatgggggagacacatgaaatgccccaccacaatctagcggactttgagccttgcctcggatatgccacttaa

SEQ ID NO: 60679 - DNA, 363 bp, Glycine max
  Peptide Sequence Number=SeqID_152364
atgtcatctattgtttgcagggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctagagttcacctcagctcatccacaaaaagtaggacgcacctagttgctcatgatcctggggatttaacctccaccccaccgcgcaagctcggaaggtag

SEQ ID NO: 60680 - DNA, 470 bp, Glycine max
  Peptide Sequence Number=SeqID_152365
tacctatcgccttaagaaggttgcatgccctcaccttcatagggctgcacgtcctcgcctttagagggctccacgtcctcaccttaagagggctgcacaccctcgccttcagagggctacacgccctcaccttcagagaactaaaggtcctcaccttcagagaacaacacttcctcgccttcagagggccacacgccctcgtctttagaggactacacgtcctcgccttcagagggctacatgccctcacctttagaagactacatggcctcgcctttagaggactacacatgctcaccatcagaggactacacgtcctcgccttcagagggctacacgccctcgccttaggagaaccacacgtcctcgctttcagagggctgcatgccctcgccttcagaggactacacgcccccaccatcagagaactacacgtcctcgccttcagaggactacacatcctcacctaa

SEQ ID NO: 60681 - DNA, 612 bp, Glycine max
  Peptide Sequence Number=SeqID_152366
atgggttctgtcttgatccctactgtaaacaaaccaacggagggtccgtgtcgccttcttaaaaacgtgcgttggggcatttcgctacccctagatgtcgtatctaagaaggtgacaaattccccggacccccgtattcgtaaattgcatctgtgtcatatgcatttcttcatgcattcatccatcccacccatgagatatcggagttttgatttgcaccagcttttgtctcactttaaggttctaccaagtcaaggtcaaaagcctagataccaccagcatcaaggaattagggcggttgatggaacccctccaaatgcaagccttccgcagacttacggaaagatcttagagttgaccatagcagagaattgcaactgtggtcaaggattcagcaagaggtttggacagcataaaacagacttggaacggcatagcgggcctaccacggaggtacctagaagacaaggcgaggggtatggccaatcaaggagattgggtcccgtttatggatgtgttagctttgcttatttttggggtcgtcctctttccaaacgtggatggtttggtggacctagcagcaatcgacgctttccttgcttaccaccatag

SEQ ID NO: 60682 - DNA, 594 bp, Glycine max
  Peptide Sequence Number=SeqID_152367
atgacatgcggagacaaattatggtcattccgcacaccttttgccattcagatacagtcgtgtccgatggcacgcagagacaaattatggtcattctgcgcccttttgtcatccggaggcggcgggcccgatgacatgcggagacaaattatggtcattttgcacaccccttttgccattcagacacagtcgtgtccgatggcacgcagagacaaattatggtcattctgcgcccttttgtcatccggaggcggcgggcccgatgacatgcggagacaaattatggtcattccgcacacccttttgccattcagacacagttgtgtccgatggcacgcagagacaaattatggtcattatgcgcccttttgtcatccagaggcagcggacccgatgacatgcggagacaaattatggtcattctgcacacctttttgccattcagacacatttgtgtccaatggcacgcagagacaaattatggtcattctgtgcccttcgtcaatcgcggccgacaagcccgttgacacgcggagatttacatcatcttccgtgctcacaagatctgtcaatcgcggccgacaagcccgttga

SEQ ID NO: 60683 - DNA, 297 bp, Glycine max
  Peptide Sequence Number=SeqID_152368
atggcttacgaacggggcggagatttcctggaagatgccaggaagatacttaacagggaagtgagagggccgcggcaaagccgtttttccataggctccacccccctgacaagcatcacgaaatctgacgctcaaatcagtggtggcgaaacccgacaggactataaagataccaggcgtatccccctggcggctccctcgtgcgctctcctgttcctgcctttcagtttaccggtgtcattccgctgttatggccgcgtttgtctcattccacgcctgacactcagttccgggtag

SEQ ID NO: 60684 - DNA, 370 bp, Glycine max
  Peptide Sequence Number=SeqID_152369
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagagaaccttcgaaaaaccgctctgcaaggcg

SEQ ID NO: 60685 - DNA, 376 bp, Glycine max
  Peptide Sequence Number=SeqID_152370
atggcgggttacacacctacaagttttacagatttggacttcgccagcaaaaagatcgaagtggatctgaaaagaggcaaatttaatcatcctgcttggacgaatgagaaaactggggcaaataaagagggtgaggacgagggagaaacccatgctatgactgccattcctcctatagagttcagcccaattccagtgtcctatgctgacttgctcccatatctacttgataattcaatggtatccataaccctagccaaggttcatcaacctccatttctccgagaatacgactcgaatgcaacatgtgcttgtcacggagaagccccggggcgttccattgagcattgtagggatctgaagcgtaaggtgcaag

SEQ ID NO: 60686 - DNA, 699 bp, Glycine max
  Peptide Sequence Number=SeqID_152371
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgccccccgttttcaccatgggcaaatattatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 60687 - DNA, 1128 bp, Glycine max
  Peptide Sequence Number=SeqID_152372
atggcacagaagaagagcactccaatcactcctaccacatccagacggagcaaagttgcaatcccttccaagaagaggaaagaaatttcctcatctgattctgatgatgatgtcgaactagatgttcccgacatcaagagggccaagacatcagggaaaaaggtgcctggaaatgtccctgatgcaccattggacaacatctcattccactccattggcaatgttgaaaggtggaaatttgtgtatcaacgcagacttgccttggaaagagaactgggaagagatgccttggattgcaaggagatcatggacctcatcaaggctgctggactgctgaaaattgtcaccaagttgggagattgctatgaaagtctagtcagggaatttattgtcaacattccctctgacataacaaacagaaagagtgatgagtatcaaaaagaaatcactgccaaacaagtccagcattggccaaagaaagggaagctttctgctgggaagctaagtgtgaaatatgcaatcctgcacaggattggagctgcaaactgggtacccaccaatcatacttccactgttgccacaggtttgggtaaatttctgtatgctgttggaaccaagtccaaatttaattttggaaactatatttttgatcaaactgttaagcattcagaatcatttgctgtcaaattacccattgccttcccaactgtattgtgtggcattatgttgagtcaacatcccaatattttaaactacactgactctgtgatgaagaaagaatctcctctatccctgcattacaaactgtttgaggggacacatgtcccagacattgtctcgacatcagggaaagctgctgcttcaggtgctgtgaccaaagatactttgattgctgaactcaaggacacatgcaaggtgctggaagccaccatcaaagccaacacagagaagaagatggagctggaacggctgatcaaaaggctctcagaaagtggcattgatgatggagaagcagctgaagaagaagaagaagcagctgaggaagaagaagaagcagctgaggcagaggaagatgcagcagaggatacagattcagatgatgatgatgattctgaagccaccccatga

SEQ ID NO: 60688 - DNA, 387 bp, Glycine max
  Peptide Sequence Number=SeqID_152373
atgaggcctttgctgggcaaatggggctgggaattggcgactaatcagaatcacttttggcccagaattgtaatgtccaagtatggtggctggaatgctctgattcatgggagaaactccacagctttctctaagtggtggaaggacttaaaatctattttccagcagcagcacactaataggctgttttataatttgtgttggaagttgggtaatggggcaaaaatcaggttctggaaggataaatggagagaggatgatttaactcttcaagaaaaataccctactttgtatcaagtgagctaccagcaggattcttctatcagcctaatgggaattcttgttgataataaatgggaatggaggatgcaatggaggagaaattga

SEQ ID NO: 60689 - DNA, 786 bp, Glycine max
  Peptide Sequence Number=SeqID_152374
atggtagaagtctccacagaggccattgcctccctcacccagtattatgatcaaccattgaggtgcttcacttttggggacttccaactatcacccatggtagaagaattcgaagaaatactaggatgtcctctagggggaaggaaaccatacctcttctcagggttctatccctcattagctagaatttctaaaatattccaaatcttggcgaaggaattagaccatcaaaagcaagtcgaaaatggggtggtcgggataccgagaaaatgtttggaggcaaaagcaagaatcttggcaggtagaaacgaatgggccccattcatagacgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccgctcgtgcgtcgaaaaaggaaaggcgaattgggaccaactcttggctagcatggagggacgtctgttaattggttccctcgctagaaggaaggaagaatcaggattgtatcttcatgcgaaggatatccaaatgttccctggatgggaacatggggttgtattaattataatcccgtcctcgccataa

SEQ ID NO: 60690 - DNA, 465 bp, Glycine max
  Peptide Sequence Number=SeqID_152375
atgaccatgattacgccaagctcgaaattaaccctcactaaagggaacaaaagctggtaccgggccccccctcgagggcctgttgggggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60691 - DNA, 132 bp, Glycine max
  Peptide Sequence Number=SeqID_152376
atgaagggtagagttaacctagggttaaattattggcctcaataccaagatgctcagaacgaagaagacttatgtgctcagtttgagaatgggcttcgattggagattcaacaggcagttagctacatgtag

SEQ ID NO: 60692 - DNA, 807 bp, Glycine max
  Peptide Sequence Number=SeqID_152377
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaacttggattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 60693 - DNA, 318 bp, Glycine max
  Peptide Sequence Number=SeqID_152378
atgtcattgcctagcgctgttcatgtgtcctccaccttcgagtttggagctatgcttcatgattgcctaagtgtggaccttcaagtgcaatcctccattctccacttttttcggagccccatgaatgtcatgcctagcgctgttcatgtgtcctccaccttcgagtttggagctatgcttcatgatttgcctaagtgtggaccttcaagtgcaatcctccattctccacctttttcggagccccatgaatgtcattgcctagcgctgttcatgtgtcctccaccttcgagtttggagctatgcttcatgattgcctaa

SEQ ID NO: 60694 - DNA, 809 bp, Glycine max
  Peptide Sequence Number=SeqID_152379
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaccactctaaatgctagagttaacagtagtgaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60695 - DNA, 422 bp, Glycine max
  Peptide Sequence Number=SeqID_152380
ctccagaagacataagcgctgtcaactgtcgctgccccgctgtgcaaaaccaccgctcccggcgccctgaacgaaacgccaattcatgggttccattaaacattcgagaagggcaaatgtccggaagcaatcaatgtgcggggtccaaactcgttggtggaggacgcatgaacaaaaacgcaattcatggggaagccggaatgaaaacacaattcatggggctccgaaaaagatttgagaatggagaattgcacgaagcaatcattacgcatggctccaaactcgtgggtggaggacacatgaacgaaaacgcaattcatgggtgtcgcaacctacccttcggcgggagggcgacgcgtgactcgcgggatgcgtgttccacgaaaggaatacgcgcggagtcgccaccaacgtttatttga

SEQ ID NO: 60696 - DNA, 213 bp, Glycine max
  Peptide Sequence Number=SeqID_152381
atgggacattttcttcagcacgaggtccccctcattgaacttgcgcgggcgtaccttcttgtcgaatgcgttctttatccttcgttgatacaaacacccatggctcatggcggctgtcgcaacctacccttcggtgggagggcgacgcgagactcgcgggatgcgtgttccatgaaaggaatacgtgcggagtcgccaccaacgtttatttga

SEQ ID NO: 60697 - DNA, 543 bp, Glycine max
  Peptide Sequence Number=SeqID_152382
atggaccaagttcaacgccaagccttcccgttgttggtgtttgggatcctcctctttccaaatgtagacgggctagtggatctagtggcaatcgattcttttcttgcttatcaccacagcaaggaaagctcgactgttgctgttttggccaatgcctatgacatgttcgaccagagatgcgagaagagcagcgcgagaattgtctattgcacacccgttctttatgtatggctgctctcccacatttttcgacatgaaagtagacctgtttgtcccctacaaggtcatcgcatgtgtgccgagaaagggaagccaaattgggaagaactcttggtaggtatggtaggggcatccgttaattggttcccccaatggaaggaaggaggggtcggagttttgtgctcatgtgaagggttcctaaacgtccccttgatgggaacaaggggttgtattaactataatcccatactggccataagacaactaggctaccctatgagaggggcgccatcgaaagagggtattgcgtctttcatcgcatga

SEQ ID NO: 60698 - DNA, 455 bp, Glycine max
  Peptide Sequence Number=SeqID_152383
atggcacatgtatacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 60699 - DNA, 484 bp, Glycine max
  Peptide Sequence Number=SeqID_152384
gcatcctctggacccagataagtccaacagggccctgggatttcccgccttgatcacaggactctgccagtcgttcggcgtccccgtcacacctagcaagagacagatccagggtgatgcaccacaggccgcggacgcgtcgccacctcatcaggctggtccagccggattgtttgatacggagcagtatttgcggcatttggttcgccagcaggcggccaaccaccgggcacatgtacagactcatgattgtctttatcagatgagtctcagcctgcagagccagggctttacttcttttccgtgccctactccggaccagttcagggcagaggtcgcatggcctagagattggcctgaggcccaggcaggagaggcaccagcaggggcaccagcagaggctcccaacgaggcagatggggctcgcgaggacgaagagatgaccgatttacttgatttcttaggagggagcggggccacatga

SEQ ID NO: 60700 - DNA, 589 bp, Glycine max
  Peptide Sequence Number=SeqID_152385
ccttaaggagttgggacggttgatgggacccctccaaaggcaagccttccgcaaagtgtacggaaagattttggatttgaccgcagtggaggtatttacggaagctgttgtatccctcgcccaatactatgaccagccgttgagatgcttcacgtttagggacttccaaatgcaagattgcagctgtggtcaaggattcggcaagagagttggatcgtatgaagcaaactcgaaacggcgtagtaggcctacaaagagtctcaaggttttacaaagagtccacaaggcgtggagaagtctgttgaggaaagataaagaacttaggggcatccgtaatcgcatcatcggtggttatcatgaatggctaagggttcatacgcgagggttagattggctctccaagttgaaagttatgaatgaggagaacttcgaagctccggaagaggatgaagaagtccaagctctaaaattagagctaggaaaggaaagactcgccaaagaaaaattcaagtcagccggtacttcccgagacgtgccgaaaatcaaaaggaagcaggcttacgcgatccgtgaaaattccgtgatatga

SEQ ID NO: 60701 - DNA, 432 bp, Glycine max
  Peptide Sequence Number=SeqID_152386
atgaaggagaaggagattataacaatgatagtggacacgttatcggtgttctactatgagaagatggaagcctgggaaaatgaagagaataaggagggaggaacccatgctgtgaatgtcgtccctacatggccaaatttccccccagctcaacaatgtcaacactcagccaatattagctcttctcattacccaccaccctatcaaccaagaacactcaatcatccacaaaggccacccctaaatcatccaataccaaacaccactcttaacacaaaccaaaacaccaaccaaggaaggaattttctagtaaagaagcctgtagaattcaccccaattccgatgtcgtatgctaacttactcccatatctactcaataatgcaatggtagccataaccccagccaaggttcgtcaacctccatttttctga

SEQ ID NO: 60702 - DNA, 117 bp, Glycine max
  Peptide Sequence Number=SeqID_152387
atgtggaccgtcacgggggaggatcttgccacccagctcgcccaggtgagcaaggttgcttcctctagaagcaaccgccttctggaagaagaatctggaaggcccaagtggacctga

SEQ ID NO: 60703 - DNA, 246 bp, Glycine max
  Peptide Sequence Number=SeqID_152388
atggacagaatgagaaaggataatgaggagagtttgagaagaatacacgggagtagtgaagctttaagtgtgaggattgaaaacataaagaaaagaagagaggataaatcatctaattcttctcatggagaagatgaggcatatgaagaggatgtgggaggaaggaggaatgagaggtatagggagagaagaaatcatagaagatatgaaggtaggaaaagagaggaatggattgacggagtgtag

SEQ ID NO: 60704 - DNA, 117 bp, Glycine max
  Peptide Sequence Number=SeqID_152389
atgtggaccaccacgggggagatggttgccgcccagctcgcccaggcgagctcagctcgcccaggcgagccaggttgcttcctccagaagcaacagccttctggaggaaccttctag

SEQ ID NO: 60705 - DNA, 432 bp, Glycine max
  Peptide Sequence Number=SeqID_152390
atggctaccaattaccaggacaacatgtttgtccatgcccatttcttaatatttgagtatgataaaggtgtaagtagtgcaacaactacattctttgaaacgaatctatcgaatgccacgactttggtattaagctcaagttctacaacttcaattcttgtgtcatatgctatgacatcagcctcggtgtcgaatattgtgagcacagttgcaatgccactctactcaaacgctgatgtaattgcgagcatgagaggctggagagcattcctccatttcaatccatgcccatgttggggcaggacctttgtatcaaggaggccttctgatgtagctccatgtggagcttgtgggccttggatcttcttcatcaatggagtcatttgcttcttaaagttcaattgcagcaaaatggagaaggaagaaagatga

SEQ ID NO: 60706 - DNA, 340 bp, Glycine max
  Peptide Sequence Number=SeqID_152391
atgtcaggcattagacctattctgtttccttacaagaacagccgtgcagttctgtggaggtacgcccctccaggcggtaagaaggaagaagctaccgacatcagctcactatcagccaaagtaaccaacatcaccgggctgagcgacataacccgcagtggtcgcgtgttcgcaccccctggcctgccaatgcagcccacgaacgctaaagggaaagcaaaggtgaccgaaggacaaaatgtcaaggcgatccccgcatcggacgaggatgttccggcgaaggagtttatcgagggaagagagggtcgcaacaagaaagaggtatcactcgaggaggcca

SEQ ID NO: 60707 - DNA, 276 bp, Glycine max
  Peptide Sequence Number=SeqID_152392
atgggatgttacaatggtcaatgtctcagcatatctgtcatacagttgtggattctgcatttgactgagacaactatgcgagcggggaattccgatgtgtatggattcctcgagccacagtctattcagagatctaggcaatcacagtttgactcagaaagttacatcaagagttggatgcagagttcaaaatgcaatgtctaccttggaggctacttaaatggcggacactggcaaatggtggtcattttgcccaaggaaaatcttgttgtctag

SEQ ID NO: 60708 - DNA, 619 bp, Glycine max
  Peptide Sequence Number=SeqID_152393
gtcgactctagaggatccccaagagctggtagcccgcggagataccttacggttatccgcacccttttgtcatccagaggcggcgggcccgatgacaagcagagaccaaagaccaagtttggtcattctgcacccatgatacgcggagataccttacggttatccgcacccttttgtcatccagaggcggcgggcccgatgacaagcagagaccaagtttggtcattctgcacccatgatacgcggagataccttacggttattcgcacccttttgtcatccagaggcggcgggcccgatgacaagcagagaccaaagaccaagtttggtcattctgcacccatgatacgcggagataccttacggttatccgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttacggttattcgcacccttttgtcatccagaggcggcgggcccgatgacaa

SEQ ID NO: 60709 - DNA, 184 bp, Glycine max
  Peptide Sequence Number=SeqID_152394
atgacaaaatctcatgagaacaacaaggaagaatctgtaaggaagaagtggtacatcaacagtggatgttccaagcatatgacgggagatgcatccaagtttacaaccatttcccataagaaaagtgggcatgttacatacggcgacaacaacaaaggcaaaatcattggagtcggcaaaatag

SEQ ID NO: 60710 - DNA, 405 bp, Glycine max
  Peptide Sequence Number=SeqID_152395
ggagataagaaggatcttggagaagattgtgcagccaaacagaaggattggagcaccaggctggatgatgctctttgggcacataggactgcctacaaagcacccataggaatgtctccctatcgggctggagaggaaacctatgagaaatccaaattctacaaggagaagaccaagaagttccatgacagcttgatagctaagaaggacttcgtggttggactgaaagttttattgtataagtttaggctcaaactcatgagtgttgagatcaaaagtgaatccacagataagagcttcaaggtcaacggacaccggctgaaaccattcctcacaaatccttccttggtggatgtagtggtggaggagacctccttacttcaccctacttctcttccgccgtga

SEQ ID NO: 60711 - DNA, 225 bp, Glycine max
  Peptide Sequence Number=SeqID_152396
ggtgtgatctccattgtccttgttgattgtagggaccttgttggaaacctgagaatcctccttggttgtatccttgcctttgttgatttcccatgcctaggatcttcttcatcaatggattcttttgcttcttggaagatgaatgacagtggaatggagaaggaagagagagaggagacgccacttcaaggagaagatgagtctagaggaagctcaccaccatag

SEQ ID NO: 60712 - DNA, 255 bp, Glycine max
  Peptide Sequence Number=SeqID_152397
atgaatattgaggaatccattcatgtttcctttgatgaatctaatgttatttctccaagaaaggatgtgttagatgatgtttcagatttcttagaagagatacacactcatgaaaggggttctcaaaggaaaagagatgaaagcaatgaggattctcaagactacgaaactccagcaaccaatgatcttccaaaagagtggaaagcttccagaaatcatcctcttgacaacattattggtgatatttctaaaggg

SEQ ID NO: 60713 - DNA, 1080 bp, Glycine max
  Peptide Sequence Number=SeqID_152398
gtcgataagcagcgcgggctcgaactcgcgcaggccttcttcaatgcatcgcgcagcggcgacatgaatgcgcttggtgcgatgctggcagcagatgtcaaccttcaggccgatggtggcggcaagcgcccggctttcccgaagcctgttttcggcttcgaagaggtgatgaaaacccacgagaaactggcgggctatttccgtggcaaccagtccacgcttttgcgtgcggtcttcatcaatggtttgcccggcatcatcacgcgtgaagccgatggcgaaatccagacgacagctctcgatattgaggacggcaagattgtcggcatctatgtgcatgtctttgtcccgaaaccggtctccactttttggagacatgctttacccgatcaggtagcggcaggcgcctgccgcgccgatgccgatcagcacggttggcagcatggaaaagcgcgtcgcagcgaagatcgtgattgcgagtgcgatcaggtcggcaggcttgtcggacacgaaatcgggcgcgatgaccgaaatcagaacacagccgggagctgcttccatcaccgccgtcgcgcgcttgctgagcgtgcggttgcgcagcagcacatagccgccgatccgcgtgagataggtgacacttgccatcagaacgatggctgcaacaagaccggacaaggcacccgcggcgacataccaggcgccgggaatggtgagataggtcagcgcggccaccacaaggctgaccagccacgggcgcgcggccgcaaaacctttccacatgcccgccagcagaaccagaaacactgccggaaatgccatgtcgaaaccataagggcgcaggtctcccatcatcggcccgaaggcggcacccagcgtggtgaggctcagcgccggattgacgcctttcgactggcgacgtttggcatcggcaaggccgagcgcccagctttcatcgcacatcagaaacaggctcgcaaaagccttgcgcttgggcagatggcggatgaagggggccagagccgcgcccatcagcagatggcggctgttgaccagaaaggtgatcgcaaggggatcctctag

SEQ ID NO: 60714 - DNA, 470 bp, Glycine max
  Peptide Sequence Number=SeqID_152399
atgcagctggcacgacaggtcgacggtatcgataagcttgatgttttggtgactgcgctcctccaagccagttacctcggtcaaagagttggtagctcagagaaccttcgaaaaaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60715 - DNA, 657 bp, Glycine max
  Peptide Sequence Number=SeqID_152400
aggactacacgttctcgcctttagagggaaaaatgcccttgccttcagaggactacacatcctcgcctttagaggactacacgtcctcgcctttagagggctacacgtcctcgcctttagaggactgcacgccctcgccgttagaggactacacgtcctcgcctttagaggactgcacgtcctcaccttcagaggactacacgtcctcgcctttagagggctacacgccctcgccttcagaggactacacgtcctcgcctttggaggacaacacttcctcgcctttagagggctgcatgccctcgcctttggagaaccacacgtcctcgccataagaggactacacgtcctcgccttcaaagggctgcacgccctcgcctacaaaagactgcacgttgtcaccttcagaggactacacgttctcgcctttagagggcaacacgcccttgccttcagaagactacacatcctcgcctttagaggactacacgtcctcgcctttagagggctacacgccctcgccatcagaggactacacgtcctcgccttcagagggctacgcgccctcgccttcgtagggatacacgccctcacttcagaggactacacgtcctcgcctttagagggctacacaccctcgacatcagaggactacac

SEQ ID NO: 60716 - DNA, 173 bp, Glycine max
  Peptide Sequence Number=SeqID_152401
cattcccagtcgcaggatcgacgtggaccaccggtctctctgccccaggtggtctagtggccaaggatcgtagtcgtgtggctttacgtgtccgcttaaaggtagacggagtttgtgatgctactacaagaggaggaggaggcaagccaggtggagtagccatgggcctataa

SEQ ID NO: 60717 - DNA, 411 bp, Glycine max
  Peptide Sequence Number=SeqID_152402
atggaagggttagtggacctagcagtgattgacgctttcctcgcctttcatcatggcaaggaaagcccggtcgtcgccattttggccatgtatgacacgttcgaccggggaggtgaaaagagtggcgcaagaattgtttgttgtgcactggctctctatgtgtggctgactgtgagagacgatgaggttaaagcttcggaagaaagtgatgaggtacaagccctaaagacagagcttgaaagagcccgagtagtcgaagagaagttcaagtccatagccatcaaagtctatgatgaactaagggacgtcaatatggccacagctgaagccttggaacgaggaaccaagaaggcccgaaaggaagaacatgaccaaagcaaagttttgaggggctttatagggcagcaatag

SEQ ID NO: 60718 - DNA, 177 bp, Glycine max
  Peptide Sequence Number=SeqID_152403
atggcttatcacgcgccaatgttccccacttgggaatcaggtggcatggttgaaaacttggtgggtcttgaggactgcctcttctattgcggccacctcctcttcgacaccattccagcgctggcgaaccttgccgtcctttttcgggactgggacaatgttggccacccactccgg

SEQ ID NO: 60719 - DNA, 312 bp, Glycine max
  Peptide Sequence Number=SeqID_152404
atggtgtcctccacccacgagtttggagccatgggtagtgattgcttagtgcaattctccattctcaatctgttttcggagccccatgaattgcgttttcgttcatgtgtcctccaccctcgagtttggagcaatggccccaagaattgcgttttcgttcatgtgtcctccacccacgagtttggagccatgcgtagtgattgcttagtgcaactctccattctcaatccgttttcggagccccatgaattcgcgttttcgttcatgtgtcctccacccacgagtttggagccatgcgtagtgattgcttag

SEQ ID NO: 60720 - DNA, 401 bp, Glycine max
  Peptide Sequence Number=SeqID_152405
ggtggacccttgggtactagtaccctcacccttagagggctacacgccctcgtcatcagaggactacacgtcctcgctttcagaggactacacgtcctcgccttcagaggactggatgtcctcaccttcagaggactatactacgccttcgccatcagagggctacacgacctcaccttcaaaggactacacgtcctcaccttcagaggactagacgtcctcgccctcagaggactagacgtcctcgtcgtcagaggactagacgtcctcgccttcaaaggactacacatccacccttgtagaggactacacgtcctcacctttagagggttgcacgtcctcgcctttagagggccgcacaccctctcctttagtgggctagacgccctcaccttcaaagg

SEQ ID NO: 60721 - DNA, 467 bp, Glycine max
  Peptide Sequence Number=SeqID_152406
agggtacatcctttgtggtacaagtagagggtacatctacttgggttgttgtaactgagaacaagagagggtacatctcttgtggatccgttcaagtggagggtacatccacttggttgttcaaagagaacaagggagggtacatcccttgtggatctttgcttgtaaaggattttacaaggttgaaaagtaatctcaaggaccgcaggaacaagtcaaatctgaaatcattccaagatcatgatgaagaccaagccaacttgtgtctcatgacaaaatctcatgagaacaacaaagaagaatctgtaaggaagaagcagtacatcgacagtggatgttcaaagcatataacgggagatgtacccaaatttacaaccatttcccccaagaaaagtggacatgttacatacggcgacaacaatatcagtaaaatctcaaaaaaggtaacatctaagtcatctctatga

SEQ ID NO: 60722 - DNA, 337 bp, Glycine max
  Peptide Sequence Number=SeqID_152407
tcgccattcaggctgcgcaactgttgggaaggcgatcgtgcgggccttctcgctattacgccagctgcgaaggaggatgtgctgcaaggcgattaagttgggaattcgatctccacaagatgagcgtactccttctcctcatcctcagcgagataatttagccctcatgactgaagttcttttcgagttacggggtcttcgtacttatgttggagaatgttttgattcattggataattgctttgccggaatggatatccgtctcatacagcttgaagaagatgtgggttatattcgtcagagctttgatcttccaccaccacctccaccttcttag

SEQ ID NO: 60723 - DNA, 534 bp, Glycine max
  Peptide Sequence Number=SeqID_152408
atgactaggggcaatccatctgacttacaaccctttgatcctgagatagattggacatttcatagattagttagacatcattttataccttttgagcatcctgagcattttgttactggtgagtctgtgcattatgttattggtgattttgaacatcctgattttgagcattataatattgaacattctgattttgaacattctgagaacatggcacaacctctaccccgtgagaggactctaagggaaatggctgcacctgatttcacctacgaaagcttgtgcatccaataccctgatgaagatgtcccatatattcttaaaactggactgatccatttgcttccaaagtttcatggccttgcaggtgaagaccctcataaacatctaaaagaattccatattgtctgctccaccatgaaacctccagatgtccaagaagatcacatctttctgaaggcctttcctcattctttagagggagtggcaaaggactggctatattaccttgctccaaggtccatcacgagctag

SEQ ID NO: 60724 - DNA, 195 bp, Glycine max
  Peptide Sequence Number=SeqID_152409
atggccaacaatataatcaacaacagggacagtggagaactcaccctgcgcactcctcacgctaagcgccatcttcttcacgcgctaagcgagctgctgttcgcgctaagcgcattaacccctgatcattggctgtatggtcccgctaagcgcgtgacctgtgtgctaagcccaataaactctatgtccatttaa

SEQ ID NO: 60725 - DNA, 111 bp, Glycine max
  Peptide Sequence Number=SeqID_152410
atggtcaatgagctgtttgatagaatgactgaaaaagggctatcatttactactgctaattggcgttgctgcggaagcgctttgattatatctttgaagcctcaaagtcag

SEQ ID NO: 60726 - DNA, 333 bp, Glycine max
  Peptide Sequence Number=SeqID_152411
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattctccattctggctgagcaactgttgggaagggcgatcggtgcgggcctcttcgctattacgccagctggcgaaagggggatgtgctgcaaggcgattaagttgggtaaccccagggttttcccagtcacgacgttgtaaaacgacggccagtgaattgtaa

SEQ ID NO: 60727 - DNA, 270 bp, Glycine max
  Peptide Sequence Number=SeqID_152412
atgttccccagtggagtcgccaattgtcgcaacctatccttcggcgggagggcgacgcgtgactcgcggaactttacggattgcgcactaacacttccttttaatttccagcatgtcacggaacttcacggattgtgctacaacgcttttcttttggcttccggcatgtctcggaacttcacaaattggctaatgatgggtgccaaatacctcgaagtggtcaaacgagggtcgcatcccaacaacggatggtcccccgaacgaaattag

SEQ ID NO: 60728 - DNA, 449 bp, Glycine max
  Peptide Sequence Number=SeqID_152413
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgttcgagcttcccggctgctttgtttacctaagcacgcctgggcaatggtgggcgcccctcccccagcctcgctgccgccttgcacccgtcggaaaagcgcagtatttgggtgagagcgacccgattttccaggtgccgtccgtcacccctttctttgactag

SEQ ID NO: 60729 - DNA, 540 bp, Glycine max
  Peptide Sequence Number=SeqID_152414
gtcaaggaatcttaggggtgagaccttctaagcccaaagatgataaggggaagacaatagaaaagcaaccccttaaggctagtatgcaagagaagactagctccacgaagtgctttaaatgtcttggaagaggacacattacttctcaatgccccaccaagaaaaccatgattatgaggggccaagacatttatagtatccaagatgaggctacttcaccttcctctagtaaaagtgaagaagcaaaaggggaagaatctagtgaagagatctacccccaagaagaaggacaatctttaatggttaaggaggagtgtaaggagacacttgttagcattgccacatctcttaggcttgagtttattcctcaagtaaatgagttgttggatgagggtttggttcgcaagagattaaatccttgtgctttgttggtgcccaaaataggtggtgtgatgaatgttttgggtggtgcaacactcttttgtaaaatcactcgtgcacccaacatcttcacgatttgtgtacatagggactcattag

SEQ ID NO: 60730 - DNA, 516 bp, Glycine max
  Peptide Sequence Number=SeqID_152415
tggaccttagcagcgattgatgctttcctcgcctgtcatcatggcaaggaaatcccggtcgtcgccattttggccatgcatgacacgttcaatcagagacgtgaaaagagcggcgcaagaattgtttgttgtacaccggctctctatgtgtggctggtttcgcacccttttttttccaagaaggtaggctcgtctatccgctacaaggaaggaagaatcgggattctatcttcatgcgaaggatttccaaatgttcccttaatgggaacaaggggttgtataaattataatcctgacagagagcttaggggaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccgggtagtcgaagagaagttcaaatccatagccatcaaagtctga

SEQ ID NO: 60731 - DNA, 531 bp, Glycine max
  Peptide Sequence Number=SeqID_152416
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcaaaaccgtttgcaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 60732 - DNA, 720 bp, Glycine max
  Peptide Sequence Number=SeqID_152417
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggccttttcgctattacgccagctggcgaaagggggatgtgctgcaaggcgattaagttgggtaacgccagggttttcccagtcacgacgttgaattcgatcaacccatatttcattttctttctgtctttcattactcatcaggaagctgaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60733 - DNA, 450 bp, Glycine max
  Peptide Sequence Number=SeqID_152418
atgcattgccctttctgtttcgccgtggataccaaagtcatcgattctcgcctggtcggcgaaggctcctccgtgcgtcgtcgtcggcagtgtctggtctgcaatgaacgctttaccacttttgaagtggctgagctggtaatgccgcgggtggtaaaaagcaacgacgtgcgcgaacctttcaacgaagacaagctgcgtagcgggatgttgaaagcgcttgaaaagcgcccggtcagcgccgatgacgtcgaaatggcggtaaatcacattaaaacccatctgcgcggcaccggtgagcgtgaagtagcgagtaaaatgatcggtaatctggtgatggagcaactgaagaagctcgataaggtcgcctatattcgcttcgcttccgtctatcgcagtttcgaagatattaaagagttcggcgaagaaatcgcccgtttacaggactaa

SEQ ID NO: 60734 - DNA, 228 bp, Glycine max
  Peptide Sequence Number=SeqID_152419
atgcggaagggaccactaaaagaaggaggaactgaagccattgatagtgttggaacacgcagaacttgtttgaaaatttattttattcttgatacgaaaaatgaggttacattaagcaaaaatggcaacagaaatgaagagaaagaaggaattctgaagaaggcccagcccaacagtggagctaagcgcgagtcaggcgctaagcgagcaaccaaatgtagacgctaa

SEQ ID NO: 60735 - DNA, 549 bp, Glycine max
  Peptide Sequence Number=SeqID_152420
atgggtagatggatatgggcttttgcatctggtcagcagcagctttgggtaagagttctaatctctaaatatggtggatggcctgagttccagtatgatacagataagaggggattttctcattggtggagggaccttagaaagatatttcaccagtcagatcacaatatcttcaagcaccaattgacttggaaggtgggatgtggggaaacaatcaaattctggacagacaagtggctaggggaagattatacccttggacagaaatataataagctttttctgattagtaggcagcaaaattctctcatctcaaatatgggagactttaatcatgatagctgggaatggaaccttagatggagaaggaacttatttgatcatgaaagtgatttagcagcccttcctatctacctactgtcattcttcaaaattcctaaaaaagtggtgcataaggtcatcaccactgcagtagaatttaagttaaacttagataagtaccttatgaagaggccagctaccttgtcacagctaacaagtcagaactga

SEQ ID NO: 60736 - DNA, 369 bp, Glycine max
  Peptide Sequence Number=SeqID_152421
tcgttcggagtccccgtcacacctagcaaggtgattcggccgcccatcacccgagcttttattgagaagtattgcacacagagacaggcccagggggatgctccgcaggctgcagacgcgccgccacctcatcaggctggtccagccgaatcatttgatacagagcagtatttgcggcatttggttccgtgccctactccggacctgttcagggcaaaggtcgcatggcctggagattggcctgaggcccgggcaagagaggtgccagcagaggcaccagcagaggctaccgacgaggcagatgaggcccgcgaggacgaggagatgaccgatttacttgatttcttaggaggaagtggggccacatga

SEQ ID NO: 60737 - DNA, 444 bp, Glycine max
  Peptide Sequence Number=SeqID_152422
atggtggggtacgcaccttcaagcttcgcggatttggtcttcaccggcgaaaggatcgaaacgggtctaaaaagaggtaaatttgataatcctgctctgacgaatgagaaaactggggctaatgaagagggtgagaatgagggagaaacccatgctgtgacgaccattcctatacggccaagttttccaccaacccaacaatgtcattactcagccaataacaacccttctccttacccatcacccagttatccacaaaggccatccctaaatcaaccacaaagcccacctaccacacaaccaatgctaaacaccacctttagcacaaaccaaaacactaaccaagaaataaattttgcagcgaaaaagcctgtaggattcaccccaaaattctggtgtcatatgctaacttgctcccatatctacttgataatgcaatggtag

SEQ ID NO: 60738 - DNA, 863 bp, Glycine max
  Peptide Sequence Number=SeqID_152423
atgggaacaaatcaaaccggcaagaggttctaccaagtcaaggttaaaagcttagataccaccagcatcaaggaattagggcgattgatggaacccctccaaatgcaagccttccgcaagacttacggaaagatcttagagttgaccatagcagaggattcagcaagaggtttggaccgcataaaacagactcggaacggcatagcaggcctaccacggaggtacctagaagacaaggcgaggggtatggccaatcaaggtgattgggtcccgtttatggatgtgttagctttactaatttttggggtcgtcctctttccaatcatagatggtttggtggacctagcagcaatcgacgctttccttgcataccaccacagcaaggaaagtccggtggtagctgtcttggcagatttatttgacacatttgaccgaaggtgcaaaaagagtagtgcacggatcatctgttgcttacccgctctctgtgtttggttggtttcacacctgttccagcaagacacgaggcatccatgtccgctccagagccatcgctcgtgtactgaaaagagaagaatagattgggaccagcttttggctgaggtaggaggtagaacaatcaattggttcccccgatggaaggaaggaaaggagggagtccttttctcatgcggagggtacccaaacattccactgataggaacgaggggttgtattaattacaatcccgcgctcgctataagacaactagggtaccccatgaggggagcaccgatggaagaaagcatgtctcctttccttgtgaggaatttcggcgtgcaaaatttcaaggctatacaaagaatccataaggcgtgggaaacccc

SEQ ID NO: 60739 - DNA, 198 bp, Glycine max
  Peptide Sequence Number=SeqID_152424
atgatgcctaatttctatatgcttggttctagagtggagaactggatttttagatatgtttatggcacttgtgatgcaatcctccctaggaagggaccaatcactagaaccatgagtaagaggctccaagaagattgggctagagctgctgaagaaggccctagggttctcatgaaccttagggactccatattgtag

SEQ ID NO: 60740 - DNA, 368 bp, Glycine max
  misc_feature (365)..(365): n is a, c, g, or t
  Peptide Sequence Number=SeqID_152425
ttcatcggaaccacttggttgtgcacgtaacagcccccctcccataggtgatcagcctgggagtccaaaggtgttccctactaggtacttggcaccctttgttgcacaatacgtgaagttccgtaacatgccagagatcaaaaggaagcattgttacacaatacgcgagattccgcccacttgggccttccaggatgttcctccagaaggcggttgcttctggaggaagcaacctggctcgcctgggcgagctggaaaatccaagccgaggcacttccgtaacatttccgtgggtgattttgcgaagattttcaaccgttcttcgtcgttcgtctttcattcttcgtcgttctttgatcttcaanccg

SEQ ID NO: 60741 - DNA, 150 bp, Glycine max
  Peptide Sequence Number=SeqID_152426
atgcaagaacaacttgaaggcctaggatcttcttcatcaatggatccctttgcttcttggaagatgaatggcagcagaatggagaaggaagagagagaggagacaccacttcaaggagaagatgagtctagaagaagctcaccaccatag

SEQ ID NO: 60742 - DNA, 933 bp, Glycine max
  Peptide Sequence Number=SeqID_152427
atggattttaccgccggactgatgtcgcttgagacggcactcacgcagatgcttgaccgagtttccccgctgcatgacgttgaaacgctgcctctggtgcgctgttttggtcgtattgccgcgcgcgatattgtctccccgcttaacgtgccagggttcgataattccgcgatggacggttatgcggtacgcctggcggatctccgggccggtcaggcgctgccggtggcgggtaaagcgtttgccggacagccatttaacggtgaatggcctgcgcgcacctgcgtgcgcatcatgaccggcgcgccggtgccggaaggctgcgacgccgtggtgatgcaggaagaaacggaacaaagcgacgccggcgtgcgcttcatcgcgccggtaaaagccgggcaaaatattcgccggcgcggggaagatatcgccaacggtgcggtagtattcccggcgggtacgcgtctcaccgtagccgagctgccggtgctggcatcgctgggcattgccgacgtcgaggtagtccgtaaagtgcgcgtcgcggtcttctcgaccggggatgaactccagttgccgggccaaccgctcggcgacggccagatttatgatactaaccgcctggcggtacatctgatgctcgaacagctgggctgcgaggtgatcaacctcggcattattcctgacgatccggcaaagctgcgcgacgcctttatcgccgccgaccagcaggccgatgtggtaataagctcaggcggcgtctccgtgggcgaagccgattacaccaaaactatcctcgaagaactgggcgagatcggcttctggaagctggcgattaagccgggtaaaccgttcgccttcggcaagctcagcaacagctggttctgcggcctgccgggcaatccggtttccgccaccttaaccttctatcaactg

SEQ ID NO: 60743 - DNA, 432 bp, Glycine max
  Peptide Sequence Number=SeqID_152428
atgaagggtgaaattccacgggagctcaacaacatggaagcattgacagaactcctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60744 - DNA, 294 bp, Glycine max
  Peptide Sequence Number=SeqID_152429
gtcgactctagaggatcccccatcccagagcttttcttgaggccttatcaggttagatgggatgccaccgtgttcggggtcgttaatccagatttccccctgtacataaagcacgaagacttctccgaaatcgcacacggtggtcaatgtctcagcatatcagtgttacagttgtggattctgcatctcactgaaacatgtatgcgagcggggaattctgatatctatggattcctcgagcctcagtccattcagaagattcagatgatgaagaagacttctcactctttgtga

SEQ ID NO: 60745 - DNA, 911 bp, Glycine max
  Peptide Sequence Number=SeqID_152430
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaggatctggtggaggtggtgcgccaggtggccccccagggcccgctggcgctggccggcttctcgttcggggccttcgtcaccacgcatgccgtggccgccttgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60746 - DNA, 787 bp, Glycine max
  Peptide Sequence Number=SeqID_152431
gaaagtagagatacatcacactgagctagatgagtttaaggctgaagtggagaggcgtaatttccataaatgcctcaccaatttagtcgatgggagcatagacctggctttggtgaaagatttctatgcaaatttatatagttttgaggactatccaccaaagaagtccagagtcagaggtcatttggtgaaaattgatgttggcagtattaacacattctttgagacacctgtggtattagccgagggggagaccttacccgcatactccagatactacaggttgcctacaaactacagagagatagagggccatcctgggaagattctcaagaaggatctgactacactagctcgggtgtggagtgtcctctcatactacaacttggccgccacatcacacacttctgacttgacagtggatagagctaggctgatctttggcctagtctcttgcatggatatgaacataggagcgttgatctctggccagatgacctctataccccaatctaacacttctagacttgggtttccagctctgatcaccgcattatgtagagccagaggggttgtctctgatagcctcacttttgagcgcctaaggctggtcattaacttgtcctacatcaggaagaactattggaaccccgaggatctaacaatttctatccgaggggttatgagggcgagggctaggctagctgagctcccttccacgtctgcggctcaaactccaacatccacatcagcagctccttctgtcccagcccagacagattcttag

SEQ ID NO: 60747 - DNA, 240 bp, Glycine max
  Peptide Sequence Number=SeqID_152432
atgactgaagcacgtcaaaagggggtacggaaagtaaatgaaacgagaataaatgtacacaaaacaaatgaggaccaccacggaatgttacggaacctcacaaatcgtgcaacgatgcttccttttgagttccggcatgtcacggaacttcacgaattgcctaacaatgggtgccaagtacctcaaaatggtcaaatgaaagttgcatgccaccaagcaaaggtccccggacgaaattag

SEQ ID NO: 60748 - DNA, 366 bp, Glycine max
  Peptide Sequence Number=SeqID_152433
atggcgaggacgtgtagtcctctaaaggtgaggacgtgtagtcctctgaatgtgaggacgtgtagccctacaaaggtgaaggcacatgaccctttgacggcgaggacgtgtagtcctctgaagttgaaggtacatgaccctttgaaggcgaggacgcgtagtcctctgaaggtgaaggcgaggacttatagtcctctggaggtgagggcgtgcagccctctggtggtgaggacgtgtagtcctctcaaggcgaggacgtgtagtcctctgacggtgagggtgagggcgtgcagccctctgatggtgaggacgtgtagtcctctcaaggcgaggacgtgtagtcctctcaacggtgagggtaactag

SEQ ID NO: 60749 - DNA, 310 bp, Glycine max
  Peptide Sequence Number=SeqID_152434
ccaggaaagatgacccatcgaggtctaaaaaagaagcatgaccggatgacgccgatcgaacatttcccaatcgcggtttctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttggcccaattggcaacctaggcatcagccttttgggagaccaaatggtggctgacttgttggctgttgggg

SEQ ID NO: 60750 - DNA, 354 bp, Glycine max
  Peptide Sequence Number=SeqID_152435
atgcaatctcagggacttgcactgcctccggagcctctagttggtccctcaggtcctcgagtaagcacaaaggagagttgtgttgatccctcaggaaacgatcctgagacgggtgactcagagaggtgcggcttgtacatcgaagcaaatcctactcacctggttgccctaggaaaagtttatgagggatccactgttgttcataacactcctttgttgcatgtccaagtaaaggtgggtgtggaggaggttaaagatccaaatgctcccgttcctgtacccactgatgaggtttccttaatgggttgtgtctccggcaaaaccacctcaaaagctggatccggaggtcgatga

SEQ ID NO: 60751 - DNA, 330 bp, Glycine max
  Peptide Sequence Number=SeqID_152436
aaaattgggggagaagcttgccacccagctcgcccaagcgagcagggttgcttcctccagaagcaacagccttctggaggaatcttttggagggctgttgcttctggaggaatcttctggagggcccaagtgggcctggtggctttggagaaacaaattgttgtaaaggatgccactgagaaaaagaaagaagaggtaacagatgtgacaagtcaggagagtgaaaaaccaataatggtcgaggagaaagaaataaacgaccaagaaaaagaaatagaggtagaaaaagaaaaagaaaatgaagaaaaagaaaaagttgaaaaaaaataa

SEQ ID NO: 60752 - DNA, 1038 bp, Glycine max
  Peptide Sequence Number=SeqID_152437
ggtggacccttgggtactagtaccctcacccttagagggctacacatcctcgccttaagagggctacacacccttgccgtcagaggactatacgtcctcacctccagaggaatacacgtcctcgccttcagaggactacacatcctcgccttcagaggactacacgtcctcacctttagagggcttcacgccctcgccttcagagggctgcacgccctcaccatcatagggctacacgtcctcaccttcagaggactacacgtcctcgccatcagaggactatacgtcctcacctccagaggactacacgtcctcgccttcagaggactatatgtcctcgcctttagaggactacacgtcctcaccttcagagggcttcacaccctcacctttagaggactacacatcctcaccatcagagggctatacgtcctcaccttcagaggaccacacgtcctcaccttagtgggctacacagggctgcacgccctcaccttcagaggactgcacgtcctcaccttcagagggctacacgtcctcgcctccagaggattagacgtcctcgccttaagagggctgcatgtcctcgccttcagagggctacgcgccctcaccttcaaagggctgcatgtcctcgccttcagagggctacgcgccctcgccttcaaagggctacacgtcctcgcttttagaggactacatgccctcaccttcagaggtctacaccccctcgcctttagaggactacacgtcttccccttcagaggactacacgtcctcgccttcagaggattacacgccttcgccttcagaggaccgcacgccctcgccgtcagaggactacacgtcctcgccttcagaggactgcacgtcctcaccttcagagggctacacgttctcgcctttagaggattacacgccctcgccttcataggattgcacgccctcgccatcataagactacacgtcctccccttcagaggactacacgtcctcgccttcagaggactacacgtcctcgccatcatacgactacac

SEQ ID NO: 60753 - DNA, 773 bp, Glycine max
  Peptide Sequence Number=SeqID_152438
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttgcaggcaagatgatcttcaaggcttccattcgagcttgtcataccattcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60754 - DNA, 675 bp, Glycine max
  Peptide Sequence Number=SeqID_152439
atggccccgaggaaagttgcctcaaagagatccaggaaggataaagcggccgaaggaactagttccggtcccgagtatgatagtcaccgctttaggagcgctgaacaccagcagcgcttcgaggccatcaagggatggtcatttctccgggagcgacgcgtccagctcagggacgatgagtataccgatttccaagaggagataattcgccggcggtgggcatcactagttacccccatggccaagtttgatccagacatagtcctcgaattttatgctaatgcttggcctacggaggaaggcgtgcgagatatgaggtcttgggtaaggggtcagtggatcccgtttgatgcagatgctatcggccagctcctgggatatcctttagtgctggaagagggtcaggagtgtgagtatgaccataggaggaaccggtccgatgggttcgatgaggaggccatcgcccagttgctatgtataccggggcaagattttgcccggactgctgccgggagacgggtgcggatcatgcgcaccaacatgaccaccctgactcagatctggatgactttgctgctcagcaacatccagcccagcgatcataattccaacctccccctgccgaagtgtcagctagtgtatggcacctaccaggcaccctctggacccggataa

SEQ ID NO: 60755 - DNA, 939 bp, Glycine max
  Peptide Sequence Number=SeqID_152440
atggcttccaaaaagagaaagagtattggtacaaggcccacatatcagtatgatacaaggaggttccactcctttgaggcctggacccgatacacaaataatgttctaggaagacatatactgcctaagaggaaggtagaaatataccatactgagctggacgagtttaaggctgaattggagacgtgtaacttccataaatgccttaccaatttagttgacatcagcatagatctagttttggtgaaggagttttatgccaatctttacagccctaaaggaccttcaccaaagcaagtcagggtcagaggccacgtggtgaagattgatgtagacaacctcaacacctttctagagacacctgtggtactagctgagggtgaaaccttacccgcatattccagatattgcaggccaccctgggaagattctcaagtgtggagtgttctctcatactccaacctggctcctacttcccacaccccggacctgacagtagatcgagctaggctaatctttggcctagtttctcatatggacatgaatgtggaagctctcatctctggtcagattacatctatgacccagtctaactcttctagacttgggttccctgctcttatcaccgctttatgtaagtccagaggggttgcttctgacagcctagtctttgaacgcctgagcccggtcattaacttggcatatatcaggaaaaattgttggaaccctgatgatctgacagttactatcagaggggccaggagagtgaggacaaggccagctaaggccctttccacatctacagctcctcctccagcacgtaccctagcagttccttctgcctcagctcctatggtggcagctccagactctattccttccgtagagcaatttaatgagtgggtagcctggcccggaactcaatcttctcttcacagg

SEQ ID NO: 60756 - DNA, 471 bp, Glycine max
  Peptide Sequence Number=SeqID_152441
atgaagcacttcactgacaccctcatcagtgccaacatagtttatgactgggtgtggtggctcacgcctgtaatcccagcactttgggaggccaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60757 - DNA, 441 bp, Glycine max
  Peptide Sequence Number=SeqID_152442
atgaccatgattacgccaagctcgaaattaaccctcactaaagggaacaaaagctggcatcaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60758 - DNA, 1050 bp, Glycine max
  Peptide Sequence Number=SeqID_152443
atgaagatctccattgcccaagccaatgaatacggccgtcgcgtgctgatggcgcaaggcgtgccggaagatatcgcgcgcgacgtggccgagcacctggtggagtccgaccgggtcggctacaccagccacggcctgtccatcctgaccaactaccggcgtgtgctggccgaaggcctggcgcaggccgacggccgccccgaactgctcaacgaccgcggcgccatgctggcctacgacggccacaacggcctgggccagtacgtgggcaaggtcgtgatcgagcaggccatcgaacgcacgcaggcgcacggccagtgcatcctgacgctgcgccgcagccatcacctgggccgcatgggccactacggcgagatggtggcggccaagggcctgatcctgctggccttcaccaacgtgatcaaccgtgcccccacggtggcgcctttcggcggcgcgcgcgcctgcctgacgaccaatccgctgtgctttgccggcccgctgccgggcggccgcccgccgttcatcgtcgacatggcgaccagctcgatcgcggtgaacaaggcgcgcgtgctggcggccaagggcgagcaggcgccaccgggctcgctgatcgacgcgcaaggcaatccgaccacggacccgggcgcgctgttcaccgatccgccgggcgcgctgctgccgttcggcggccacaagggttacgcgatgggcctggtggccgagctgctggcgggcgtgctgtccggcggcggcacgatccagccggaacacccgcgcaacggggtggccacgaacaatatgttcgcgctgctgctggatccgcaggtggacttcaatacggactggcgctcgatggaagtgggcgcgttcatcgactacctgcatgcctgcccgccccagccgggcgtggatggggttcagtacccgggcgagtatgaagcccgcaatcgggagctgaacgcggattcgctggaattttcgccacccatctgggaggggttgaagaagctggccgcggacgttggggtggctgacgcgttgccttga

SEQ ID NO: 60759 - DNA, 1006 bp, Glycine max
  Peptide Sequence Number=SeqID_152444
atgtctctgcgctgggccaagcgcagccgcgaccgtttcgatggcctcggcaacaaaaacgcgctctttggcatcattcagggcagcgtttacgaagatttacgagatatctcggtgaaaggtctggtagagattggctttgatggctacgctgtcggcggtttggctgtcggcgagccgaaggaagacatgcaccgtatcctggagcacgtttgcccgcagatcccggcagataaaccgcgatacctgatgggcgtcgggaaaccggaagacctggtggaaggggtacgtcgcggcatcgatatgtttgactgcgttatgccgacgcgcaacgcgcgtaacggccatctgttcgtgaccgatggcgtagtgaaaatccgcaacgcgaagcataaaagcgatacatcgccgctggatgccgagtgcgattgctatacgtgtcgcaattattcacgtgcttacttgcatcatcttgatcgttgcaacgaaatattgggcgcgcgcctcaataccattcataacctgcgctactatcagcgtttaatggctggtttacgcaaggctatcgaagagggtaaattagagagcttcgtgaccgatttttaccaacgtcaggggcgttccgttcctcctttgaacggcagcccaatgtctctgattctgatgctggtggtgttcggtctgattttttacttcatgatcctgcgcccacagcagaaacgtactaaagagcacaagaatctgatgaactccatcgccaaaggtgatgaagtcctgactaacggcggtctggttggtcgcgtgactaaagtcgcggaaaacggctacatcgctatcgcgctgaacgataccaccgaagtgggaactgccgtgttaaaccgttatcctttgtggaagtacgtgatgctggtcgtcgtgattatcgtcggcctgatttacgcgcttcccaacctgtatggtgaggatccggctgttcaaatcactggcgcgcgcggcgtcgccgcca

SEQ ID NO: 60760 - DNA, 837 bp, Glycine max
  Peptide Sequence Number=SeqID_152445
atgaggtatttccatgtgctatcggaccctcgagtcacgatagcagaattgagactttttcgtggtttcggccgaaagacgctgacatctccaggaagggtatgtccgcatgctactggacccttgggtttgacgacagaattgagacttttttacggtctcggccggaagacgctgaaatctccgggaaaggtgcagatgaccatgttggtctctacgtgctaccagacccttgagtctaacagtagaaacgagactttttcgcggtcccggctggaagacgctgacatctccaggaaaggtgcagatgaccatgttggtctctgcgtgctatccagacctttgagtctaacagtagaaagagactttttcgcggtctcgctgaaagacctgacatctctaggaaaggtaaacgagactttttcgcggtctggaagacctgacatctccgggaaaggtgcagatgagacgttagtctctccatgctgccgaacccttgagtctgatggtagaaacgagactttttcgcggtctcgggaagacgctgacatctccgggaaaggtgcagatgacgactctctgcgtgctaccggacccttgggtctgacggtagaaatgagactttttcgtggtctcggccggaagatgctgacatcttcgggaaaggtggactacgttagtctctgcatgtcaatcaggcttggggtctctgaaagacgggatgcagataaccgtaaggtcacgatagcaaaaggtggggtggtcgacaaaagcggggcttttgcttctacttatcctcaatttatgatgagaaactcagacctacgtagttcttga

SEQ ID NO: 60761 - DNA, 1358 bp, Glycine max
  Peptide Sequence Number=SeqID_152446
tttcaggaaaatatgttgcgttgcaaatttgtgatgacgaagatgttgaaattatgattgaaagttttcaacaacaacaacaaatgtcagttctagaattgtccatagaaaaggatgttgttggtggttctatgtttcattctgcaaactctattacatcatgtggacataatttatctcataatgagtcggaaccaccaagaaatataagcaatttacatgatgatgaagatgatggtggtgattatcttgtgtctaactcacatgttgaagagtctttagatgaagatgatagtgttgatggtatatctgatacagacgatgaagtcacagacatgattcaacaagttaaaattgttcacccaacaaaaggtgtacaaggaattcaaaattcattttggaatgatgctttgcattataacaatatcaattggagtcatccggtcaaggaggacatttgcggtttggagatgccatcgacttttaatgttgggcaagaattatatgttggcatggagacagtaaagatgcgggcaattttgtctaaaaaaaatgattcatggaaagtgacacaatggggtggaccgcacacatgtctgaatacgagtatgacacaagatcatgagaagcttgattcagatttaattgccacttgcatagtagaggcttttaagtattgtaagccaatcatacaagttgatgatggcacacatttatacgggaaataccgtgggaacttgttaatggccacatcacaagatggaaatggtggtgttcttcctctagcattcttcgtggtcgaagcacttggttggcaacctccccacggttatcatgttcattgcgtccgacacatagcaagcaatttcaatcgcaaattcaacaacgcgaaacaaaaagaaatgtttgagaaattggccataacaacatggattgatcgcatttcaaaggaaaaatggagcatggcttatgataaagaaggacgaagatatggtcacatgacaaccgataacagcgttgaacttcgaaaaaatcaagaacaagcttgttcgtacatcgtccgcgtgtatgatatccactcgataaggtttgaagtagaggagaccttcaatcctataacgcaacatggcagacaaaagtgggcagttaacttgaatgaccattattgtcaatgcggaaagtattctgcacttcactatccatgttcacacattattgctgcttgtgcggaaattcctccttctaatgatgcatggacacttatccctgatccaactacaatttgtgcaaaaggtcagccaaaatcaacaaggataaggaatgagatggattggctcgaaccatctgagcaccgataa

SEQ ID NO: 60762 - DNA, 834 bp, Glycine max
  Peptide Sequence Number=SeqID_152447
atggccccaaagaaactccctgctaaaagagctaggaggaccgctacaagagagggatctactacagctccacctatagacatcgagtttgatgggcacaactttcgaaatgctatcaaccaattcttggggcatccattgatcttagaagagggacaacaatgcgaatacattgaaagaataagccaattttcaggttttgatgaagagaccataggtcagctactttgctcccccggacatgattttgcacgaagcgcagcagggaagcgagtgcggatcatgcacattagcatgaccactatgactcaaatctggatgacctttctactcagcaacatccttctgagtgaccacaactctgatctcacactacccaaatgtcagctggtctacaacattatgatgcatattagtgtccacgtggcacaactcatcttaaattccatccatcagttcgtaggcatttcacctcctaagcacccagtggacccagaaaagtccaatagagtgctgggatttcctgcattgattataggtctctgccaattctatggagtaccggtcacgctgacgaagctcatccagcctcccattaataggtcattcatcaaaaaatattgcatgccaaggcaggtacaacagccggggcaagagcaacagcagcagccgatagcaggtgcaccactgccgcctccatatcagccatcatccttggaactccaaatgcacacatacatgcggcatttggcttatcaacaggcagcaaatgctaggggccaaatgcagttaaatgacaacttctaccactatacactgcaccagcatcgctag

SEQ ID NO: 60763 - DNA, 357 bp, Glycine max
  Peptide Sequence Number=SeqID_152448
atggataagagcttaaaggtagaagaagatgagtggagggagaaggagagaagaagcacaaaatttcatgtctcaaatgagataagtggacccaaccttggcccatgggctcagaaatctatcccgaggttcatgagaaccctagggccttcttcagcagctctagcccaatcctcttggagcctcttgctcatgtctctggtgactggtcccttcctagagaggattgcatcatatatgttactaaaatattactatatacatatccatgagaaagctttcggactcccactaatcgaaaacatcaaaagacttaaccaaacacatgtgagcaacaaagttctaaaagctcaatag

SEQ ID NO: 60764 - DNA, 291 bp, Glycine max
  Peptide Sequence Number=SeqID_152449
atgaaaactgattttaaaataagaatgttacggtgtatgtttgcatcaagacactgtagcaacgtgcccttttgcgggcgtgcgaggcgaggctcacgggtgcgctttccaaaggaggaaagatgcgcggagtcgtcactgtcataccctaatttcgtccggggattattattttatgatatacaacctttgattggccgcttcgagatacttggcaccctttggtgcacaatatgtgaagttccgagacgtgccgaaaatcaaaaggaagcaggcttacgcgatccgtga

SEQ ID NO: 60765 - DNA, 573 bp, Glycine max
  Peptide Sequence Number=SeqID_152450
atggcctcccctcccctccacggccttgcggcccttctcctctatcctccttccccctccacaaccgtctacggtcacctccaaatccacacaaggcccgatcttgagcttaagatccttactcaagatctgacactaaagttgctcttaggatcctttcttatgctgttagagactaaagagccaaagaagttcattggaatcccattgcatgcatggtctgaggaatttttcacacagattggttcattctacggtgagttccttcattctaatgaggagactaaaatcaaagaatcccttgaagattgttcgaattgtttactatgcaaaggaaagtcaactgccatggtttctaattctgatgcttcaaaagacaacctacatttggatgggtttgagaaagatgatctaggggctggtgatggtaggagaatagcaatggtgaatgtttactcaccctgctctttggctggtaagaggaagctatggggtgacttggttatgacaaagagaggttttgggatgacattatggtgcattggaggggatttcaacattgtagcaaactag

SEQ ID NO: 60766 - DNA, 453 bp, Glycine max
  Peptide Sequence Number=SeqID_152451
atgcgcggagtcgccatcaacgtttattcgaggaaaacgtcggaaaaaccggaaaggtgtggtctacgaactttaattgtgaaaggttcgaagttgtatttactcgcggggaaggtcaacaaaagcgaggcttttgctcctacgtatcctctattgaagaggaaatcagacctacgtagttctcgcaaaagcgctagcccgcatcaattagactttgcaccttgtgctttaaggtcatacaatgctcaatggaatgccccggggcttctccatgacaagcatacgttgcgttcgagtcgtatcctcagaaaatggaggttgaggaaacctagcaggggctttgtggttgatttagggatggcctttgtggatagctgggtgatgggtaaggagaaggtttgttattggctgagtaatgacattgttgggttggtgggaaacttggtcgtatag

SEQ ID NO: 60767 - DNA, 636 bp, Glycine max
  Peptide Sequence Number=SeqID_152452
atgttatttgttgtgagagagatcatcttgccatctgtgagagaattgaggcctttgggcattgtgaggtgcaaaccctcaaagttttgcaagttaggcactgtatcaaggggagaaatcccttatatttctgataagataccaagattcaatcatagtggttgcttgttgattaataatatacgagagattttgttaataaaatatcaattgacttctttcaaagtgattgatacatcaatagctcaagcaagaaacggaaaggatattcagggaattccatgggagatgttgaacatatcaagggagaggtacaaattgacaaggttagagcaatataggaattttgaggacattcttacatcaggggatgttgtgggcaagaataagaatttgtttcacaaatgttttgatgttcaaaattttacttctttctttccctatcggggtcccaagagtgcaagcaaatggagaagggtggcaattactatgaattcttctatcatagaagaatggttaagcctactgtcgcaacctacccttcgacgggagggcgacgcgagactcaagggtccgtcttccaacaaaagaaacgcgcaggagtcgccaccaacgtttattcgaggaaaatgttag

SEQ ID NO: 60768 - DNA, 201 bp, Glycine max
  Peptide Sequence Number=SeqID_152453
atggcggatggcagaaagccaaaattccgtcataaaaatatggcggatggcatagcagaaaatggcaaacgtcatgagcattgtgtcccgatgtccttcagaacaacattccttaaagcagttcacctagtcatctgcttccccgaacacaaagttcaagatcatcacaggatccaaacacaaacagcaaactgggagtga

SEQ ID NO: 60769 - DNA, 120 bp, Glycine max
  Peptide Sequence Number=SeqID_152454
atggagaaagatgcatcgcacgaagacagtaccactatcactttcagaagacatgtgagtccgcttagaggtggtgtcccaatgagaaattactatgaaattgatgtgtccttgtgttga

SEQ ID NO: 60770 - DNA, 289 bp, Glycine max
  Peptide Sequence Number=SeqID_152455
atgactagaggcaatccatctgacttacaaccctttgatcctaagatagataggacatttcatagattagttggacatcatttagtaccttttgagcatcctgagcattatagttttgaacattctgagaacatgacacaacctccactctgtgagaggactctaagggaaatggttgtacctgatttcacctacgaaagcttgtgcatccaataccctgatgaggatgtcccatatgttcttaaaactggactaatccatttgtttccaaagtttcatggccttgcag

SEQ ID NO: 60771 - DNA, 76 bp, Glycine max
  Peptide Sequence Number=SeqID_152456
atggggctaagctctagcttctttaggaatcttcttaaggaagcttctcaaggaggtgagcttagttatgagaagg

SEQ ID NO: 60772 - DNA, 355 bp, Glycine max
  Peptide Sequence Number=SeqID_152457
atggaaaatgcaaattttattgaggaagttgagtttgggagggaagaaaatataaggaatgttgtttttgaggaagaactttggattgacagtgatcaagtcctcataccaattattgctcaacacacaactctagtaatagaagacaatgttgacgacattgttctagaacaagacaacaatgaggttctccctcaaatacctatagagcaacctcaacaacctacaaaagtatcattaaggagatccattagagatgagaattcaaacactaaaaaatggatggatgccatgaagaatgagatgaagtttatgcaagacaatgacgctttggatctcatcgaattgctagaag

SEQ ID NO: 60773 - DNA, 183 bp, Glycine max
  Peptide Sequence Number=SeqID_152458
atgatagcttccggcgtgaacgtgatgcaagctccattggagcttgtaggcctaggatcttcttcatcaatggattcctttgcttcttggaagatgaatggcagcggaatggagaaagggagagagagagaggagacgccacttcaaggagaagatgagtctagaagaagctcaccaccatag

SEQ ID NO: 60774 - DNA, 591 bp, Glycine max
  Peptide Sequence Number=SeqID_152459
atggaggccatgaaagagcaaatgaccacaatgatggaagccatgaggagtatgagaaaaatgatggagttcaacacggctacagtcattactacatgtactgccactaaggtggacccgactcacccatctggcatcaatcaagcaagtcgtctagtcttgaatatggtaggtcagggaggcgaagcattgggaagtatgggcgaccctcattttgtgcaggtccctcaacccatgggagagacacctgaagtaccccgagaccacactctagccaacttcgagcctcacctcagatatgccactgaggggcaagcatttggtggcataccccagccgaacaccttgggaggacctaagtatcgcccacaaccacaacccttgcattttgcagtgggaagagtccctcctaccatggtggaaaggggaaatttttatcacatagaggaaaggttgagggccattgcaggaggtggagattatgcttttgctgacatggaagagttattccaagtgcctgaaatcgtcatccttccgaagttcaaggtgtcgaatttcgataagtacaagggaactacggggatcctctag

SEQ ID NO: 60775 - DNA, 177 bp, Glycine max
  Peptide Sequence Number=SeqID_152460
atgttgaggagatacatggagaaaaaaatgaagaaacaacaatggaagagaagcttgtggggcttctatggaggctggatctttgagcttcaatggggtcctttaatggtgattttccaccatggagatgaagcggaagacaaaggaaaagaggtgagaggaggcgccatccattaa

SEQ ID NO: 60776 - DNA, 1686 bp, Glycine max
  Peptide Sequence Number=SeqID_152461
atgaccccagcaacagcgaaccctagacctgaacggctgaacctcgccgtctacggcggcggagctgtttgtccgacgtccttaggagacaagccgtcgtcgggtcggaacttgcgctgtggtcgaagtgttcatagattaagaagagtgatggatgaggcagaggaggagcagcaacgtcgtcgtttaaagcttgaagaggcccttgaaatccaatccctcagacgcatcattagtgcttacctcaactatcctgatgccgcagaagaggatgttagaagatatgagaggtcttataggaagcttccaccttcccataaggctttgttatcccactattctcgaaagtttcaaagattacgctggtgtatctcaatgaatacacatttcatattcggcatgcttcaagcatttgaacctccacttgacatgagccaggacgtagattttagtgaagatccacatcctgaatcgacccaaaaagatcatttagtttctgaagggattagtgcttgttcatgtgagtcagtccctgtgagaataacatgttctgtatctgatcaacatcgttgtgtggaaggtggcaatcatacttgcatatcacaagcacaaatgcattccaatgaggaggtggacattgagagttgccaccagtcaaatactgggagccattctccaagcatgatacatcctaaagaaactagtgaatactgtggaagtcctattgctgattccaatggcaatgtaccggtcacgtcatcacaacaacaatggttggatccatctttaaaattgaatgttcctttagttgatgtagataaggtgcgatgtataataaggaacatagttagggactgggcagctgagggtaaaaacgaacgtgatcagtgctacagccctatacttgacgagcttaatatgctattccctaatcgcagtaaagatagtccacctgcatgtttagttcctggtgctggacttggtcggctggccctggagatttcatgtttaggatttatcagtcagggaaatgaattttcatactacatgatgatatgctcgagctttattcttaaccacaattgcaattcattatcagacagtgatcaacttcgtcctgtttcaataccagatatgcatccagccagtgcaggaattactgaaggtttttccatgtgtggaggtgactttgttgaagtttacagtgattcaagccaagttggtgcatgggatgcagttgtaacttgtttctttatcgatacagctcataatattgttgagtacattgaaataatttcaaaaattttgaaagaagggggagtttggataaatttgggacctctactttatcactttgcagatatgtatggacaggatgatgaaatgtccattgaattgagtttggaagatgttaagagggtcgcattacattatggatttgaattagagaaagaaaggactattgagacaacttacaccgcaaattctagatcaatgatgcaaaatcgttacttttctgcattttggacaatgagaaaaaaatctgctgcagtgcagcagcaaaaggttttcatattagaagttcacttggcaaggttagaagcaaagtttgatatttgtggaagaagccaggaagctgttacaatagaatttgtgacaagtgaccaactttcacccagtgtttga

SEQ ID NO: 60777 - DNA, 237 bp, Glycine max
  Peptide Sequence Number=SeqID_152462
atggcagcagcaacacctaatgagacagacgttgatgtgcatcatgttcgacatgcagtggatggttttgtagaaattgctgataagttggagagactattgaacctaaggatcttgacggaaggaacaaaagcctatactgttgctggagaaattctgggcatcacaagaaactacattggccaaccaactgtaggtcacagatcgaggcatatgcagcgtacggatagtcattga

SEQ ID NO: 60778 - DNA, 111 bp, Glycine max
  Peptide Sequence Number=SeqID_152463
atgttttgcgggaaaatgcgagagagtgtggtggcgcggtgtgaaacagaaaacgagtttgtttggagactttggagtgtattatacggaggaggaagtgtgacagagtga

SEQ ID NO: 60779 - DNA, 315 bp, Glycine max
  Peptide Sequence Number=SeqID_152464
atggagaagagattgaagcctccacttatactgtcttcatgcgattcctttttctccctccacgaatattatcttgcaaatcccaatggtaaaagtccaacggttaacgaaaccggtatcatagttttatcgagacagctctgggtttctgcgggaaaagaaaatgctacaatgcgagtgtatttctattatctcagacatgatatcgaaattcccaacggtaggaattctcggaattgggttgtaaacgtggtgctcaaatttcacaacgatccaacggtgaacgagtccgagatcgttgtttttctgagatag

SEQ ID NO: 60780 - DNA, 354 bp, Glycine max
  Peptide Sequence Number=SeqID_152465
atggcggaaccatcaaagaagcgcaaaggttcttcgagtagaagccaacggcactctgaggctcaggatattccaattctttcctccatttcctcttcctcattgttctcatcggaagaacaatgtgcattggacgatgattggaagtttgatttttttgtgcatgatgcccgccgcttggtttgcaccaaccaaacggatatgaccggaaggcttcttgctggttcattggctcttgaaagccgcatccttcactatcttattgttcgtattttacttccaagatcttcaaaccttgcacaggtttctgaagaagatcttatagtcatgtgggcctttcataccaaccgataa

SEQ ID NO: 60781 - DNA, 105 bp, Glycine max
  Peptide Sequence Number=SeqID_152466
atggcggtggtgggaacaatagggaacagcgatgtgagggtgggcacaaaggagtcaatggaaaggagatcgagtgggatgagttcacagcgcgctaggttttag

SEQ ID NO: 60782 - DNA, 651 bp, Glycine max
  Peptide Sequence Number=SeqID_152467
atgataaagaggaacaactatgatttagttggtgtttctagcaagaagatagcaagtggttttggcaatgaggtatataagaatggcacaagaggttggaagtatgagtgttttgaagttgaaagggacaacgattcttatgattcaatagatgatgagagtaatgaaaacagttcagagactgaatcttttcctgctccaaggtatcaaacttttgatatcactaggttgacagatagcactctattccttggtgttgtatctcctgaattgtcaggacccccttttatgtattatgtagtacctctagttaaaagtttggtgaataatgaatgcactgaaaatggtcgacaaccagatgaagatcagactgttatggcaccagatgcagtctcttacttccaagacatgcagagaaggatcaatgcaattgcaaggacagttaagcagttaaatgaaagtcttaaaccaaagaatgaagagaacattcaagcaagcaagcatgttactcaaccagatcaagcaaggccatctatcccagttaccgagattgaagttctgccgaaagacatcatggttgaccagatgcttgagttgtgggaaacagcagataaggatgccacgattggcaagcaagctgaaaagacatag

SEQ ID NO: 60783 - DNA, 222 bp, Glycine max
  Peptide Sequence Number=SeqID_152468
atggcaatgccaaagggaatgttggttttgttggttagcactcttctggtttgctcacttttgggacaacatgccgaagcacgtccagttcaaattgattatggggtaattagacgtgacactatcgttggatgcagcaaaagacatcctgcaaattgcaaactacctagagccaatccatggagaagaggctgcgaggatgaaactcgatgtcgccactga

SEQ ID NO: 60784 - DNA, 192 bp, Glycine max
  Peptide Sequence Number=SeqID_152469
atggggtgtagctcaaaaatctaccctgaggttcatgagaaccctcaggccttcttcaacaactctagcccaatcctcttggagcctcttgctcatggctctggtaattggtcccttcctagggaggattgcatcataagggatgagtttatcgcaattgaggttagaatgaacatgtacaaggatccttag

SEQ ID NO: 60785 - DNA, 204 bp, Glycine max
  Peptide Sequence Number=SeqID_152470
atggacccgaaatctaccctaaggctcatgagaaccttagggccttgtcttgcatctttggttcaatcttcttggagtcttctatccaatgcccttggggggaattggataggaggattaatgccatcagttgaagaatttgagtcaagaagcaagggaccaaccaccttaagagctattggactaagaagcactccaaattga

SEQ ID NO: 60786 - DNA, 1566 bp, Glycine max
  Peptide Sequence Number=SeqID_152471
atgacaggcgccgtcgatgctgcagacgcaaagggagtggctactgatggtagtgagggttcacctgctgctgatggtagtgagggagtggctattgatggtagtgagggttcacctactgctgatggtagagagggagtggctactgatggtagtgagggttcacctgttgttgatgaggaattccctggtgggccacgcgacccatcaattttgactggttttgccaagcacctgacacatagcatttggagtggaaaggaacgacccgagctgaaggtggtctcccattgtagaaaagtctataaatttgggagaccagcgcttgagatagaaagcatgattgcggccaccggattgagtccactgatcaggtgttcggtaatcaccactaatcctggacttatattctccttcgttgagaggtggcatgggaagaccagcaccttccacctgccagtaggagagttgacgatcactctagatgacgtgtcgtcagttctacaccttcccatcactgacgcgctgcataccttcgagccgctggttactttcgacgcagtcatgctgttgacagagctgcttaaggccttatgttcggttgtcttggctccgggaggtgtaccagagcaggtgtcgggccagacgttggattgtagcagcccacgcgtatctcctccacttgggggattctcttggggattggcagcattggtgcacttgtatgaccatctgaatgaagcgtcgcagacccctacatggcagatgagttgttacatgacattatctcaatgctggatatacgagcactttttgatggtgcatcagtgcgtcgttgatgatgcttatgctgaggcaagcccacgtgcctctaggtggcttacgagtaaggctcatatgagggggatcaagggagccccataccaggcacgtatagaagccctgactgtgatggacgtgtgctggatgccctatgcagagcaccggggagttaagggcttcgacctggtctcatcctacacgggccagctaagatggggtcagatagaggccctcgtctacgttcgactagagcgggtgcttcgacagttcggctacattcagactgtccctccgccgcctattcgtgattcgttgatgggtcttgatatagacggtcggtggttgcacttttcagaccatctagtgcccgcaggtgagatctgtgtagttcctggccaggtagcgctagactacatggattggtttttccggatttcccacccgttcgtcacaccgatcgaggacggtgctgagctgagacatctgcctaccccacatgatgaggagttcgtcgagccacctatcccagaggttccagttgcatccgatctccctacacattcaatggttgattgccaaggatgtcaagcgatcgctgaggatttggagcaggtcatcaacctcaggatggtcactgaaggcattgagctatatgacatcatggctcgttgcctcaggatcactagaggtgatgacgtcgcagatggaagtcttaggctgcgacaaagatggtgcatagaatag

SEQ ID NO: 60787 - DNA, 1140 bp, Glycine max
  Peptide Sequence Number=SeqID_152472
atggcctctaggaagaggaaagctaccgcctccagacctatggagccctatgacaccacgagattcatttccaaggagtatgatgagttccgtcgggagcttaagaggtggagttggcataaagccttgaccaggaagcttgacggtcacattgacgtggccttggtcaaggaattttatgctaatctttatgatccgaaggataaatctccgaggcaggtcagagtgcgggggaagcttataaagttcgatgctcagtccctcaacacattcctggagaacctagtgatcttggagcttggggagcaatacaccacccacaccagattttgttactcacgcccaaaccctcaggagggcaccctggaagctgttgaggaaggaccttaccacccttgcccagacatggagtgtgttatcatactccaaccttgccccacctctcacacgtccgattttaacatggatagggcgaggttagtctacgggcttgtgatgaagatggatatggacttgggctcgctcatttctggccagatctctcagatggcccagtctaactcctctcggcttggctttcctgcactcatcacagctttgtgcgtagccagaggagtcatattcgattctctcaccttcgagtccctgagccctgccattaatttggtatacattaggaagaattgctggaactcggatgatcccatgatcacctttctggggacctgcaaagctagggcttggggaccatcagacacttctactccagctccttatgctccaactcctccaccagcaccaccagctcccactcttgccactctaagtatccatgacttggctcagcatcgactgattatgagcatggaggcattcatggcccaggtggcctggtcaggagtccagccttctcctttggggggaggtgaggctcctacagcccaagagccgcagccaaaggtcgagccggaggcatcaccagaggccgaggccactccagaggtcacacctgctgccacaccacttgtggagatcatagaggatgaggatggtgccaaggatacagattatgcagctgacatggtagcggtgcagagcacttgggatccctggcccactacagcacaagagacaccttag

SEQ ID NO: 60788 - DNA, 168 bp, Glycine max
  Peptide Sequence Number=SeqID_152473
atgaaaattctaagttcgggagttgtatttacgtttgaggaaggtattagcacctctcacgtcgacaaaagcggggcttttgctcctacgtaccctccatcaaagaggaaatcagacctacgtagttcttcctttaagcatgaatcaagcgattcttttactagaaag

SEQ ID NO: 60789 - DNA, 213 bp, Glycine max
  Peptide Sequence Number=SeqID_152474
atggttcaactcactaatccaagatcaagtccaagattctccactaagagtgtgcttaggtgtcatgaggcataccatgggtccaaaatctaccctaaggctcatgagaatcctagggccttctcctgcatctttggcccagtcttcttggagtctcctagccatggctctaatgatgggtcccctccttggaaggattgcatcattaactaa

SEQ ID NO: 60790 - DNA, 77 bp, Glycine max
  Peptide Sequence Number=SeqID_152475
atgagcaagaggctccaagaagattgggctagagctgatcaagcttatcgataccgtcgacctcgagggggggcccg

SEQ ID NO: 60791 - DNA, 360 bp, Glycine max
  Peptide Sequence Number=SeqID_152476
atgcgggggtaccgtatggttatccgcacctttcgtcaaccaggggcaaacgagcccgttgacgcgcaaagactagcgtcgtcttttgcaccttttgtcatccagggacagcgagtcaggtggcaggcggagataccttatggtcatccacacctttcgtcaatcgaggcaaacgagttcgacggtttttactctcgtcgtccggagacattcaagcccgacgacgcacaagattcttctccactgggcggcgggcgatcaagttcgatggcgtggggaaatgtcatggttgtcccactttatcgctttcaagacactgaagttttgttgacgcttttgatgccttttctttccttttga

SEQ ID NO: 60792 - DNA, 180 bp, Glycine max
  Peptide Sequence Number=SeqID_152477
atgaagctagacttggtggacttgtccaatatagatgaatgtatccatttgaaagtgtttgaccagcaaggtcgtccttctgggaaggagttcattcattggttaactgatgaagagaaagactcagcccatgttcatgtgttgattaattgtgctgaagttaagtcataccttgagtaa

SEQ ID NO: 60793 - DNA, 321 bp, Glycine max
  Peptide Sequence Number=SeqID_152478
atggccaaattaggaatgtcttcatcaataggcatgttggctacaaccgatgatggggatggtgtggatgtaggtaccaaggacggtccacgtgcatcaagatgggatggagatggtcaaacttcagtcgaaggtggaaatggtgtaggtgtaacatcggaagatctgactggcatagatagaacaaacggggatgggataaatgatggcagactatctttagggtctacttattcaatacctcctattaaatcttccaatcttgaaatattttcaacttcaatgacttcgttgacatgtgacatttcttctacttggtaa

SEQ ID NO: 60794 - DNA, 615 bp, Glycine max
  Peptide Sequence Number=SeqID_152479
atggaagaaaggatcagtggagcagtactcagcagtgccatacctagccacattgatgaattgcatggtatggaccctttatggcctccccatggtgcaccctcacagcttgctggtgatcatctatgtcaccctcttcttgctctactccgaccgtaccaagaggctcaaggtcttcctttggctcttcttagaactcgtcttcatcgccgttctaaccttcgtcacattcactctcatccattccgtcaagaagcgctctgccgtcgtcggaaccatttgcatgctcttcaatgttgccataaactagtcatcacgaccaaaagtgttgaatacatgccgtttttcctctctctagcatcctttgggaatggcgtgtcttggactacttatgctctcatcccttttgatccattcattgctataccaaacgggattgggacaacattttctgtggctcaactaattctgtatgcaacctattacaagtctacgaagaagcaaatagcagcaaggaatgcaaaagaggtgaatctctcagaggtggttgttggtaacagtactgtccaagatcccaacaataacaagatcagtgctgctcccaatggtctttaa

SEQ ID NO: 60795 - DNA, 297 bp, Glycine max
  Peptide Sequence Number=SeqID_152480
atgagattccgtgtgataagtgatgtagctcaatgtagagcttgtaggccttggatctttttcatcaatgaagtcctttgctttttgaagattaatggcagtggaatgaagaaggaggaaagaaatccctacaagagcactgcacccagggtacctttgtatcccaagggcgtgaggatatattcattgttgccattggatgaccaaaacatcctaatcatgttcgcgctgctaaagtcattgtcaccatcaaccattactttggaagatcatgtggctcctagactttatggttga

SEQ ID NO: 60796 - DNA, 412 bp, Glycine max
  Peptide Sequence Number=SeqID_152481
gattaaacggtgtttgatgaatcctcctatgctcgtgccaccagtgcctaaaagacctcttatcctatacattacagtgttagatgagtcgatgggcatgcgagatgaactaatctttgctagagaggacgtgttgtgccttggtgtgggtagctcaccgtttgaggcagtatatgctgagttacactacttggttggtgttcaaaatggatcccgtcaagtacatcttcgaaaagcctgctctcactggaaggatagctcggtggcagaattccctaatgaggatatcatgaccttgtttgaagaggatgtcgaagatgaggacagggataagtggattgtgtggtttgaaggtgcatctagtgcactaggccatgggattggggcaatattggtttccctagataaatga

SEQ ID NO: 60797 - DNA, 423 bp, Glycine max
  Peptide Sequence Number=SeqID_152482
atggctccaaagaagcttcttactaaaagggctaggaaggccaccgcagaggagggatctagtgcagccttgcaagtggagattgagtttgacggacaccattttcgaagtgaggagcatcagcatcgtttcgaagcaatcaagggatggtctttcctcaaagaaagacgggtccaactaagagaaaaggagtacacagagttgcagttcaatgcaaatgcctggcccactgaagaaggagtcatggataagcgctcctgggtgcggggccaatggatcccttatgatgaagatgctatcaaccaattcctagggcatccgttggtcctagaggaggggcagcgttgtgagcacaccgagagaagccaggtctcaagttttgatgaggaggccataggccaactaatgtgctctctgggatag

SEQ ID NO: 60798 - DNA, 261 bp, Glycine max
  Peptide Sequence Number=SeqID_152483
atggcggaattgcgcggcggaaatttgaaaaaacgccaccgaatagaagtggcgtggcgggttgcttatggcggccgccatagccatggcggtcatggcggcattgggctgacccgacccaaccctacccgatattgtaatgcaaaagcgcagcgaggagaaccgacaaggcacagcacagaacacagcagcacgaccagcagcgacaacaccgcacccagcagcaacgaacggcagccgcacgacaccgcaccggcatga

SEQ ID NO: 60799 - DNA, 138 bp, Glycine max
  Peptide Sequence Number=SeqID_152484
atggagggcgtctcctgttacgtcctgaatttcaacatgggcgttcatctggattacattctggttgcacgatgtttgttgcccttgacgattgcccagtttcaaaattcattggcgattgcatatttaaaaaaataa

SEQ ID NO: 60800 - DNA, 567 bp, Glycine max
  Peptide Sequence Number=SeqID_152485
atggaaaggagtatgattgatgctgccagtggtggagctcttggtgatatgacccctgctgaggctaggaacttgatagagaagatgatttccaactcccaacaattaagtgcaagaaatgatgctattgtccttagaggagtccatgaggtggccacaaattcatgttcatctactgaaaataaaaagcttgagggaaagcttgatgctttggtcaacctagtaactcagattgccatgaatcaaaaatctgcatctgcacctattgcaagagtctgtggtctatgttcttcagcaaatcaccatacaaatctttgtccttctttgcaacaatctggagtcaatgagcaacctgaagcttatgctgcaaacatttataaaagaccccctcagcagcaaaaccaacaacagcggaataattatgacctttcaagcaacagatataatctaggttggagaaatcatccaaatctgagatgggcaagtcctccacaacaacaacaacctgaccctcctttccagaaggctggtggtccaagcaagccatatgttcctcctccaatatag

SEQ ID NO: 60801 - DNA, 92 bp, Glycine max
  Peptide Sequence Number=SeqID_152486
ccgaggcgcttccgtaacgcttccgacacgtttctatgggtgatttcgcgaagattttccgctgttcttcgtcgttcttcggtcttcaaccg

SEQ ID NO: 60802 - DNA, 716 bp, Glycine max
  Peptide Sequence Number=SeqID_152487
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtgatttggttgaattggacttggaaattgaagccacttgtagaagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60803 - DNA, 339 bp, Glycine max
  Peptide Sequence Number=SeqID_152488
atgaccacagattcacctccttccttatgtccccatggacccaggcctaactctctaaaaacggtccccagtggagttgtcaactgtcgcaacctatccttcggcgggagggcgacatggggctcacgggtgcgtcttccaggcgaggaaggcgcacggagtcgccaccaacgtttattcgaggaaaacgtcataaaaaccggaacgtgtggtctacgaactttaagtatgaaaggttcaggagttgtttttatgcacggtgaagggtgtttccctcgctcctacgtatcctcaattgcgatgaggaaatcagacctacgtagttctttcgagaactaa

SEQ ID NO: 60804 - DNA, 708 bp, Glycine max
  Peptide Sequence Number=SeqID_152489
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcaggacgacgaaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatggattcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaag

SEQ ID NO: 60805 - DNA, 240 bp, Glycine max
  Peptide Sequence Number=SeqID_152490
atggcacgcagcgtgtctgcttcgtgcccctattcatgggacctatatgggagagagttaaaagggtttttagtgataatccccaaggtggtcatatctctcttgatggtctctagagcctacccttcagcgggaaggcgacgcgtgactcgcgggtgcgtgttccaagaaaggaatacgcgcggagtcgtcaccaacgtttatttgaggaaaaagtcggaaaaaccggaaaagacgtga

SEQ ID NO: 60806 - DNA, 519 bp, Glycine max
  Peptide Sequence Number=SeqID_152491
gttgaccatctacgttatctcggcaacaatctctcttcttgtggttgtgtgatgagaagcacgcacggtattccttgtgcataccaagggttatgtgagacgaaagtcaccatcaaggaagagatagagattgcataccctgatcataactctatgtgccctcctccgtcaaagtatgttgatgcttttcattatgttcaaagtagcaactctccaatgaaacgaagtgcatcatgttctcaaccgcctcagccaacaaggatcatcccgatgttggatcaatttgtgtcattctttcaaggtttcattcgtgacgttgtgaatgtgaaagcggacggtaactgtggatatcggtccattgccgctttattaggtatgggggaagattcgtggccgttagtgcgtaatgaattgattaaagaacttggcaggtggtcgcatgagtacatgaaccttttcggtggcacagagagatttgaacaattaaagttgtccctacttgttgatggcttttcaaag

SEQ ID NO: 60807 - DNA, 258 bp, Glycine max
  Peptide Sequence Number=SeqID_152492
atgggtgcccaggtagcggtccagggtcagcagcgcgatggtgacggtcagaattgggaaagaggcaataatcaggatgttggcgcacagagatgcccaggtaaataccggcatcttgaacatggtcatgccaggggcacgcatcttgataatggtcacgaagaagttgataccggtcagggtggtaccgacaccggagagctgaagcgcccagatccagtagtcaacgccaacgcccggactgtactcaattcctga

SEQ ID NO: 60808 - DNA, 213 bp, Glycine max
  Peptide Sequence Number=SeqID_152493
atgtgctgcaaggcgattaagttgggtaacgccaggggggaatgggagttccaccgcggtggcggccgctctagaattagtggatcccccgggctgcaggatttcaagaagaaaaaagaaggagtggagatgagagtcgtcatcacagaaagggcagaacggacgaaatcagtgtcctatctttgctttcctcttatctccgatgagaggtaa

SEQ ID NO: 60809 - DNA, 498 bp, Glycine max
  Peptide Sequence Number=SeqID_152494
atgggcgtcatcctgaagcgcatgatggtgcgtgcggcgtccaaagtggctgaacgctacggcgtgcaggcgctggtcaccggcgaagcgctgggccaggtctccagccagacgctgaccaacctgcgcctgatcgacaacgtgtctgatacgctgatcctgcgtccgctgatctctcacgataaagaacacatcatcgatctggcgcgcgaaatcggcaccgaagattttgcccgcaccatgccggaatactgcggcgtgatctcaaaaagcccaacggtgaaagcggtgaaggcgaagatcgaagcggaagaagagaacttcgatttcagtattctggaaaaagtggtggcggaagcgtccaacattgatatccgcgagatcgcccagcagaccgagcaggacgtgattgaagtggagaccgtgagcggtttcggcgcgaacgacgcgattctggatatccgctccattgacgagcaggatgacaagccgctgcag

SEQ ID NO: 60810 - DNA, 183 bp, Glycine max
  Peptide Sequence Number=SeqID_152495
atgggtgcttattttatgccaatcttagttctgaaatttaaattgaaaattagtgtgaaaacaagtgccaaaactagagggaattggaaaggaggattggtgccatcccttgaagaatttgagtcaagaagcaaggggccaactaccttaagagctattggactaagaagcactccaaattga

SEQ ID NO: 60811 - DNA, 645 bp, Glycine max
  Peptide Sequence Number=SeqID_152496
ttggctctccaagttgaagttatcgatgaggaggacttcgaagctccagaggaagatgaagaagtccgagctctaaaattagagttagggaaggcaagactcgccaaggagaagttcaagtcagctgatacacacatccggaaagagtgcactgagttacaagaggaaaacgcggccactgcaaaagcccgtgaacaagaaaccaaaagggcccgcaaggaggaatatgcccgagagaaattccgaggagcattgtggggtagtaacaatgagctcaagctccgaagagaggagagagatcggtcacgggtgcatggcatgatcttaaaagaggagttagttgcttgcgcgaggtccaaaaggagtttggctcaacacttggaagccacggagcaaagcatgttagctatcatagggcaatacaaggaagaattgaaccagtccatggcccatgaacaaaagctagtggaggattttgcacaagtgtatgccgaaaaagaagcaagagggagggtgattgatgcattgcatcaagaagcgactatttggatggataggttcgccttgaccttgaatggaagtcaagacctcccgcgtctattagccaaagcaaaagccatggccgaggaatttcatcataactaa

SEQ ID NO: 60812 - DNA, 93 bp, Glycine max
  Peptide Sequence Number=SeqID_152497
atggggcatgccacattgctccccttctcttgcaattcatgtccaaacatgcgctcaccaagtgctcggtacaacataggagattcaaaatag

SEQ ID NO: 60813 - DNA, 375 bp, Glycine max
  Peptide Sequence Number=SeqID_152498
atggcttacgaacggggcggagatttcctggaagatgccaggaagatacttaacagggaagtgagagggccgcggcaaaaccgtttttccttacgctccgcccccctgacaagcatcacgaaatctgacgctcaaatcagtggtggcgaaacccgacaggactataaagataccaggcgtttccccctggaggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 60814 - DNA, 244 bp, Glycine max
  Peptide Sequence Number=SeqID_152499
agggctacaccctggcaccttcatagggctacaacgggccctcgccgggctacacgccctcgcctccagaggactacacgtcctcggccttccggggcctgcacgtcctaccttagagggtgcccgtccctgcctttatagggctacatgccctcacctcaggagagatggctacacaaagcccctcggaccttcggagaaggctccacagtgccctggtttcagcctggttcagaggctctga

SEQ ID NO: 60815 - DNA, 291 bp, Glycine max
  Peptide Sequence Number=SeqID_152500
atgactccacctaaagaaatatcgattgtcattcgtcaccatggtcaaattgcagacaatccgattccgggactgatgtactcatacacatttatttcagcacaactacacgacaatgacgatctcagaggcatgctggaaacaattgtccaaaatctagaattgaattatattgaattatatgttgttactaaacttattcatcaccacaaccaccgtctctacaactacaactaccgtctccacaactacaactaccgtctccacaacaattattgtacaacaacctag

SEQ ID NO: 60816 - DNA, 243 bp, Glycine max
  Peptide Sequence Number=SeqID_152501
atggcacaacctccacctcgtgagaggcctctaagggaaatggctgcacctaatttcacttatgaaagcttgtgcatccaataccctgatgaggatgtcccatattttcatggccttgcaagtgaagactcacacaaacatctgaaagaattccatattgcctgctccaccatgaaacccccagatgtccaagaggatcacatatttctaaaggtctttcctcattcttcagagcttaactaa

SEQ ID NO: 60817 - DNA, 202 bp, Glycine max
  Peptide Sequence Number=SeqID_152502
ggctgcctggtatcaacagggacaccaggacttatttattctgcgaagtgatcttccttcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 60818 - DNA, 456 bp, Glycine max
  Peptide Sequence Number=SeqID_152503
atgagatatcggagttttgatttgcaccagcttttatctcactttagtaagcatgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggaattagggcggttgattgggtcccgtttaaggatgttttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggtgcgaaaagagtagcgcacggatcatctgttgctacccgccactctgtgtttggttg

SEQ ID NO: 60819 - DNA, 144 bp, Glycine max
  Peptide Sequence Number=SeqID_152504
tgaaaaacctcgtcgggcgcctaggagtacatgacaggacatgcctcacaaaggttaagtcagacttacagaagcactcaaatcggatgacccccaaggcctacactccgaagagtccatcagggcctctccctcctgattcag

SEQ ID NO: 60820 - DNA, 312 bp, Glycine max
  Peptide Sequence Number=SeqID_152505
atggtgaaagttggaacctcttacgtgccgatcaacgtctcattttcgccaaaagttggcccagggcttcccggtatcaacagggacaccaggatttatttattctgcgaagtgtctgtccgtcatcagcgtcacgctgcgtacaattccacacaacatacagccggaagcataatgcgccgctcaggggcgtcccttcgccaattcaggctgacgctaactgcacattgggaaggttgcgatcggtgcgggcctcacttgcgctattacgccagctcgggaaacgggggatgtgctgcaaggctgcattaa

SEQ ID NO: 60821 - DNA, 278 bp, Glycine max
  Peptide Sequence Number=SeqID_152506
ctgctgcaattcttcaagaggcagcgaggaagagctgcgggacgtccatggagctgatccgaagtattgcttgatggtgacaccggctccagcaacacagacacgtccaagccttgccttagtaggatcaacgtggaacactggtctgtcagcaccaggtggtctggtagacaaggatcgtagacgtgaggcttttcgtgtccgcttcacggcagacggtgaagctgatgcgtttgaaggaagaggaggaggaggaagaggaggaggaggcgaggcag

SEQ ID NO: 60822 - DNA, 327 bp, Glycine max
  Peptide Sequence Number=SeqID_152507
atgcaaatagatattttctttgttgttgctcctaacctacaggtggttgtcatcatcaaaaagggggagaatgtaaatcatgaagattttgatgatatcaagaagaatttgcttgagaaagggggagatgtaaatcatgcaagctttgatggtgtcgagaagaaatcacatgtttgtcatcatcaaaaagggggagaatgtgaatattcactaaagaccaagtcttgccttaaaacaaagtgctttcaagacatgcaaggctctggtaatcgattaccaggaagtgtaatcgattaccagaagacagggttgagaaatagctgttga

SEQ ID NO: 60823 - DNA, 372 bp, Glycine max
  Peptide Sequence Number=SeqID_152508
atgccttcagtgtgcaggacacatctggacggtcaaaccatcccaatcagtgtccctggtcctggacccatgtgcttgactaacttcaaagcaggggacgtctcctgcactcctgtattagcaaaaagagtccgcaaccgacaccaggtgcagcagataagccgtagctgcgacaatccaccgccgggcctgacatctggtctcataaatgtcagcgaacccatcctaatcgtacatatgctcccatgtgagtgctgtctcggctctggcctcttcggcagacacttccagcaactccgtaagcaagaatctggcctcctccgtagaaagagcgtggaaactgtgcaaggcgccagtgatgggcaaatgtag

SEQ ID NO: 60824 - DNA, 197 bp, Glycine max
  Peptide Sequence Number=SeqID_152509
gtccccagtggagtcgccaactatcgcaacgtgcccttcacgggcgagcgagggcgaggctcatgggtgcgctttccaaaggaggaaagatgcgcggagtcgccaccaacgtcgacaaaagcgggacttttgctcctacgtaccctccatcaaagaggaaatcagacctacgtagttctttctcatgcgtgaatcaa

SEQ ID NO: 60825 - DNA, 231 bp, Glycine max
  Peptide Sequence Number=SeqID_152510
atggagattgaggaaaccaagcaggggttatggctaccattgaattatcgagtagatacgagagcaagtttagcatatgacactgaaatttggggtgaatcctacaggctttttgctacaaaattcctttttggctttgtggttgatttagggatggcctttgtggataattgggtggtggggaaggagaagttacatcctatccgaagacattatactgacactgcctaa

SEQ ID NO: 60826 - DNA, 435 bp, Glycine max
  Peptide Sequence Number=SeqID_152511
atggcgcccttcacatgtgcatgtggcaaatataataaggaagttgtgcttaggtataggattgaggtgatgatcaaccacagagatgaaagcacaaaattcctgctttgggaccgtgaatgcactgaattgattggtcaattagctgatgcagttaataggcttaaaattgaagatggtgatgttgatttaaatgcttcacccgaagcacttgataagttgttgggttatgtacttgcttttaagataaaggtgcaacccaagttcaggaattctgttgttttgaaatgttcaactgactcaagcttaataaatgttgtgatggatatactagttgatgttgagacatcttcaaaaatcaatatcccagcctttgattccaatcattctaccgaacatgaatctacgagtttaatcatgaccctcatcttttaa

SEQ ID NO: 60827 - DNA, 186 bp, Glycine max
  Peptide Sequence Number=SeqID_152512
atgagaccagtcaggcttaaaggagcactcaaacccggtgaccccagccataccttaaagcagttccctagtcagggctctctcccccgacaaagttcaagatccaaccccaggatccataacacaacagaactgggcagtgagttatacaatacccacgattcctcaactaatagagaatcttaa

SEQ ID NO: 60828 - DNA, 147 bp, Glycine max
  Peptide Sequence Number=SeqID_152513
atgtcgcggaacttcacggattgcttaacgatggcgctaggcaatcaattcatggggctccgaataagatttgatggtggaggatgcacgaacaacgctaggcaatcaattcgtggggctccggactcgatggtggaggatgcatga

SEQ ID NO: 60829 - DNA, 222 bp, Glycine max
  Peptide Sequence Number=SeqID_152514
atggcatgtccattggcatgtgttccaaaggatccctcatgtacctccaccaacatttgctcagcctctctggcatccacacatcgaagcagtaccacgtcatggttcctcttgtataggatattcccactcaggaagaaaccagtctccaacttcacaacgttcttttgtcgttatcagaggcctcttgcgggtattccttatcctcgatgtatcgtttga

SEQ ID NO: 60830 - DNA, 207 bp, Glycine max
  Peptide Sequence Number=SeqID_152515
atgctggcaaatgagtgcgagagagaagatgcaggctgtagatgcaattgcctttggtgttttgatgatgatcataatgatatgatgcaattgatgcaaatgggcttttcaagattaaattcaagacaatacttcaagattacaagtcacaacatcaagatgatcactagtatattaggaagggaattcctaattgaattagcaaag

SEQ ID NO: 60831 - DNA, 227 bp, Glycine max
  Peptide Sequence Number=SeqID_152516
tggcgtctcctctctctcttccctttctccattccgctgccattcatcttcccaagaaagcaaaggaatccattgatgaagaagatcctaggcctacaagctccaatggagcttgcatcaggatgtaccctcccttgttctctttgaacaacctagtggatgtaccctccactagaactgatccacaagagatgtaccctctcttgttctcagtcacacccaagtag

SEQ ID NO: 60832 - DNA, 585 bp, Glycine max
  Peptide Sequence Number=SeqID_152517
atgcatgctttgttagggtcattcaatagtggaaactggtctgactctaaagtccttgatagtacagggctaagtttttgtactatcacgaggaatcgggatagtttctacacatgttcatattcacatttatctttacacactagacacttatttgctgaaatagcttaccaaataacacaagttccccgagagttcgatactcggttcttaccattttatactacttgtgcgatccgatgcacttgccgaaagtcgaacaagtttttggcaccgttgtcgggaaacttctttttatttgggaaatctcccataggcaatttagttcctttggacttagaaattgaggctacattgcaaaggaacagggccgagaggagaaggaaacttctgcaagatagaacagttgcatccattcttgaggaggagactcgtttctctgacttattatcacctgatttaccatcatcaagggaatctgccactcaattacctgaagtcattaccatggcagaagagcatgaccagaggattacccttgaggagttcagtaccacaatttttcaccagcattgcacgtcctga

SEQ ID NO: 60833 - DNA, 321 bp, Glycine max
  Peptide Sequence Number=SeqID_152518
atgtcctcacttttagaggactacacgtcctcaccttcagaggactgcatgtcctcactttcagaggaccacacgtcctcaccttcagaggactacataccttcagaggactacacgtcctcaccttcagagaaatgcatgtcctcactttcagaggactacacgtcctcaccttcagaggactacacgtcctcaccttcaaagggctgcacgccctcgccttcagaggactacacgtcctccacttcagaggactacacatcctcgccttcagagggctacgcgctcttgcctttagtgggctccatatccgcaccttaa

SEQ ID NO: 60834 - DNA, 366 bp, Glycine max
  Peptide Sequence Number=SeqID_152519
atgaagtacttccctgaatcgaagactgtagaaggcaaagctgccatctcttctttccaccagtttccagatgaatccttgattgagacacttgaaagattcagagagctcatgaatctggatgttatatccctaatgaagagcaaattacacatgaggttaattatatggggtataagcctagaggcaatctcaatacaagtggatttccaggatttcagaacaactagtagtatcaacaacaaagacagtggcaaaatcaccctagtaaccaattcaacagagatcagggtggttcatctacaaggccacaacagcagatgccaagtctctatgactgaaccgcgaagctggaagagactctag

SEQ ID NO: 60835 - DNA, 313 bp, Glycine max
  Peptide Sequence Number=SeqID_152520
atgatcgaaagttttcaacaacaacaaatgtcagttctagaattgtacgtagaaaaggatgttgctggtggttcgatgtttcatgctgcaaattttgttatgtcatgtggacgtaatgtatctcatcatgagtcggaactgtcaagaaatataagcaatttacatgatgatgatgatgatgatgattatcttgcatctaactcatacgttgaagagtctttcgatgaagatgatagtgatgatggaatatctgatacagacaatgaagtcactgacatcgttgaaccagtttcaattgttcacccaaccgaag

SEQ ID NO: 60836 - DNA, 606 bp, Glycine max
  Peptide Sequence Number=SeqID_152521
atgcaacaatctgaagcaattgaacatcctgaagcttatgctgcaaacatctacaacagacctcctcaacctcaacagcaaaatcagccacaacagaataattatgacctctccaacaacaggtacaaccctgggtggaggaatcatcctaaccttagatggtcgagtccttcacaacagcagcaacaacaacaaccttatttccagaatgttgctggcccaagcagaccatacgttcctccaccaatccaacagcaacaacagccccagaaacagcaaacagttgaggcccctccacaaccttcccttgaagaacttgtgaggcaaatgactatgcaaaacatgcagtttcaacaagagaccagaacctccattcagagcttaactaatcagatgggacaattggctacaaagttaaatcaacaacagtcccagaattttgatagattaccttctcaatctatccagaatcccaaaaatgtgagtgccattacattgaggtctggaaagcaatgtcaagaacctcaaccaacaacatcttcctcatctgcaaatgaacctacccaacctcactctactccaaaaaaagatgatgacaaaatttaa

SEQ ID NO: 60837 - DNA, 234 bp, Glycine max
  Peptide Sequence Number=SeqID_152522
atgagggggagtgaacacccggccactacgggttacgccactgaggccgatgatgttggtcaccttggccgacaaggagtcaacttcggttgcaactctttctccaaaagcgggaggggtatgcttccacggaacggccttattgctttaatattcaaacggcgtcagcttgggcgctgtgcgggggtacatgggcatggagctggtccctttcctagtgaaacatattactag

SEQ ID NO: 60838 - DNA, 783 bp, Glycine max
  Peptide Sequence Number=SeqID_152523
atgccgaccacgatgctcagcgctgcgccggaggcgaaaggattgaccaggcacagtatcccgcccgccagcagcaggaaggcgatgatcaaaagggtgaccgtccgggggtttttgactgacccggcgcaaatgttacactgtgcggctgacgcgtatcagaaccgaaacgacgactggggacaggatttgagcacaggaagcaaactggcagggtggcgccgtgtggcggtgtgtttggcattggggctgctgttggccgggtgttcgggcaaaaacacctataaccgcgactatgacaaactgccgaagggcagttattctggcaaaacctataccgtcaaacggggcgatacgctgtactacatcgcctggatcaccgacagcgaagtcagcgagctggccagaatcaacaaaattcgtccgccttatagcctcgaggtggggcagaaactgcggctgagcggcagcgcgccggccaaaaccgccgctacgcgccgtaaaaagtcgtcttccgccgcaatcgtcaaacaaacgccgccgccgggcgcttcccgctgctggcgctggccgaccagcggtcggatcgtgcaggcgtactccaattccgacggcggcaacaagggcatcgatatcgccggcaagcgcggccagccgatctacgcttccgccaagggcaaagtggtgtacgtcggcaatcagctgcgcggctacggcaatctgatcatgattaagcacggtgaggacttcattaccgcctatgcgcacaacgacaccacgctg

SEQ ID NO: 60839 - DNA, 228 bp, Glycine max
  Peptide Sequence Number=SeqID_152524
atggctctgaaaaagctttccgcgaagatatctaggagggacgccgtagctgaagggaccagtgctgtccccgagtttgatagccaccgtttcaggagcgccgagcaccagcagcgcttcgaggccatcaaaggatggttgttccacagagagatacgcgtccagctcagggacgatgagtacacggaatttcaggaagagatagctcgccaacattggacgtcgttg

SEQ ID NO: 60840 - DNA, 219 bp, Glycine max
  Peptide Sequence Number=SeqID_152525
aggatccccgatgtggttgcgcaccttgcggcgatcggccagcgtgccttcgcagcggccgtgttccaggcgggtgatgcgcggtgcgatgctggcgaagtagggcgccttgaagcagaccgcgcgcgagaacagccagttgccggcgggccagcgctgcaggcggtggtagagcgaaagcaggggcgtggacatgagcggtttccggtcggcggatag

SEQ ID NO: 60841 - DNA, 307 bp, Glycine max
  Peptide Sequence Number=SeqID_152526
atggagaaatctgaaaagaaaaactttaatgaaaagaaggcaaagagggcctacattacatgggatgataatgatatggactcatatgaaaattcaaaaaatgaagtggttagcttgagtctaatggccaaaatttatgaaaacaatgaagaggtatccttgaagaagagatggtacatagatagcgaatgctcaaaacatatgatgggagatgcatcaaaattcactcatatctctcccaagaaaagcggacatgtgacttatggcgacaacaataaaggtagaattcttggagttggaaaaatag

SEQ ID NO: 60842 - DNA, 342 bp, Glycine max
  Peptide Sequence Number=SeqID_152527
atggcggatagatcatcaagcagttttacagctaatacagagaaaaatcccaaggaggagtgtaaagctgtgatgactagaagcaaaatggcaatccatctggcacctaagccagcacttgaacccgattctgattttgtagaacttgaagaaattaatgaggaggctaaaaatgataaggaagaagagacaccaataaaagagaaagaaaaagaaaaagaaaaagaaaaagaaaaaaagttgaaaaatgaaaaacaaaaacagaaagttattgattttgagatgaggagaggcaagagtgaggcaagcactgaaaaagaagaaggatactactccaaatga

SEQ ID NO: 60843 - DNA, 354 bp, Glycine max
  Peptide Sequence Number=SeqID_152528
atggccgagaaaacaaagaaaaaactagaggaagttgctcagtccggaagcactgagggcatcaataaccctccatctaccatcagacgacatgtgaagtggaagatggcccacaccaagaaaactaggcagataacgtctgaggccgcaaaggaaatcgctgaaaagattgcgtcacagggtttgtttgtcccccatagacgtcaggatgtcctgactactgccattgggcgaccagaacaccctggccgtatgcgtgctgctggagccggtgtcaccatcaagcaatacttcggatcggctccacgaagctcccgcagttcctcctccatccctcccgaagaactcgagtag

SEQ ID NO: 60844 - DNA, 366 bp, Glycine max
  Peptide Sequence Number=SeqID_152529
atgcccaccacggaaactttgggtcgttcaacaacttgccagtttcctaattggaaatcaggaaggcacggttgtacccagtttgaatggtcttggggggcttcgtcgtgtatcatgggcgctgatgtaagctccattggagcttgtaggcctaggatcttcttaatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaggggagagggagagaagagcacgaaattttgtgctctaaatga

SEQ ID NO: 60845 - DNA, 447 bp, Glycine max
  Peptide Sequence Number=SeqID_152530
atgtaccaactgccaaatgtcaaagacagtaatgataaacctgtcatggccacaccctttaaaacaaaagatgtcaatgaagaggtcacctcaaaagacatcaaaagcctaatggagcaagctaattacaccaacaaatatcttcaagtattaggagaatccattagtagagaaaaggttagtgaaaaggcaaaacaaaaaattagggaacttaggaagcataaatcccttacagagggtataggtgataaaaatagtgaattattaagcaagattgatagtttacttaaagtcatccctaaaacacctcaaccttcgaaagaatcatccaaaatgagaaccagaaacacctccaaactaatcaatgttattaatgatgacagtgaccaaaacttagaacaaacaactgaagagggttcagtatctggaaaggatattaatccatag

SEQ ID NO: 60846 - DNA, 81 bp, Glycine max
  Peptide Sequence Number=SeqID_152531
atggtggtgaatgacaaccgatatttctttatatggagccatgggtggtttttaagggaacgtgagcaggaaggctggtga

SEQ ID NO: 60847 - DNA, 228 bp, Glycine max
  Peptide Sequence Number=SeqID_152532
atggcagaaatcaaccaaggtaagatgatgactgctcacgattggtcgcatatcatcttggctcttactcgcaggtacatagggacggatgcaagtagggttagggtcacgaccgaccgatcgttgccccttcccggcgctaaacaagcagagaacgtcgctgcaaggcagcccagtatcctttgtgttcgcagtttcttttactatttgtttgttttaaatgagtaa

SEQ ID NO: 60848 - DNA, 345 bp, Glycine max
  Peptide Sequence Number=SeqID_152533
atggagtcaggtgacatgtgggggtatcgtatggttacccgcacctttcgtcaaccaagggcaaacgagcctgttgacgcgcagagactaacatcgtcttctgtaccttttgtcatccagggacagcgagtcaagtggcagacggagataccttatggtcatctgcacctttcgtcaactgaggggaacgaattcgacagtttttactctcgtcgtccagagacattcaagcccgacgacgcactagattcttctctgctgggcggggacgatcaagttcgatggcgtagggaagtgtcgtggttgtcccactttatcgctttcaagacactgaagttttgttga

SEQ ID NO: 60849 - DNA, 243 bp, Glycine max
  Peptide Sequence Number=SeqID_152534
atgaaaagaatacgaatttggggatcccacggtcatgtggctccgcatgccaccggactcttgggtcacgggaaggagagtatgctgatgaaattttctcataaccatgagattttggatgttagtatttcatttccaaacgaccatttagaggaaacactgggtccaacaaaaatagaagaaaatcactcaaagtgtatcaacctcacacagtgtgaggtgaccagtcaggggatcctctag

SEQ ID NO: 60850 - DNA, 303 bp, Glycine max
  Peptide Sequence Number=SeqID_152535
atgtcaaagggacagcctcctatattcaatgcagactcgccagctgttctgcactcttgtggggataagctcatccctttcattcataatcattgtgaggcctgtcttcttaggaaccacttggactggactcacgttcagcctcctatattcaatgcagactcgctagctgttctgcactcttgtggggataagctcgtccctttcattcttaatcattgtgaggcctgtcttcttaggaaccacttggactggactcacccactagctatcagaaatggggtagatgattccagcttgtaa

SEQ ID NO: 60851 - DNA, 162 bp, Glycine max
  Peptide Sequence Number=SeqID_152536
atggagacaacaaacaaaggccacttgatcaacaaccccaacaattggaagttggaagttggaagtagttattggaagttgaaagttaaaaatggaagttggaagttggaagtggaagttactggaagttggaagttggaaatgaaagttattggaagttga

SEQ ID NO: 60852 - DNA, 423 bp, Glycine max
  Peptide Sequence Number=SeqID_152537
atgaaggaagacattggtcacatcttagacctcactcccataggagagaaaaggaaagaaagcctcaagaggctaacattaacctccgatacttccatgggaaggacaatgaagtctacttcaaaatcttatggctctcactcttatccaaagaaagaccaaggtcaaggcatattaggggtgacaccttctaagcccaaagatgataaggggaagacaatagaaaagcaaccccttaaggctagtatgcaagagaagactagctctatgaagtgctttaaatttcttggaagaggacacattacttctcaatgtcccaccaagaaaaccatgattatgaggggccaagacaattatagtagccaagatgaggctactacttcaccttcctctcgtgaaagtgaagaagcaaaagggaaataa

SEQ ID NO: 60853 - DNA, 340 bp, Glycine max
  Peptide Sequence Number=SeqID_152538
gctgccgtctcttgtgacggacgcgtggggtgctaataccttccccgtgcgtaaatacaactcccgaacctttcacttaaagttcgtagatcacgcacccgcgagtcacgcgtcgccctcccgccgaagggtagctagtcatggaggggctagcgtgaacgccaccgaagaggatgggccatcacgggcaaagagtttaggagaggtagctacttccagacgcttcatctaccaatcgatgcaagtggcgtgtatggtctcccgtggcggaggcgagagggacaagtgtttgttttcacctcgggggagtcgcacgacatggaaacctgtcccgcgatag

SEQ ID NO: 60854 - DNA, 603 bp, Glycine max
  Peptide Sequence Number=SeqID_152539
atgagcgcatacaaccgccgccgctttttgcagcacagtggttccatggtcctgctgggcgccacgtcggggatggccgcattgccccgcgccgcgttcgcgcaggacgccaccgtgaaactcggcctgctgcattccctgtccggcaccatcgccatcgccgaggcgtcgctggtggacgccgagaaactggccatcgaggagatcaacgccgcgggcggcgtgatgggccgcaagatcgagccggtggtcgaggacggcgccagcgagaacgccgtgttcgccgagaaggcccgcaagctgctggaccgcgacaaggtggcggccatcgtcggctgctacacctcggcctcgcgcaaggcgctgctgccggtgctggcgcgcagcaagggcctgctttactacccgacctactacgaagggcaggagcaggacgcgcgcgtgttctatccgtcgcaggaagccacgcagtcggtgatcgcggcggtcgagtggatggcgcgcgagaagggcaagaccttcttcctggtgggctcggactacatctatccgcgcacctgcaacaagatcgcgaagccggccatcacgcacatgggcgccaag

SEQ ID NO: 60855 - DNA, 168 bp, Glycine max
  Peptide Sequence Number=SeqID_152540
atgcctctagttgcttggatagctgtagaagcaaagcttcatgatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 60856 - DNA, 324 bp, Glycine max
  Peptide Sequence Number=SeqID_152541
atggtgaaagttggaaccttttacgtgccgatcaacgtctcattttcgccaaaagttggcccagggcttcccggtatcaacagggacaccaggagtgctccagtggcttctgtttctatcagcagtccatcccgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 60857 - DNA, 615 bp, Glycine max
  Peptide Sequence Number=SeqID_152542
atgactggaaggcttcttgacggttcattggcttttgagagtcgcatccttcattatctcattgtgtgtatcttgcttccaagatcttcaaaccttgcacaggtttttgaagaagatcttattgttatgtgggcttttcataaaggccggcaaattgattgggcacacttagttcgatatcgcatgcataaggcattgcgattaaatgctccattgccatatccacacctagccaccctcttccttcaacacttcaacattcctcttgattctgaatcttatgttccaatcaagagatcctttctaataggcaccgctgtgattgcatcctttcgttaccgtaaagagtatgatggctcttgggtgaaaaagggtgctcaacccattgatgaagaaagacatttacatggtggagaagattcctctcttcttcaaaagattttggataggttcgatggtattcaaacctttgttggtgaaaggtttgatactttggagttacaagtggacatgcgattcaatgagatggagtcaaggatcaccaacatcgaagaagatgtttcttacattcgtacaagctttgatctaccaccaccaccgccaccatcatcttag

SEQ ID NO: 60858 - DNA, 424 bp, Glycine max
  Peptide Sequence Number=SeqID_152543
atgggatgccaccgtgttcggggtctttaatccagatttccccctctacataaagcacaaagacctctccgaaatcgcacacggtggccaagtaaaggcaattcacaccttccttgcttggccgacacatctggcagctgtgtctccagcaaaaccacctcaaaagcccgatccggaggtcgacgatctgctttatctgatgacattgaccatcccagagcttttcttgagaccttatcaggttacatgggatgccaccgtgttcggggtctttaatccagacttcccgctctacataaagcatgaagacctctcagaaatcgcacacgcatctcacttaaacatgtctgcgagtggggaattcttatatgtatggattcctcgagccacagtccattcagaggtctgggcaatcgcaatttga

SEQ ID NO: 60859 - DNA, 282 bp, Glycine max
  Peptide Sequence Number=SeqID_152544
atggaaagggagattatcacaatgatagtagacacgttactggtgttctactatgagaagatggtgggttacacgccttcaagctttgccgatttagtttttgctggcaaatttaatcatcctgctttgataaataagaagcctgaggaaaatggagagaataagaagaagggaggaacccatgttgtgactgtcgttcatatatggccaaatttcccaccagctcaacaatgtcactactctgccaatatcagcccttctcattatccaccaccctattag

SEQ ID NO: 60860 - DNA, 405 bp, Glycine max
  Peptide Sequence Number=SeqID_152545
atgacaagaaaaagaaaggaattgctcttaaagcatcatcctcaattcaagaagaaaattcaaaagtttcttaaagtaagaggaaatcaaaggcgacccaattttaaatcaaaaagaaggacagaaacttcatcctctactttaaaatgctttgaatgtaatcaacctggacatctgagggttgattgtcccatcttcaagaaaaagatggagaaatctgaaaagaaaaatcttagtgaaaagaaactgaagaaaacatacatcacatgggatgaaaatgatatggaatcttctgaagattcagaaaatgaagagataaatctctgccttatggctaaaagttacgaaagtgatgaagagaagaggacatggcatatcaacttgctacttcaagaaaaattatag

SEQ ID NO: 60861 - DNA, 318 bp, Glycine max
  Peptide Sequence Number=SeqID_152546
atgggcccagttttgccagactcacagagacccttcttgcaaaaactcctggctgagaagaacaagaagaagctggaggaagctgcacagtcaggaagtgttgatggcatcatcaaccctccatcccccgtcagacaccacgatccctttgaggagcaggcgacacagggatccttcatccctcatggacgtcaggatgttctcaccactactattggacgtccagagcaccctggacgtgtccgtgctgcaagagccaaggtcaccatcaagcaatacttcagatcggctgatcgaggccgtgcccgaatcaattaa

SEQ ID NO: 60862 - DNA, 240 bp, Glycine max
  Peptide Sequence Number=SeqID_152547
atggacttcaggaaggttagttccaggtttagcaaaggcataatcttcgcctccaatttcaatggccctgagcctttccatcaattagattcctttgcaccttacgcttcagagcccaatgctcaggaacgccccggggctcttcccaccgcaaaatgcaatgcgttcagtcggttgtgggcgaaatggaggttgatgaaccctaaagggttatggaaacaccaattgaattacaattag

SEQ ID NO: 60863 - DNA, 740 bp, Glycine max
  Peptide Sequence Number=SeqID_152548
atggggacaaatcaaatcggaaaaagattctatcaagtcaagattaagggcctagatgtcaccacccttaaggagcagggacggttgatgggacccccccaaaggcaagcctttcgcaaagtgtacggaaagattttagatttgatcacagcggaggtatttacagaagccgttgtatccctcacccaatactatgaccgagccgttgagatgcttcacgatgccctcttgggggaagaaaactgtatctttgtcgtccgggttggtcttccctccttgagcaagattgcaactgtggtcgagagattcggcgagagagttggatcgtatgaaaaactcgaaacggcgatagtgggcctactgcggaaatacttggttgggataggcaaggcaagggcatatggcgaatcaagaggggtaccccatgagaaggagagcccgatggaagagagcctctcgcctttccttgtgagagattttggcgcgcaaagtctcaagattgtacaaagagtccacaaggcatggaaaagcccgttaaggaaagataaagaacttaggggcatctgcaatggcatcatcggtgattggctctccaagttgaaaattatcaacgaggagaacttcgaagctccggaagaggatgaagaagtccaagctctaaaatccgagctaggaaaggcaagactcgccaaagaaaaattcaagtcagccgctacaaacatccggaaagagtgtgccga

SEQ ID NO: 60864 - DNA, 462 bp, Glycine max
  Peptide Sequence Number=SeqID_152549
atgaccatgattacgccaagctcgaaattaaccctcactaaagggaacaaaagctggtaccgggccccccctcgagtattgttcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60865 - DNA, 250 bp, Glycine max
  Peptide Sequence Number=SeqID_152550
gtatcatcccctttgaagaacatattgtagcagtagggactactagcaacaataggttttcaaagagaaaagctctagatgaggtggagtcgccaactgtcgcaacctacccttcggcgggagggcgacgcgtgactcgcaggatgcgtgttccacgaaaggagtacgcgcggagtcgccaccaacgtttatttgaggaaaacgtcggaaaaaccggaaaggacgcaatctacgaacttttaagtgaaag

SEQ ID NO: 60866 - DNA, 442 bp, Glycine max
  Peptide Sequence Number=SeqID_152551
agtcaaacaccgtggaagggaaagctgcaatcttttcatttttcatcagttccctgacgagtccttgagtgaagcgttggatagatgggctaagaccacaaaccaagcaaatgttagatgcttcagcaaggggaaaaataaagctgaagcccctgaagaggcaactgagctaattaagaatatgtcagccagcgatcatgccattctgcatgatagagttcatcaacccacaaagaaaaacttgttacaggttgtatcatctgtggtgaggctcatgaaacaggccaatgtattcccattgaagaaaacactcaagaagttcactatatgggaaatcaacaaagacaaagatatactcaaggaggattttcaggcttccagcagggtccttataactatcaaggatagtggagatcacaccctggcaatcaattcatcatga

SEQ ID NO: 60867 - DNA, 462 bp, Glycine max
  Peptide Sequence Number=SeqID_152552
atgggaaatcaacagcgacaagggtacactcaaggaggattttcaggcttccagcagggtccctataatcaacaaggacagtggaggacacaccctggcaaccagttcaacaaagaccagagtgggccttcaaataggccaatccaacaaaggcctaacatattccaaaggaatactaaactggaggagaccttgactcagtttatgcaggtaacaatgtcaaatcataaaagcactgagtcagcattgaagaaccttgaggtccagatgggacaactggccaagcagatagctgacaagtcatccaatagttttgtggcaaatacaaaacaaaatcccaaggaggaatgcaaagctattatgacaaggagtaaaaggtttgtggaggctaaggatgaggatagtgttgtccataagaagaatactgctgacaagaaaggtactgatggcaagaaaaatgag

SEQ ID NO: 60868 - DNA, 231 bp, Glycine max
  Peptide Sequence Number=SeqID_152553
atgtacaaagataattggacccaaccttggcccatgggctcagaaatctaccctgaggttcatgagaaccctagggccttctttcgcagctctagcccaatcctcttggagcctcttgctcatggatctagtgactggtcccttcctagggaggattgcatcaggatacattgctcttcagatgagaacagcgtggaggacgaaatggatggtggaattggagtatcctga

SEQ ID NO: 60869 - DNA, 219 bp, Glycine max
  Peptide Sequence Number=SeqID_152554
atgggaaaatgccagtttcggccgaaacaaaacgtccgttgcgctcgcacgaaaaaacctagccgacctggggctatttcacgaccgatgtcggtgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 60870 - DNA, 321 bp, Glycine max
  Peptide Sequence Number=SeqID_152555
atggcctctgtagtcctacagggtgcccgttccccctggcaaggatcgcgcccgcaagacacccagtggacccgaagaagtccaacagggtcttggagtttccaagctctaattacgggcctctatcagttctacggagtgcttgtcgcccccagcaagatcatcaggccccctactaatcgagttttcatcaagaagtactgcgtccccaggcagttgcagggcgaaacaccacagcagcctagggatggccggcagtggacaatagacgcaccgccatcacctctagagttcacctcagctcatccacaaaaaggttag

SEQ ID NO: 60871 - DNA, 447 bp, Glycine max
  Peptide Sequence Number=SeqID_152556
atggtgaaagttggaacctcttacgtgccgatcaacgtctcattttcgccaaaagttggcgaggcctgccgggcggagcccccagcgccgagcggcttccgggcgaatcacacagggacactgcccggatcaagcttattcgatatccgtcgacctcgaggtgggcaaaggcgtcggtgctctggcgttcatggttctatcagctgtccttcctgttcagctactgaaattggggtggtatccgcgtccaattcgcacacaagcataccgagccggaagcatcagcgcggcaagtgtagcggtgctaagacgctgacgcgtacactcacaccgcttaatgctgcgctacagggcgcgtccctttccagtcgggaaacctgcggcaactgtaatgaggccaacgcgcggggatcgagtgcgggcctcttcgctattcgctggcgctaa

SEQ ID NO: 60872 - DNA, 771 bp, Glycine max
  Peptide Sequence Number=SeqID_152557
atggcagagcgcctcgcgctacatgaattcacggaaaatgcctacctgaactactccatgtacgtcatcatggacagggcattaccgtttattggcgatggcttaaagccggttcagcgccgcattgtctatgcaatgtccgagctgggcctgaacgccagcgccaagttcaaaaaatccgcccgcaccgtcggcgacgtgttgggtaaatatcacccgcacggcgacagcgcctgctatgaagcgatggtgctgatggcgcagccgttctcttaccgctacccgctggtagacgggcaggggaactggggcgcgccggacgatccgaaatccttcgcggcgatgcgttacaccgaatcccgcctgtcgaaatacgccgaactgctgctcagcgaactgggtcagggcaccgtcgattgggtgccgaactttgacggtacgctgcaggagccaaaaatgctgccggcgcgtctgccgaacatcctgctgaacggcaccaccggcattgcggtcggtatggctaccgatattccgccgcacaacctgcgtgaagtggcgcaggcggcgattacgctgctggaaaaaccgaaaaccacgctcgatgagttgctggatatcgtgcaggggccggactacccgaccgaagcggaaatcattaccccgcgcgcggaaattcgcaaaatctaccagaacggccgcggttcggtgcgcatgcgcgccgtgtggacgaaagaagacggcgcggtggtgattagcgcgctgccgcatcag

SEQ ID NO: 60873 - DNA, 405 bp, Glycine max
  Peptide Sequence Number=SeqID_152558
atggcgccaaccaccctacctcgtctcctccgtgtcatggtgccacctgaacaattgagtcccatcaccatgcgcacctttgcatcctcaactccccgatgccacaagattcgaacgcgcttctcaagttttattcaagacaagaatccaagatatccaagaaattcaagagatatgatcaagataatttctagagtcttaggaagaaaattccaagttgaaacaacaaaagatttggccaaaggatttaacttaaaatgtttttttaagagttttacttgtcaaacttgtaaaaggtttttacaagatagtgaaattctcaagcgggttgcttggggactggacataggcacaagggtattggcttttatggttgagaacttcaaagaagatgaagaaggttaa

SEQ ID NO: 60874 - DNA, 258 bp, Glycine max
  Peptide Sequence Number=SeqID_152559
atggcggaaccatcgaaaaagcggaaaggaacttcgagtcggagtcagcggcattccggtgaaggtgtgccttttgagggtgcactaattgatgaatggaaattcgatttctctgtgcatgatgcccgccggttggtttgcaccaaccaagcggatatgaccggaaggcttcttgccggttcattggcttttgaaagccgcatcctccattaccttataattcgcattttgcttcctagatcttcaaaccttgcctag

SEQ ID NO: 60875 - DNA, 330 bp, Glycine max
  Peptide Sequence Number=SeqID_152560
atggcacctccagactctattcttttagtagagcagtttaatgagatggtagcctggcccgggaaccaaccttctcttcatagggaagacaaaggtcccacagcccaggtacctgctgccactcctgagcgatccattgaggctacttcagagccttctacaccagtggtaaacctaccttcacctcagcctgcagcagacccctccactcctcttctacagatgccagaggacccgactacaccagtcctagctgtggacacttctcctccaactactccagtgcttcagctgacagatgaggaggatgatcagacacaggacacctag

SEQ ID NO: 60876 - DNA, 563 bp, Glycine max
  Peptide Sequence Number=SeqID_152561
gtaaagacgagtgggcctcgttcatagatattctcgcactgttgatcttcggaggagtcctctttccgaatgtggatgggttggtggacctagcagcgatcgacgcttttctcgcttatcataatcacaaggaaagcccggttgtcgctatgctagctaacctatatgacaccttcgaccgaagatgtgagaagagcagtacgaggattgtttgctgtactccagctctttatgtatggttagtttcgcacctttttcgccaagaggtgaggcatgcttgcccgctagaaagccaccgttcatgcacagagaaaggaggggcaaattgggaccaactcttagcaagcaaagaaggagcatctgtcaactggttccctcgatggaaggaaggaagaaccggagttcttatttcatgcggaggatttccaaatgttcccttgatgggggcgaggggttgcatcagctacaatcccgttcttgctataaggcaacttggctacctgatgacaggggcaccactagaggaagagctcgcacctgccatttcacgagggtttagttag

SEQ ID NO: 60877 - DNA, 222 bp, Glycine max
  Peptide Sequence Number=SeqID_152562
gtttacccgtgcatggatccttagattcataggaggtgttctatttgttgacaaaagtagcagcaaagtatcgctaagagagatgtgcagcgccaccgattacaaaataaaatcgatcggaggtatgtgcatcttaatccaaatgtgggcatgggaacgatgcacgactttggctccaaataggactcctcctgtaatagaaaataaaacactcggacatag

SEQ ID NO: 60878 - DNA, 357 bp, Glycine max
  Peptide Sequence Number=SeqID_152563
atggcgtgctcagttttgaattgtgcacagctcatggggtcgtcctactcatcctcaaacctctcttgcctaccatatttgaggtctgggatgattcattttcttgaggccagatggggcatcgggttcaccttagcgacagcgctagtagcggcaactataaccgcattggcttccattatcttcttcatgctcatcatggcctccatcattgtggccatttgctctttcatggcctccatgtcggccttcatcttctcttgcacctcctctgcttcagcccattactctagctctagcacgagttcggcaaccattaggtccttccaagtatggactcggaaggttccaagttag

SEQ ID NO: 60879 - DNA, 820 bp, Glycine max
  Peptide Sequence Number=SeqID_152564
atgatgggaactgttacctctcacaagttacaaagcctttctccggagaattcattgtctctttttgtcaaatgggcatttaaagaaggcgaagaggaaaaacatcctcattttgtaaacatcgggaaagaaattgtgaacaaatgcaaaggggttccattggctgtgagaacattggggagtttactattttccaaatttgaggcaaatgagtgggaatatgtgagagacaatgaaatttggaatttgccacaaaaaaaagatgacattttagctgtacttaaattaagttatgatttcttgccttcctatttgaggcaatgttttgcattattttcgctttacccaaaggattatgaatttcgtagtgttgaggtagctaggctttgggaggcacttggtgtccttgcaccacctagaaagaatgagacaccggaagatgttgtcaaacagtatctggatgaattactgtcaagatctttccttcaagattttattgatggtggcactatttgtcaatttaaaattcatgatttggtgcatgatcttgcgctgtttgttgcagaagatgagtgtctactcctaaactcccacattcaaaatattcctgagaatatttggcatctatcttttgctgaatacaattttcttgaaaattcattcacctcaaaatcggtagctgtgagaaccataatgttttcaaatggtgcagaagtagccaacgttgaagctttgttaaatacttgtgtgtcaaagttcaaatttttgcgagttctagatttaagggattcaacatgcaagacattgccacgttccattg

SEQ ID NO: 60880 - DNA, 192 bp, Glycine max
  Peptide Sequence Number=SeqID_152565
atgtctcagtatatcagtgttatagttgtggattctgtatgcaagcggggaattccgatatctatggattcctcgagccacagtccattcagaggtctgggcaatcacaatttgagtctgaaacggacactggcagatggtggtcatcctgcccaaggaacacctagttgtttggttttgttcattgcatag

SEQ ID NO: 60881 - DNA, 453 bp, Glycine max
  Peptide Sequence Number=SeqID_152566
atgtggatggatcggtttgctcttaccttgaacgggagtcaagaacttccccgcttgttagccaaggccaaggcgatggcggacacctactccgcccccgaagagattcatgggcttctcggctattggaaaaacaccataactaaacgcgccacaaggcatccctatcgcaccagatccaaatctagaacggtgggtgatcaagaggagacacaggaacagatgaaagccgacatgtcggctctaaaagaacaaatggcctccatgatggaggccatgttaggaatgaggcagctcatggagaaaaacgcggccaccgctgccgctgtcagttcggctgccgaagcagacccaactctcttggcaactgcgcaccatcctccctcaaacatagtaggacggggaagggacacattggggcacgatggcaaccctcacctgggatacaactga

SEQ ID NO: 60882 - DNA, 1119 bp, Glycine max
  Peptide Sequence Number=SeqID_152567
atggctaatttctttattcagcggccggttttcgcctgggtacttgccatcattttaatgattgccggcgggctggccattctcaaacttcccgtcgcccagtatccgaccattgcgcctcctgcggtggcgatatccgcaacctacccgggcgctgatgcccaaacggtgcaggataccgtgacccaggttatcgaacagaacatgaacggtatcgataacctgatgtatatgtcttccaccagcgactcggcaggtaacgtcacgatcaccctcaccttcgagtcagggaccgatccggacatcgcccaggtgcaggttcagaacaaactgcagctcgccatgccgctgctgccgcaagaggtaaagcaacaagggattggcgttgagaagtccagcagcagcttcctgctggtcgcaggttttgtttcagataacaaacatctcacgcaggatgacatctccgactatgtcgcctcaaacgtcaaagatgccatcagccgaacgtctggcgtcggcgacgttcagctgtttggtgcccagtatgcgatgcgcatctggctcgacagcaatgcgatgaacaaatatcagctgacgccgctggatattatcaaccagctgaaaacgcagaatgaccagatagcggcaggccagttgggtggaacgccgtccattcccgggcagcagctgaacgcctcgatcatcgcacaaacccgcctgaaatcgccggaagagtttggccgggtcacgctcaaagtgaatcaggatggctcaatggtgcatctgaaagatgtggctcgcattgagctgggcggcgaaaactacaacatggtgaccaaaatcaacgggcaggcggcaaccggcctggggattaagctggcgaccggggcaaatgcgctgaacacggcggcagccatcaagagcaaactggcgcaactgcagcagttcttcccgcaggggctgaaggttttctacccctatgacaccacaccttttgtgaaaatctccattcacgaagtggtgaagaccctgtttgaagcgattattctcgtcttcctggtcatgtacctgttcctgcaaaacctgcgggcgacgctcatcccgactatcgcggttccg

SEQ ID NO: 60883 - DNA, 809 bp, Glycine max
  Peptide Sequence Number=SeqID_152568
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggctggaaaggtcacacataggttttatgtgttggacacaaaactaatggcagccacactaaataagatccacaaggacatgcttgtgatatgtatttctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60884 - DNA, 96 bp, Glycine max
  Peptide Sequence Number=SeqID_152569
atgaagtcgttgagaggaaaggagatcgcgttggtgaaggtgcagtggggaaccgatgaagaagtaggaatagtgggggcaagatatgcgggttag

SEQ ID NO: 60885 - DNA, 241 bp, Glycine max
  Peptide Sequence Number=SeqID_152570
gcccacttgggccctccagaatattcctccagaaggctgttgcttctggaggaagcaacctggctcgcctgggcgagctgggcggcaaccacctcccctattttgctataaataggggtggaagtgaagaagaaaaggccgaggcgcttccgaatcatttccgtaacgttttccgtgaagaatttcgcgaaggtttcgaccgttcttcgacgttcttcattcgttcttcgatcttcaacgg

SEQ ID NO: 60886 - DNA, 240 bp, Glycine max
  Peptide Sequence Number=SeqID_152571
atgttttgcaagaatgctccaaccatatgggatcaacataggcttaaaggagtactcaaatcgggtgacccccaaggcctacactccgaagagtccgttaggggacttaacatcaactcgtcacccttaaagggacttaacattaactcattgcccaaaaagggacttaacgttaactcgtcacccttaaagggacttagcattaactcatcgcccttaaagggacatatagtcgtgtga

SEQ ID NO: 60887 - DNA, 462 bp, Glycine max
  Peptide Sequence Number=SeqID_152572
atgctaaacatccaaaatctcatttgtggttatgagaaaatttcatcagcagattctccttccccgatagacacattgttttttgtccgaaaagcatatgttgatctgattagttggaagttttatctctttactaaagcacgttcgcattttagcgaagaaaacactgggactatttctagtctcacaagttatccagaactacgtaggtctgagttcctcattggaggatacgtaggagcaagagcctcgcttttgtcgaccacaccaccttttgttgccatgacccaagagctggtaacccgcggagacaccttacagttatccgcacctcgtcgttcagtgaccccaagtgtgattgatgagcagaggccaatgtggtcatctgcgccctttccggagatgtcagcatcttccggtggagactttttcaagtctcacaagttatctagaactacgtag

SEQ ID NO: 60888 - DNA, 444 bp, Glycine max
  Peptide Sequence Number=SeqID_152573
gatgtgccacttggtcgatcccatcttcgtgcttggcgatcaggatttcttctgccccgatgcctccccgcttcttcttcgtcagcctccgcagaaaatgtgttggaattgggccatgatattgctgtgaaggggtcattgtgggccatgaaaaatgagcttgtgtttccgcaacaccaccgaacgattgctggcttgcataagtatcagtgtgatgaccctgaaaaggatattgatacatctgggtcggatactcaacaaatgtttgtggcgtgtgatacattccatggccacgctccgccatttgttgggaatattcttccgcttcaacagtgtcccttcttctgtctatcccctgagtttcaatacttgactgaagcatgtgaaactgttgtgcaggaaattgacgctctgatgcgggaccatgtgacactggctcagtga

SEQ ID NO: 60889 - DNA, 318 bp, Glycine max
  Peptide Sequence Number=SeqID_152574
gcggaatttgaaatccctgaagcttctaacagtaggacaaagaagaaaattcttcaaactgtcggcgagtgctggaggcagtttaaatctgacttgactaggaaatgggcacttgcagccgacaaggacggtgtggacgacattgtctgtgaaaaatacggcattagcaatgagaaatggacccagttttgtcagacccgcaaagactccttatgggagctcatgggtgagaagacaaagaaaagactggaagaagctgcccagtccggaagcactgagggcgtcattgaccctccactcccattagatgccacgtga

SEQ ID NO: 60890 - DNA, 271 bp, Glycine max
  Peptide Sequence Number=SeqID_152575
ggtcacgctgcgcgtaaccaccacacccgccgcgcttattgcgccgctacagggcgcgtcccattcgccattcaggctgcgcaactgtagggaagggcgatcggtgcgggcctctttgctattacgccagctggcgaaagggggatgtgctgcaaggcgattaagttggggcgaattggagctccaccgcggtggcggccgctctagaactagtggatcccccgggctgcaggaattcgatccattctcaccctttttcggagccccatga

SEQ ID NO: 60891 - DNA, 573 bp, Glycine max
  Peptide Sequence Number=SeqID_152576
atggagagaagtatgatagatgctgccagtggtggagcccttggagacatgactcctgctgaagccagaaatttaattgagaagatggcctccaactctcagcagtttagcgccagaaatgatgccatagtcattagaggagtgcatgaggtagctacaaacccatctgcatcatttgaaactaagaagcttgaaggcaaactggatgcattggttaacttggtaacccagctggccttgaatcagaaatctgtacctgtcgcaagggtttgtggtttgtgctcctctactgaccaccatacagacctttgcccttccatgcagcaacctggagcaattaagcagcctgaagcttatgctgcaaatatttacaatagacctcctctacctcagcagcataatcaaccacagcagaacaattatgacctttccagcaacagatacaaccctggatggaggaatcaccctaacctcagatggtccagccctcagcaacaacagcagcctgctccttccttccaaaatgctgctggcccaagcagaccatacattcctccaccaatccaacaatag

SEQ ID NO: 60892 - DNA, 585 bp, Glycine max
  Peptide Sequence Number=SeqID_152577
gtggacccttgggtactagtacctatcttcttcagagggctacatgtcctcaccatcagaggactacacgtcctcaccttcagagagccgcacgccctcgccttcagaggactacacgtcttcaactttagaggactacaagtcctcgtcgtcaaagggtcatataccttcacctttgtagggctacacgccctcaccttcagaggactacacgtcctcgcctttagaggactacacgtcctcgccatcagggactacatgtcccccattttcaaagggcgacacgccctcacctttagaggactgcacgtcctcgccatcataggactacactccctcgccttcaaaaggcggcacgtcctgaacttcagagggctgcacaccctcgcctttagagggccacgtgtcctcattttcagggccagtagtttccttttatcagttcccgggtcaccccctgatattggaggggatcgcgcccacaagacgcccagtgggcccgaagaagtccaacagggcccttgggtttccaactctggttacgggcctctgtcaatcctacagggtgctcgttcccccagcgag

SEQ ID NO: 60893 - DNA, 219 bp, Glycine max
  Peptide Sequence Number=SeqID_152578
atggaaaagatcggaggaaaacagagtaattctcgatcaatgaaagaaagggaatggaaaatcttcagaccagataaattttcggcaaggtcgttctcgactggcgatatcccaccccgcatgaacaaagaggaaaagaccgaaacacccagcttcctctccaaaaacactaccctcgagaaaatcctattgatccgtgatcgtacgtgtgatctctga

SEQ ID NO: 60894 - DNA, 441 bp, Glycine max
  Peptide Sequence Number=SeqID_152579
atgtggtgcacttgccggaagccgaacaagatttttgcttcattgtcagggaacttctttttatttgggaaatctcccacaggaaatttagttcctctagacttagaaattgaggctacattgcgaaggaacagagccgagaggagatggaaaattctgcaagacagaacagttgcatccattcttgaggaagagactcatttctctgacttattatcacctgattcaccatcatcaagggaatttgccactcaattacctgaagtcattaccatggcagaagagcataaccagaggattacccttgaggattactcaagtagttcagtaccacaatttttcacccgcattgcacgtcctgaagtgcaagctaacaacatcaactaccccacattccttaattcatttaatacaggggaacttatttcaaggattacctaa

SEQ ID NO: 60895 - DNA, 345 bp, Glycine max
  Peptide Sequence Number=SeqID_152580
atgaaaagagaaaaacatgtctcctatagtagtcatgactcttgcaaaagtttaagtgaagaacttagcgactattatagagggagtcatagttcacatactaaacatcactcccaaagaagagaaaaggataaaaggcctcaagaggttaacattagcctcccatatttccatggaaaagataatgttgaggcctacttagattgggaaatgaaggttgaacaactctttgcttgccatcatattagcgaagagagaaaagatccattggctttcaagggtatgccctctattggtggacttcccttgttagggaacgaaggattcatggggatcctccagtag

SEQ ID NO: 60896 - DNA, 583 bp, Glycine max
  Peptide Sequence Number=SeqID_152581
atgattggcctgattggcggcatgagctgggaatccaccgcgctctattaccgcatcatcaatgaacaggtaaagcagcagctgggcggactgcactcggcgcgcagcctgatgtacagcgtcgattttcagcagattgagaaattgcaggtcgccggtgaatggcagcaggccggtgaaatcctggccgaagccggccgtagcctggagaagggcggggcggatttcattgtgctgtgcaccaacaccatgcacaaagtcgccgatcagatcaccgcggccacccgcattccgctgctacacatcgccgacgccacggcacaacgcattcgtcaggccggcgtgaaacgcgtcggtctgctggcgaccgcgttcaccatggagcaggaattctataaagggcgccttgagcagcaatatgacattgaggtgctggtaccggacgctaccggacgtaaaacggtgcacgacattatttatcaggagctgtgccttggcgtgatccgtgaagagtcacgcgcgcaatatcgtgacatcatcgctcagctggtggcacaaggggctgaagccattatccttggct

SEQ ID NO: 60897 - DNA, 197 bp, Glycine max
  Peptide Sequence Number=SeqID_152582
acttatcaaggtagtccttgtggagtctgtccagacttatcttccttcaccggaagtggcgtctaccctgacttatcttccttcactagaagtggcgtctacccagacttatcgtccttcaccggaagtggtgtctaccctgacttatcttccttcactggaagtggcgtcatccaaatcttcatagcctgtatcaa

SEQ ID NO: 60898 - DNA, 461 bp, Glycine max
  Peptide Sequence Number=SeqID_152583
atgggggcaaatcaaaacagcaaaaggttttatcaagtcaaggttaaaggtctagatgtcactagcctcaaggaattgggacgattgatgggacccctccaaaggcaagccttccgcaaagtttacgggaagattctagatttgaccatagcggaggtatttatggaagctattgtatccctcacccaatactatgaccagtcgttgaggtgtttcacgttaggggactttcaaatggtgccaactattgaagagtttgaagagatattaggatgccctctcgagggggagaaaaccgtatcttttctccggtttcttccttccttgagcaagattgcagctgtgattggagattcagcaaaagagttggatcgcatgaagcaaattccggaacggcgtatgggcctgcctcagaaatacttgatgcaagcagggatatggcgagccagagagtggggccc

SEQ ID NO: 60899 - DNA, 377 bp, Glycine max
  Peptide Sequence Number=SeqID_152584
atgcctatactcctatgccctcctatggtatgcctagtgcatgttttgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 60900 - DNA, 712 bp, Glycine max
  Peptide Sequence Number=SeqID_152585
tgacggtgtaccatttgaaggtacactgaatgacgattggaaattcgatttctctgcacatgatgcccgccagttggtttgctccaaccatgcagatatgactggacgccttcttgccggttcattagcttttgaaagccgcatccttcattatctcattgtgcgtattttgcttccacgatcttccaaccttgcccaggtttctgtggaagatcttgttatcatgtgggcctttcataccgggcgtcaacttgactgggcacacttagtcagatatcgcatgcataaggcattgcgattaaatgctccattgccatatccacaccttgtcactctctttcttcgccattttcaaattcctcttgattctgaaccttatgttccaatcaagagatcctttttaattggtgctgctgcgattgcttcttttggttaccgcaaagagcatgatggctcttgggtcaaaaagggtgctcaacccgctgatgatgaagggaacctaccagttgaagataattcctctcttcttcgaaggcttttggacaagtttgatggtcttcagacttttgttggtgacaagtttgatgccatggaattgcaagtcgacatgcggttcgatgccatggaattaaggatcaccaaagttaaagaagatgtctctttcatccgtacttgctttgatccaccaccaccgcctccatcatcctcttag

SEQ ID NO: 60901 - DNA, 865 bp, Glycine max
  Peptide Sequence Number=SeqID_152586
atggtactggcgcaaagcctgttcaagcagctcaagatcgaacaaccggattgccagattacggttgcagcccccgcatggacactccccttgctggaaagaatgcccgaggtgtcacacgcgattgcactgccttttaagcatggcgacctggcattacgtgaacgcttcaagcttggccgcgaactggctaaacaaggctttactcaggccattttactcaccaacagcctgaaatccgccatactgccttgggccgccagaattccagtgcgcacaggcttcaaaggcgaaatgcgttatggcctggtgaatgacatgcggcccttggacaagtcctcactcaagcaaaccgtgcagcgatttatcgccttgggcttacccaggcatgcaacgctccctgagtcactgccacaaccaagcttgttggcaaatgctgctgatgctcactcgcttttgcgaaagtttgatttacctagccgcggcatggtattgggcctctgccctggcgcagaatacggtgaagccaaacgctggccgacggaatattatgccgaagttgccaatgcggcgctcagccaaggctggcaagtctggttgtttggctctgaaaaagaccagccggtcacggctaatattcagcagcagacgcagcagcgctgcgtgaacctggctggaaaaacgaaacttggcgaagccatagacctcatgtcactgtgccacaccgtgatcagcaacgattccggcttaatgcacgtcgcggcagcactggataaaaagctgatcgcgatttacggctcatctgaccccaaacacaccccgcccatgcatccgcaagccgtgattgaatacttggggcttacat

SEQ ID NO: 60902 - DNA, 809 bp, Glycine max
  Peptide Sequence Number=SeqID_152587
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacagactttcaggctggattggatgtgaatggtgtatatgctgacagattcaaatctgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60903 - DNA, 219 bp, Glycine max
  Peptide Sequence Number=SeqID_152588
atggtgaaagttggaacctcttacgtgccgatcaacgtctcattttcgccaaaagttggccgagcagttggcttcccggtatcaacagggagcaccaggaattgttcctttattctgtcttcctgttcagctactgacggggtggttatccgcgtaattcggcaaaagcataccagccggaagcatcagcgcaagtgtagccgggcacgctgcgcgtaa

SEQ ID NO: 60904 - DNA, 818 bp, Glycine max
  Peptide Sequence Number=SeqID_152589
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcttaactgcagactatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60905 - DNA, 303 bp, Glycine max
  Peptide Sequence Number=SeqID_152590
atgatcggccctctcgatgagtcaatctcttactttttcataagggtgaacccttgggtacacgccctcgccttcagaggactacacgtcctcaccttcagaggactgcatgtcctcactttcagaggactacacgtcctcacctttagaggactacatgtcctcgctgttagaggactacacgtcctcgctgtcagaggactacacgtcctcgctgtcagaggactacacgtcctcgctttcagaggactacacgtcctcaccttcagaggactgcacgtcctcaccttcagaggactgcac

SEQ ID NO: 60906 - DNA, 369 bp, Glycine max
  Peptide Sequence Number=SeqID_152591
atgaaaagagaaaaacatgcctcctatagtagtcataactcttgcaagaggctaagtgaagaacttcgtgactattacgaagggaggcataggtcacatcttagacctcactcccatagaagagaaaaggaaaaagaaagcctcaagaggctaacattaacctctcatacttccatgggaaggaaaataggacacattacttctcaatgccccaccacaaaaaccatgattatgaggggccaagaaatttatagtgccaagatgaggctactacttcaccttcctctagtgaaagtgaaaaagcaaaaggggaagaatctattgaagaaatctacccccgaagaagaaggacaaccattaatggtttaa

SEQ ID NO: 60907 - DNA, 192 bp, Glycine max
  Peptide Sequence Number=SeqID_152592
atgtcaatgaaaaatctcgtcaggcgccaaggactacatgacaagccaaaccacacactagtaagtcaggtcactctcactaggtttaaaggagcactcaaatcgggtgtatttacccccaagacttacactccgaagagtccgtcaggacctctctctcctgattcaggtccaacccagaaaacattttag

SEQ ID NO: 60908 - DNA, 540 bp, Glycine max
  Peptide Sequence Number=SeqID_152593
atgggatcaagtcaaaagccttcgcttaaaaagaggttctatcaagtcaaaatcaagagcttagaggtcaccagtttacgaaagttagggcaattaatgggtcaacttcaacggcaagccttccacaaagcctgtggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccggaaggaaggaagaatcaggattctatcttcatgcgaaggatgtcccatgagaggagtgccatcagacgaaagcatcacgcctttcatcgcacgagatttcagtgaccacaacgcgagggtactccaaggagttcgcaaggcatgggatgcggcgtga

SEQ ID NO: 60909 - DNA, 408 bp, Glycine max
  Peptide Sequence Number=SeqID_152594
atggccttcgcgccagcacgtgttgcgcctttcgtgatgcaacgtcttcaggtaccggttcaggtactgctctatgccgggttgtttgtctgcgctgaatatctggttaattggctacatctcccgcttcctgccaatcttgtcggcatgttgatgctgctgatgcttatcgtctgccgggtgataccgctaaactgggtgcgtgcaggcgcgcgctggctactggcggagatgctgctgtttttcgtcccggcggtggttgccgtcgttaactatgcgcaactgctgatgatagacggctggcgcatcttcctcgtcatcgggctaagcaccaccatggtactgggcgccacggcctgggtagtggataaggtctatcgctacgaagtgagcaggtttgaaagatga

SEQ ID NO: 60910 - DNA, 650 bp, Glycine max
  Peptide Sequence Number=SeqID_152595
atgggtgatcaagaggagacacaggaacagatgaaagccgacatgtcggctctgaaagaacagatggcttccatgatggaggccatgttaggaatgaggcagctcatggagaaaaacgtggccaccgctaccgctgtcagttcggctgccgaagcagacccaactctcttggcaaccgcgcaccatcctccctcaaatatagtaggacggggaaggaacacgctggggcacgacggcaaccctcatctgggatacaatcgagtggcttacccttatggattgccgcccaactactcaccacccgtcctgcaagacgatgcaggccatattgcttctcccgtccttgaaagagagcctcctcaacagcctgacgaggtccacgaagaccctcaagactatgctcgaagggatgtcgagttctatcccccgatccccgaagggccggcacccagcacgttgcctcagcccaacatcacgacacaaccaatagttttgtccatggaaggaccgcccccggcaactgaagaaaggaggaagctcgatctcctcgaggagagattgagagccgtggaaggatttggggactatccgttcgcagacatgacggatctttgcttagtacccgatgttgtatccccccgaagttcaaa

SEQ ID NO: 60911 - DNA, 429 bp, Glycine max
  Peptide Sequence Number=SeqID_152596
atggtcatttctccgggagtgacgtgtccagctcagggacgacgagtataccgatttccaggaagagatagttcgccggcggtgggcatcactggtcacccccatggccaagttcgatccagacatagtcctcgaattttatgccaatgcttggcctacagaggagggcgtgcgagatatgaggtcttggtaaagggtcagtggatcccgtttgatgcagatgctatcggccagctcctgggatatcctttagtgctggaagaaggtcaggagtgcgaatatggccagaggaggaaccggtccgatgggttcgatgaggaggccatcgcccagttgctatgtataccggggcaagattttgcccggactgcagcagggaggcgggtgcggatcatgcgcaccaacatgaccaccctgactcagatctag

SEQ ID NO: 60912 - DNA, 909 bp, Glycine max
  Peptide Sequence Number=SeqID_152597
atgggatcaagtcaaaagccttcgcttaaaaagaggttctatcaagtcaaaatcaagagcttagaggtcaccagtttacgaaagttggggcaattaatgggtcaacttcaacggcaagccttccacaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgactggggatgtgaaaagagcggcgcaagaattgaaggaagaatcaggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagttcgaacacaaggactggattggctcccaaatctaaagactgtgagagacgatgaggttaaagcttcgaaagaaagtgatgaggtacaagccctaaaggcagagcttgaaagagcctgggtagtcgaagagaagttcaagtccatagccatcaaa

SEQ ID NO: 60913 - DNA, 342 bp, Glycine max
  Peptide Sequence Number=SeqID_152598
atgcacgaaacacaatgtggaccaccacgggtacatagaatgaatcgaaaagcttggttcgagaaaattgggggagaagcttgccacccagctcgcccaagcgagcagggttgcttcctccagaagcaacagccttctggaggaatcttttggagggctgttgcttctggaggaatcttctggagggcccaagtgggcctggtggctttggagaaacaaattgttgtaaaggatgccactgagaaaaagaaagaagaggtaacagatgtgacaagtcaggagagtgaaaaaccaataatggtcgaggagaaagaaataaacgaccaagaaaaagaaatagag

SEQ ID NO: 60914 - DNA, 147 bp, Glycine max
  Peptide Sequence Number=SeqID_152599
atgtggaccactacgggggaggtggttgccgcccagctcgcccaggcgagccaggttgcttcctccagaagcaacaaccttctggaggaatcttctggagggcccaagtgggcctggttgctatttgcacccccttttttttactaa

SEQ ID NO: 60915 - DNA, 228 bp, Glycine max
  Peptide Sequence Number=SeqID_152600
atggaggatgagccatctgaggccaccattccaaagccatttgttgtaggggaagaggcagccttctgcaccagtggaggacctaccttcacctcagcatacaatagacctatcctagagatacctgaggacccgaccacactggtcctgactctagacacttctcctccaactactccaatacttcatctgacagatgaagaggatgttcagacacaagatacatag

SEQ ID NO: 60916 - DNA, 175 bp, Glycine max
  Peptide Sequence Number=SeqID_152601
atgtcaggttgtggtgaatatcaattggatggggcacaaatattcttgttggatgctttcaatgctcaaatgcaaagactattgagagagaacaacgaggagttatatgaaagaactaagcgattagagaatcgtgaacgccatgaggacgaaaggagaggaggaaatggtgctg

SEQ ID NO: 60917 - DNA, 690 bp, Glycine max
  Peptide Sequence Number=SeqID_152602
atgaccgactatgactacctgtttggtcaggcaagctggttaaccgaccgctacaacggttatcgccagcgcgatgtgtttaccgccggttatggtcgccagttcctgaacggcccggtacacagcttccgttttgaattcggtccaggtgtgcgctatgacgagtacaccgatggcgataccaaaacccaaccgctcggttacgcgtccgggacctatgcctggcagatgactgacaacaccaaattcacccagggtgtttctgtatttggtgccgacgatacgacgctgaactctgagacggcgctgaacgtggccatcaacgaacactttgggctgaaagtggcctacaacgtcacctggaactcgtcaccgccagaaacggcaccggatcacaccgaccgcagaaccacggtttcactgggttataaaattctatcaaacagggctgatacatgccccttcacaggatcgatcaggttatgccagcgtagggttgggcttagaaccagtggaatcgttcggcgagaatcaacaataaacctgtcgctgaaaggatgttcaatatcacaaccgttctactggatacgttcatggtatgcacctttgggtttaaagatctgttcaagagtagcccagcacttccggaatgcgagcaccgggaactggccacctgcaaattcatgctaa

SEQ ID NO: 60918 - DNA, 770 bp, Glycine max
  Peptide Sequence Number=SeqID_152603
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagattccacattcaatttcgagcgtctcgatatattacgggactcaatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60919 - DNA, 312 bp, Glycine max
  Peptide Sequence Number=SeqID_152604
atgtcgctgcatgttctttatctttatgcgttttctggatttccccccacggatttcccgtctgctgtatctctcgttacaatctttcaaagaaatgaacttggattcgaggctttagtcctcaccttggtttcaaaccttgcattgatttgtgatcacctgagcccttccgctcggggcaggatcatcttgagctaccttctggggtggggaccaaacatgaacagaagaaaccaacccaaggtacacagggacggatgcaagtggggacggggtcataaccgactgatcgtcgccccttccccgcgctaa

SEQ ID NO: 60920 - DNA, 573 bp, Glycine max
  Peptide Sequence Number=SeqID_152605
atggtgaaagttggaacctcttacgtgccgatcaacgtctcattttcgccaaaagttggcccagggcttcccggtatcaacagggacatgccatctgttcctcctgttcagctactgacggggaatggtgttatccgctcacaattcggcacacaagcataccagccggaagcatcagcgctggcaagtgtaaagcctggggtgcctaatgacgctgacgctaccactcacacgccgcgcttaattgcgcttgcgctacagggctgcccgctttcccatgtcgggaaaccatctggcgctaaagggcggatgtgctgcatactggcgattactatgttgggtacactgatgccagggtgttcccagtcacgaagtgcgttcatgtggcaggaaaaaaaggctgcaccggtgcgtcagtcagaatatgtgaatacaggactcactataggtccgcgaattcctcgctctgagctcgctaccgctcggtcgtcgactgcggcgagcgctcagaactatggcttatccccaacgggcgcggaattcctggattatggatgggtcctattcatgcca

SEQ ID NO: 60921 - DNA, 381 bp, Glycine max
  Peptide Sequence Number=SeqID_152606
tcttctgcaccttttgttcctccggggacaacaaagtcatttacatgtggaaatttcatggtcacccgcgactctcgtcagccgagaggagcgaaattagtgtcatacactggttttcggggacctttgcttgatgacatgcgaccattctttggtccttgtgaggaacgacaagtcacggtcacccgcgactctcgtcagccgagaggagcgaaattagtgtcatacactggttttcggggacctttgcttgatgacatgcgaccattctttggtccttgtgaggggcaactgtcataccctaatttcgtccggggacctttgcttgataacgtgcgaccattctttggtcttcgtgaggtgcttggcacccatcattag

SEQ ID NO: 60922 - DNA, 870 bp, Glycine max
  Peptide Sequence Number=SeqID_152607
atggcgaatcaagaggagtgggtcccgtttgcggatatactagcttttctgatctttggggttgtcctctttccaaacctggacggtttggtggacctagccgcaattgatgctttccttgcatatcaccatagcaaggagagcacggtggtagctgtcttggtagacttatttgacacatttgaccgaaggtgcgagaagaacagcgcacggattatctgctgcttacccgctctttgtgtgtggttggttttgcacctattccaacaagacataagacattcgtgttcgcttcaaagttatcgctcgtgcgtcgaaaagagaagagtagactgggaccaatgcttggctgggataggaggcagcacaatcaattggtttcctcgatggaaggaaggaaaagagggagttctcttctcatgtggggactacccaaacgttccgttaatagggatgaggggttgtattaactataatcccacacttgccataagacagttagggtaccccatgaggggagcaccgacggaagagagcctctcgcctttccttatgagagatttcggcgcgcaaagtttcaagattgtacaaagagtccacaaggcgtggaaaagcccgttaaggaaagataaagaacttaggggcatccgtaatggcatcatcggtggttatcatgaatggctaaaagttcatacacgagggttagattggctctccatgttgaaaattatcaacgaggagaacttcgaagctctggaagaggatgaagaaatccaggctctaaaatccgagctagcaaaggaaagactcgccaaagaaaaattcaagtcagccgctacaaacatccggaaagagtgtgctgagttatga

SEQ ID NO: 60923 - DNA, 285 bp, Glycine max
  Peptide Sequence Number=SeqID_152608
atggtttttcacttaaggcttgtagtgagcttcaaaacaaggaaagggaaacagggctcaaaagggctatcaaaggaattaattcagggtaagtccatttggctagaagcttttaagaacaaaattgcctcaatcatttccaaatatgcatgtgaattaggaagcatcaacaagaatcaagccaaggctattgtgcaaaatcggacaagtgtaataaaagcaaagaaggagataggaaaagaagaactccctaagtcatggtggaggaagagtagggtggagtaa

SEQ ID NO: 60924 - DNA, 190 bp, Glycine max
  Peptide Sequence Number=SeqID_152609
gcttcactatgtggtggctcgtggtccacaggtgtacccctcgaatctccccaacaattggtatcagagccgatggttcaaaatggctagcgagcagggcaagtaccgcaggtggccatggctatactcatggatgataaagacttccgctcgagggggagactactatgtggaagagactcacacttga

SEQ ID NO: 60925 - DNA, 459 bp, Glycine max
  Peptide Sequence Number=SeqID_152610
atgaccatgattacgccaagctcgaaattaaccctcactaaagggaacaaaagctggtaccgggccccccctcgaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtggcttttgccgttacgcaccaccccgtcagtagctga

SEQ ID NO: 60926 - DNA, 306 bp, Glycine max
  Peptide Sequence Number=SeqID_152611
atgataatgatagtagacatattaccggtattctactatgaaaagatggtgggttacacaccttcaagttttacagatttggtcttcgccagcaaaaagatcgaagtgggtctgaaaagaggcaaatttaatcatcctgcttggacgaatgagaaaactggggcaaatgaagagggtgaggatgagggagaaacccatgcaatgactgccattcctgtacggccaagtttcccaccaacccaacaatgtcattacccaacccttctccttacctaccacccatttatccaccaaggccatccctaa

SEQ ID NO: 60927 - DNA, 279 bp, Glycine max
  Peptide Sequence Number=SeqID_152612
atggttgttctatgtgttattttgaagtttgaatgggtaatgatctttacacatgggatgactctgaataagctttctactaaaagggccaggaaggccaccgtaggggagggatccggtgcagccccgcaaggaggtgatgaggacatgaccaagagcaagggcaaggatccacttgaaggacttggaggacctatgacaagggctagagcaaggaaagccaaggaagctcttcaacaagtgttgtccatactatttgaatacaagcccaagttttaa

SEQ ID NO: 60928 - DNA, 210 bp, Glycine max
  Peptide Sequence Number=SeqID_152613
atgggtttaggaggagtgttgatgcaaaatggaaaagtagtggcctatgcttctagacaactcaagacatctttgcttggtcttaccaagatatgcctgataaaggaagaggtgaagaagaaatttgacgttggtttcttggctgttgctcggtacctagaatgggtcgccgatatcgtgtcagttccgaaaaaggatgggaagttgtga

SEQ ID NO: 60929 - DNA, 294 bp, Glycine max
  Peptide Sequence Number=SeqID_152614
atgacgttgctactttgcaacgttctgcccagtgaccgtaatgccgatctccccctgcggaagtatcagttgggatcgtggctactagacacccagtggaccaggagaaatccaacagggccctggggtttccagctctgggagtgcccgttgcccccaacaagttcatcaggccccctattaaccgggctttcatcaagaagtagtgcgcccccaggcaggcgcaaggcgaaacaccacaacagcctggggagggccggcagcgggcaacagacgcaccgccaccacctctag

SEQ ID NO: 60930 - DNA, 228 bp, Glycine max
  Peptide Sequence Number=SeqID_152615
atgaagaacggtaaagaacggacgaaaaccttcacggatttgcttacggaaacatctcggaagggttacggaagcacctcggcttggattttcttcacggaaataattttcctaagcaaattcgaaagagagagaagtgccaaaggggctgaacccatttctacttcacttctccccctatttatagaaaattgggggagaagcttgccacccagctcgcccaagtga

SEQ ID NO: 60931 - DNA, 342 bp, Glycine max
  Peptide Sequence Number=SeqID_152616
atgttggtgcgcatgatccgcactcgtctctttgcagcggcacgggtgaaatcttgccccggtatgcatagtagctgtgtgatagcctccctctctggttgtgctcgcacagttggccctcctccaatatcagggggtggcccaggaaccgtgcggatgtggagcacactgaaaatgaggacacgtagccctctaaaggtgagggcgtgcaaccctctcaaggcgaggatgtatagtcctctggaggtgagggaatgcagccctttgttggcgaggacatgtagtcctctcaacgtgagggcgtgcagccctctgttggcgaggacgtgtattcctctaaag

SEQ ID NO: 60932 - DNA, 861 bp, Glycine max
  Peptide Sequence Number=SeqID_152617
atgtttgacacctttgaccggaggtgtgagaaaaacagtgcacggattgtctgttgtttacccgctctctgtgtgtggttggtttcacacctattccaacaagacacaagacacccgtgtccgcttcaaagctatcgctcatgcgccgaaaaaggaagagtcgattgggaccaacatttggctgggataggaggcaacgcaatcaattggtttcctcgatggaaggaaggcaaggagggagttcttttctcgtgtggggactaccctaatgttctgttgatagggacgaggggttgtattaactataatcccgcacttgccataagacagctagggtaccccatgaggggagcgccaacggaagggagtctctcacctttccttgtgaaagatttaggcgcgcaaggtctcaaggttatacaaagaatccacaaggcgtggaggagtccattgaggaaagacaaggagcttaggggcatccataatggcgtcatcggaggttatcatggatggctaagaattcacacgcgagggttagattggctctccaagttgaaagttatcaatgaggagaacttcgaagctccggaggaagatgaagaagtccgagctctaaaattagagctagggaaggcaagactggccaaggagaagttcaaatcagccgctacacacatccggaaagagtgcaccgagttacaagaggaaaacgcggccactgcaagagcccttgaacaagaaaccaaaagggcccacaaggaggacatggtcgagagaaattccgaggagcattgtggggtagcaacaatgagctcaagctccgaagagaggagagagatcggtcacgggtgcatggcatga

SEQ ID NO: 60933 - DNA, 246 bp, Glycine max
  Peptide Sequence Number=SeqID_152618
gattcctttgaggagcaagcgacacagggatcctttgtcccccatggacgtcaggatgttctcaccgctgctattggacgtctagagcaccctggacgtgtccgtgttgctggagccggtttcaccatcaagcaatactttggattggctccacggacgtcccgcaactcttcctcactgcctcccgaagaattgcagcagctaacccagcaaatcagggaccagctagaggagtcgatcacataa

SEQ ID NO: 60934 - DNA, 921 bp, Glycine max
  Peptide Sequence Number=SeqID_152619
atggagcatgccgaagtacaccgcatgctgtatgacatcatgaacgacagtcagcgcaaagtgtatgaagagacgctggaatgcgatttttcgtttgagattcctgacctggcccgtttccgggttaatgcctttaaccagcaacgcggtgccggtgcggtgttccgtaccattccgagcaaggtactgacgctggacgagctcaatgcgcccaaagtgttcaaggatattgcagatacgccacgcggtattgtgctggtcactggcccgaccggttctggtaagtccaccacgctggcggcgatgattgactacatcaatgaaacacagatgtcgcacgtgctaaccgtggaagacccgatcgaatttgtgcatacgtccaaaaaatcgctgatcaaccagcgtgaagtggggccgcatacgcagtcgtttgaaaatgccctgcgttcagcgttacgtgaagacccggatgttatcctggtgggtgagatgcgtgacctggaaaccatacgcctggcgttaacggcggctgaaaccggtcacctagtgtttggtactttgcacactagctctgctgccaaaacgatagaccgggtggttgatgtgtttccggcagctgaaaaagaaatggttcgctctatgctgtctgagtctctccgtgccgtgatttcacaaaccctttgtaaaaccaaggacgagcagggccgtgttgccgcgcatgaaatcatgatggggactccggccatccgtaacctgatccgtgaaaacaagatcgcccagatgtattctgccatccagactggccaaagtatgggtatgcaaacactggatcaaaacctgcaagacctggtgaaacgtaatgtgatcagtgctgccgaagcgcgcacaaaggctgcaaaccgtgacactatcatcggctaa

SEQ ID NO: 60935 - DNA, 457 bp, Glycine max
  Peptide Sequence Number=SeqID_152620
atgaggcctgatcctcaggagttggctgctaagctttgtatcccagggaggggattcgagcttaatgcttatgggcaacccttgaagattttaaggaagaacatgaccaccctagctcagacatggagtgttctttccttctctaacctgattcttacatcccatacttctgatgtcaccctagacagagccaaactcatttatggcatcattatgaagatggatatgaatgtggggtacctcatttcccaccagatctcccccactgctcagcatgacacatccatacttggattcccaaccttgattatagctttatgtaagactaaggaagttcagtctgatttgaaatccctggagagcttgagtcctaccattaatttggcatacattaagaataattgttggaatcttgatgatccaatagtaactttcagaggacccaggaaggccagag

SEQ ID NO: 60936 - DNA, 324 bp, Glycine max
  Peptide Sequence Number=SeqID_152621
atggactcgggaaggttccaagttagtgtaccaggtaacagctaccccatttacacagcccccaccttgaacttgggagggctgttcaagaattgccagggttgtggatctttgtgggttgacactgaggcgattctcctcaaatttcagcgggtataccacattaacgcttgcccttacagcttgagggcatacagtgctcgaatggaatgccccagggcccctccacgatatgcacatgttgcgttcgagtcatatcctcagaaaaatgggggtttgagggaacctagcaggggttatggctaccattgcattatcaagtag

SEQ ID NO: 60937 - DNA, 81 bp, Glycine max
  Peptide Sequence Number=SeqID_152622
atgaagaaaaactgcttaaagtttaagagttggatggacaagaaagggtatggaaaacctaaggaggccagtgggaagtga

SEQ ID NO: 60938 - DNA, 710 bp, Glycine max
  Peptide Sequence Number=SeqID_152623
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtattttgctatatacatgcgtgtccaaggtatcttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60939 - DNA, 159 bp, Glycine max
  Peptide Sequence Number=SeqID_152624
atgatgggagatgcatcgaaattcactcatatttctcccaagaaaagcagacatgtgacttatggagacaaaaataaaggtagaattcttggagttggaaaaatagatcaaaaacaaaaccatgatcaatgttttcttagtaaagatgatgatccttga

SEQ ID NO: 60940 - DNA, 800 bp, Glycine max
  Peptide Sequence Number=SeqID_152625
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcagactaatactcacaaacctcaatcccgttcatacactgcgccgtctctgattactgcccgtttaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60941 - DNA, 483 bp, Glycine max
  Peptide Sequence Number=SeqID_152626
atggaagggttagtggacctagtagcgattgacgctttcctcacctttcatcatggcaaggaaagcccggtcgtcgccattttggccatgtatgacatgttcgaccggggatgtgaaaagagcggcgcaagaattgattctatcttcatgcgaaggatgtcccatgagaggagtgccatcagacgaaagcatcacgcctttcatcgcatgagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaaactccgaagaggtgaaaggaatcatcacgggtcaaaggcatgatctggaaggacgagctaaaggcttgccttag

SEQ ID NO: 60942 - DNA, 258 bp, Glycine max
  Peptide Sequence Number=SeqID_152627
atgactcatcaggattttcaagtgcaagccattggtctgtttgctcaagcgacctgtgcttctgagtttggacttccaagaccgttcaatcagagattactcatccttcacgttggtgggggtgccgtaaaacaaagaggacaacccttcccttgtgttcaagaatcccctacaacaagagacccacggtctcttaatcccttttcagaaataagaagaagagaagaagaaatctctcttaaaagagatggattgtaa

SEQ ID NO: 60943 - DNA, 408 bp, Glycine max
  Peptide Sequence Number=SeqID_152628
atggtgaaagttggaacctcttacgtgccgatcaacgtctcattttcgccaaaagttggcccagggcttcccgcctcgttcaacaccgcccccggacgagccaggatttcatgcttatttgcgaagtgctccagtggcgtatctggtttctatcagctgtcccttcctgttcagctactgacggggaattggttatccgctcaattcggcaaaagcataccagccggaacatcagcgctggcaagtgtaaagcctgggggtgttcagtcacgaatgcgttctgtggcaaaaaaggctgcaccggtgcgtcagcatgaatatgtgaatacaggactcactattccgggcgaattcctcgctcatgagctcgctaccgctcggtcgttcatgcggcgacggaaagcttag

SEQ ID NO: 60944 - DNA, 369 bp, Glycine max
  Peptide Sequence Number=SeqID_152629
atggtgaaagttggaacctcttacgtgccgatcaacgtctcattttcgccaaaagttggcccagggcttcccggtatagcttattcggcgcaataccgtgcgcctcggctgttccctcctgttcagctactgacggggaattggtcgctcaatcggcaaaagcataccgaccggaacatcagcgctggcaagtgtaaagccggggtgcctaagacgctgacgctaactcaccattcaccctgcgtcgcgcttcactgcgccgctattccagtcggacgcgtcgccattcgctgcattcatgagctgcgcaactgttgcgcgaagggcgatcggtgcgggcctcttgcgtattacgccagctggcgctaa

SEQ ID NO: 60945 - DNA, 342 bp, Glycine max
  Peptide Sequence Number=SeqID_152630
atggatttgactacactagctcaggtgtggagtttcctctcatactccaacttggcccccacatcacgtacctttgatctgacagtggacagagctaggctgatctttggcctagtctttcacttggatatgaacataggagtgctggtctctggccagatgacctctatagcccagtctaacacttctagacttgggttccctgctctgatcaccacattatgtagggccagaggggttgtctccaacttggcctacatcaggaagaactattggaatcccgacgatctaatagtttctatccgaggggctagaagggcgaggacaaggcaggccaactga

SEQ ID NO: 60946 - DNA, 138 bp, Glycine max
  Peptide Sequence Number=SeqID_152631
atggaaaagagagcaaatgagaaaagaagagagcaagtaaagaaaaagagagcaaataaggaaaaagaaagcaaggtgaatgctgtgaaatttccccggacgcccgaaatggacttggatgaatgcacaaatggataa

SEQ ID NO: 60947 - DNA, 489 bp, Glycine max
  Peptide Sequence Number=SeqID_152632
atggacccgaagaagtcccatagggccctggggtttccaactctggttacgggcctctgtcagtcctacagggtgcccgttcccccagcgaggtcatgccatcgtgacataggaatcgcacccacaaagacacccagtggacccagagaagtccaacagggctttggggtttccagctctgggatcgtgcccgcaagacacccggtggacccgaagaagtccaacagggtcttggagttgtcaagctctaattacgggtctatcaagggcatcaggccccttactaatcgagctttcatcaagaagtactgcatccccaggcaggcgcagggcgaaacaccacagcagcctgggggatggccagcaacgggcaacagatgcaccgccatcacctctagagttcacctcagctcatccacaaaagaggctagagcgttgcttacgacccatggccgaccaacaggcggccaagtccgaagccaaaggtaa

SEQ ID NO: 60948 - DNA, 87 bp, Glycine max
  Peptide Sequence Number=SeqID_152633
atggctaggagactccaagaagattgggctagagatgtaggagaaggccctagggttctcatgagccttaggggctccatagtgtag

SEQ ID NO: 60949 - DNA, 417 bp, Glycine max
  Peptide Sequence Number=SeqID_152634
atggaggccatgaaagagcaaatggccacaatgatggaggccatgatgagcatgaagaagataatggaagccaatgcggttatagttgccgctactagcgctgtcgctaaggtgaacccgatgctcccatctggcctcaagaaaatgaatcatccaacctcaaatatggcacatatctctcaaaccatgggggagacacatgaaattccccaccacaatctagccgacttcgagccttgcctcggatatgccactgaagggcaagcagttggtggcatacccctgcaaaacactttggagggccctcagtgtcacccacaaccacaaccctcacattccacagcggttaaaaaccctcatgctatggcagaaatgggaaagaggaaaggcttagggccattgaaggaggtaaggtaa

SEQ ID NO: 60950 - DNA, 210 bp, Glycine max
  Peptide Sequence Number=SeqID_152635
atgtcaccagtgcatcttctccgtgtatgcgtaacattgaccacagtcctgggaacacaagattgcaaagctcccaaaagttttggcagtttggcatatgatgtggaagcaatgtcttccaaggttattttgatgattccaaagaatcaagagttaagcaaattccaaagattcaagaatcaagtttcaagaatcaagattcaagaataa

SEQ ID NO: 60951 - DNA, 414 bp, Glycine max
  Peptide Sequence Number=SeqID_152636
atgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccgggggggcttttgtcgttgctgggactatgtggatggttcagcaacaacccctattga

SEQ ID NO: 60952 - DNA, 282 bp, Glycine max
  Peptide Sequence Number=SeqID_152637
atgcagtctgcgcacctgacatggtttcccgaactgggaaagcgggcagccctgagcggcaacgcaattaaccggcgggtgctttacacttgcccgctgatgcttccggctcggtatgcttttgccgaattacgcggataccaccccgatttcatagctgaacaggaggaacagctgatagaaaccagatacgccactgagcacctcaaattaaccctcactacactagggaatcaaaagttcgggcatccccgaggtcgcacttgtaagcagtcgaactaa

SEQ ID NO: 60953 - DNA, 399 bp, Glycine max
  Peptide Sequence Number=SeqID_152638
atgacaccttcgaccgaagatgtgaagaaagcaatgcaaggattgtttgttgtactccagctctctatgtggggctggtttcacacctttttctctaagaaggtaggcccgtctatctgctacaaggtcaccgctcgtgcgtcgaaaagaaagacgaattgggaccaactcttggctagcatggaggggcgtttgttaatggttccctcgctagaaggaaggaagaatcaggattgtatcttcatgcgaagattggattggctcccatctctaaagactgtgagggacgatgaggttaaagcttcggaagaaagtgatgaggtacaagccctaaaggaagagcttgaaagagcccgagtagtcgaagagaagttcaagtccatagccatcaaagtctga

SEQ ID NO: 60954 - DNA, 432 bp, Glycine max
  Peptide Sequence Number=SeqID_152639
atgcagtttggtgactacattgcacctgtagggcaattatgtgcagtgcctggccactgttcaccagattacatggattggttttacatgatctcacacccattcatgagttcgatgcagccaggggatcctcttagagtaccaccggttcaacaacatgaagaatttgttgaaccggatatgtatcagcaaccaatggcggcaacgacacctaatgaggcagacattgatgagcatcatcttcggcatgtagtggatgactttgtagcaattgctgataggttggacatgctactgaacttgaggatcttgaccaaaggaacaaaagcctatactgttgttgaagaatgtgtgggcatcacaagacgctacattggccaactaactatacgtcacatatcgaggcgaaggcggcgtatgaacggacattga

SEQ ID NO: 60955 - DNA, 189 bp, Glycine max
  Peptide Sequence Number=SeqID_152640
atgacggctgccttcgccattcaggtgccaactgttcgggaaagggctgatcggtgccagggcctcttcgctattaagaatcgccacgcggcgaaaggggagatgtgctgcaagtttgcgattaagttgggtaacgccggagtgtccatcacggcttactatgttgtaaaactgatgacgggccagtga

SEQ ID NO: 60956 - DNA, 438 bp, Glycine max
  Peptide Sequence Number=SeqID_152641
atggacaacttcttcgcccccgttttcaccatgggcaaatattatacgcaaggcgacaaggtgctgatgccgctggcgattcaggtaactggcttggaggagcgcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtggtggttacgcgcagcgtgaccgctacacttgccagcgctga

SEQ ID NO: 60957 - DNA, 555 bp, Glycine max
  Peptide Sequence Number=SeqID_152642
atggtgacagttggaacctcttacgtgctgatcaacgtctcatgttcgccaaaagttggcccagggcttcccagtatcaactgtgacaccaggatttatttattctgcgaacaccgccggacatcagcgctggcaagtgtagcggtcacgttgcgcgtaaccaccacacccgccgcgcttaatgcgccgctacagggcgcgtcccattcgccattcaggctgcgcaactgttgggaagggcgatcggtgcgggcctattcgctattacgccagctggcgaaagggggatgtgctgcaaggcgattaagttggatcgaattcctgcagcccgggggatccactagttctagagcggccgccaccgcgggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctga

SEQ ID NO: 60958 - DNA, 144 bp, Glycine max
  Peptide Sequence Number=SeqID_152643
atgagttgtacaggttcgctaagcacaccgcttcatctcactaagtgcatcacttcagttcatctgctaagcgagaaggcacgcgctaagccgaaattcactaatagaccagagcttaaagcaggagccggtttgagagcttga

SEQ ID NO: 60959 - DNA, 204 bp, Glycine max
  Peptide Sequence Number=SeqID_152644
atgatacgccagagctcgaaattaacacctcactacacaaacaataagttggcctcacccgacgctttgcccgaaaaatacctcgaggtgacggaagatcaagcttcgattgcctcaaatcaaaattcaataccacctattggtgtccctgttgtagaactgggcacaacttttggaaccaatgagacgttgatcggcacgtaa

SEQ ID NO: 60960 - DNA, 267 bp, Glycine max
  Peptide Sequence Number=SeqID_152645
atgaccgatccaggtcttataagtcggctttgttttttcgtgcgagctcaaccgaagctgtgttgcagccgacactggcatacttatcaaggtaattcttgtggcgtctaccctgacttatcttccttcaccggaagtggcgtctacccagacttatcttccttcatcggaagtggcgtctactcggacttatcttccttcatcggaagtggcgtctaccttgacttatcttccttcactggaagtggcgtcatccaaactctgtaa

SEQ ID NO: 60961 - DNA, 517 bp, Glycine max
  Peptide Sequence Number=SeqID_152646
atggcggcgcgtctgttgcccgctgccggccatccccaggctgctgtgcaccctgtaggactgatagaggcccgtaaccaaagctggaaaccccagggccctgttggacttttccgggtccactggggggagattggcattgcgatcgctgggcagaatgcacgggtgaaatcttgccccggtatgcatagtagctgtgtgatagcctccctctctggttgtgctcgcacagttggccctcctccaatatcagggggtggcccaggaaccgtgtggatgtcgagcacactgaaaatgaggacacgtagccctctaaaggtgagggcgtgcagccctctcaaggcgaggaggtgcagtcctctggagatgagggcatgcagccctctgctggcgaggacgtgtagtcctttcaaggtgagggcgtgtagccctctgacggtgagggcgtgcaaccctctgatggtgaggacgtgtagtcctctcaaggcgaggacgtgtagtcctctaaacagtgagg

SEQ ID NO: 60962 - DNA, 144 bp, Glycine max
  Peptide Sequence Number=SeqID_152647
atggagaagaagatgaagaacaaggaattaaaatcaatggcagcagaatggagaaggaagaaatatgattggagacgccaattcaaggagaagatgagtcaagaacaagctcaccaccataggaacccatggataagagcttga

SEQ ID NO: 60963 - DNA, 327 bp, Glycine max
  Peptide Sequence Number=SeqID_152648
atggcttacactcacattccggattcaacaagcgattctcctcaaatttcagccagcccgtatcaattagacttcacactttatgcttcggggtcatacaatgctcaatggaatgccccggggctcctccatgataagcacacgttgcgtttgagtcgtatccttagaaaaatggaggttgaggaaccttggttgggattatggctaccattgaattatcgagtggatatgggatcaaatttagcatatgacaacggaatttggggtgaaccctacaggctttttgctgcaaaattcctttttgttggtgtttttggtttgtgctaa

SEQ ID NO: 60964 - DNA, 854 bp, Glycine max
  Peptide Sequence Number=SeqID_152649
atgctggcggacgaggtgccggatctcgaactgggtggcgtgctgattgcgctgcgcatcaaaggcgaaggggaagcagagatgcgcggcttctaccacgcgatgcagcagcgcatgatgcggctgcaggccccggcacagcgtccgatgcccatcgtcatccccagctataacggcgcgcgtcgccagggcaacctgacgtcgctgctggcgctgctgctggtgaagctcggttttccggtgttgctgcacggcgtcagcgacgacccaacccgcgtgaccagcgaagcggtgctggcggcgctggatattgcgccagtgaccagcgcgcaacaggcgcaggcgaaactcgacgctggcgagctggcgttcatcaccatcgatgatttatgtgcgccaatggctaaacagctggcgctgcgctggcgcatgggcgtgcgtaacagcgcgcacacgctggccaagctggcgacgccgtttgccgaacgcgccgcgctgcggctggcgagcgtatcgcatccggaatatgtgccgcgcgtgggtaaattcttccaggatatcgatgcaccggccattctgctgaacggcactgaaggtgaggtctatgccaatccgcagcgctgcccggcgattaattatattcgcggtgccggcgcagaagcggaagtgtgggtcgagcggcagccggaggtcgcgctggcgctggccgagagcaaaagcgcccaggataccgcagcgtggatccgtcaggtgctggccggtgaacgcgcggtgccgcaggcgctgcgcctgcagctggcgtgctgtctggtggcgaccggcgaagccgcaacgatggccgatgccgaaacgcg

SEQ ID NO: 60965 - DNA, 455 bp, Glycine max
  Peptide Sequence Number=SeqID_152650
gaattcgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccctggcggctcctcgtgcgctctctgttcctgcctttcggttaccggtgtcattccgctgtatgccgc

SEQ ID NO: 60966 - DNA, 128 bp, Glycine max
  Peptide Sequence Number=SeqID_152651
ggttcatgagacactgtttgatccttccaaacgcttcttgacaatcctcgttctagcggatggaaacctcagacttgcctctcggtacggggttccggcatctcaaggatggccttcaccttttcggg

SEQ ID NO: 60967 - DNA, 150 bp, Glycine max
  Peptide Sequence Number=SeqID_152652
atggcaataactcaagctacagggctccaaatgagaacaaggttgaagatgaaaggatggaaagaatcactcttttcggcgagggcaacacacaaaggttgtgaaagtcctttatacagtcgagtgttcttgaatctctcaagaacttag

SEQ ID NO: 60968 - DNA, 203 bp, Glycine max
  Peptide Sequence Number=SeqID_152653
tgaaactgagcaaaaggctccataccaagatgatgagcttgtagggcttcaagaagtgttggaagttgaccctgatgtcattaatgaatctcttgcggatgttgatggaggtggagaaaagatagatgtagatttactcaaacaattagacttggttgaaccaaatgaggataaatgcatgttaagtgagaatgacattgaga

SEQ ID NO: 60969 - DNA, 237 bp, Glycine max
  Peptide Sequence Number=SeqID_152654
atgcagagttcaaaacacgatgtctaccttggagcttccctgaatggtgctttaaaaggtcttgatgatgttccacagcctaaatcaaaggctcctcctaggtggattgtcgtcaagtgtaatagacaaaaaggaagcactgagtgcggctattatgtcatgcactggatgtccaccatcattttaggaagttacaggaataactggaaagcatattatctccgagttagagcttag

SEQ ID NO: 60970 - DNA, 815 bp, Glycine max
  Peptide Sequence Number=SeqID_152655
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcgttgcggatatgtgagggggtcgatgtcggctgccggtgcgacagcgaagctcgcctgggtgcgttcttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60971 - DNA, 570 bp, Glycine max
  Peptide Sequence Number=SeqID_152656
atggagaaagtgctggcgcgcatcgccaccatccgccagggcgatcccttcgacaccgacaccatgctcggcgcgcaggcgtcgcaagaacagtacgataagatcctgtcctacatcgacatcgccaagaatgagggcggcaacatcctcgccggcggcaaacgcacgcagcatggggatgaattgcaaaacggtttctacctgcagccgacgttgattaccggcaacaacagcatgcgcttcttccgcgaggagatcttcgggccggtgatcggcgtcaccacctttaaagatgaagccgaagcgctggcgctggccaacgacaccgagttcgggctgggcgccgggttgtggacccgtgacatcaaccgcgcctatcgcatgggccgcgcgatcaaggccgggcgcgtgtggaccaactgttaccacctgtatccggcgcacgccgcgttcggcggctacaagaactccggcatcgggcgcgagacccacaaggcggcgctgtcgcactatcaacaggtgaaaaacctgctggtcagctacgacgctaaaccgctgggcctgttctga

SEQ ID NO: 60972 - DNA, 717 bp, Glycine max
  Peptide Sequence Number=SeqID_152657
atggtcattttgcacaccttttcgccattcaaacacagtcgtgtccgatggcacccagagactaacgccgtcttctgcgccttttgtcatccagaggcgacgggcccgatgacatgcggagaaaaattatggtcattccacacacattttcgccattcagacatagtcgtgtccgatggcacgcagagactaaattttgtcgtcttctgcagccttttgtcatccagaggcggcgggctcgatgacatgcggagacaaattatggtcattccgcacaccttttgccattcagacacagtcgcatccgatggcacgcagagactaaacgtcgtcttctgcgccttttgtcatccagaggcggcgggcccgatgacatgcggagacaaattattgtcattccacacaccttttcgccattcagatacagtcgtgtctgatggcacgcagagacaaattatggtcttctgcgccttttttcatccagaggcggtgggcccgatacatgcggagacaaattatggtcattccgcacaccttttcgccattcagacacagtcgtgtccgatggtcacgcagagacaaattaacgtgtcattctgcgcccttttgtcatccagaggcggcaggcccgatgacatgcggagacaaattatggtcattcctgcacaccttttcaccattcagacacagtcgtgtccgatggcacgcagagactaa

SEQ ID NO: 60973 - DNA, 483 bp, Glycine max
  Peptide Sequence Number=SeqID_152658
atggtggggtacgcaccttcaagctttgcggatttggtcttcgccggcaaaaggatcgaagcgggtctgaaaagaggcaaatttgatcatcctactttgataagtgagaaagctagggcaaatgaagagggactacacgtcctcgccatcagaggactacacgtcctcgccatcagagggctgcatgtcctcaccttcagaggactgcacgtcctcatcttcagaggactgcacatcctcacctttagaggactacacgtcctcgccttcagagggctacacgccctctccttcagagggctatgtgccctcgccatcggaggactgcacgtccccgtcttcagagggctgcatgccctcacctttagaggactacacgtcctcgccattagagggctgcacgccctcaccttcaaagggctactgatgtgccatcattttcttctattttctaaaccctttttgcaccattttaattactaa

SEQ ID NO: 60974 - DNA, 342 bp, Glycine max
  Peptide Sequence Number=SeqID_152659
atgtacatcaagtatggcccaaaatacatcatgaagcatagccaacaaaacatgttatccaatgaaacaaaaacccccacacttattcccaaaacaattccaaagctccaaaattccttaaggatatgtgagcttcaaaacaaggaaagggaaacaaagctcaaaaaggctatcaaaggaattaattcaagggagcatcaacaagaatcaagccaaggctattgtgcaagcaatcaatggggaaaaacacaccaaatgattatgatgatggatggctcaaattctcacaatggtaaactcatcactttcaaattgagctttcaaaactatcatgacatgtag

SEQ ID NO: 60975 - DNA, 717 bp, Glycine max
  Peptide Sequence Number=SeqID_152660
atgcttcaaaactgcatcgacgaacgcaacctcctcaagggtcaaaagaaacctccacgtacctctcagagcattcttgaagccaacgagctttctgctacctccgttattttctacttcacgccgatttcggttcctttgaaaacagagccaccggttggaatacagagagcagcgactcccccggaggattccccgtcgccgccgccgcctcctgctccggtggaggacggagattccgactctttcaagaaattggttattgttggaatcgtggttggggtgactattccgacgacgcattcttggtctgtttcttctgaaggggttcgttacgcgattgagtcgttgagtgtgttcaagtttgaggagttgcagaaggcaacggcgttcttcggtgaagagaacaagatcaagggttctgtttatagggcttctttcaagggtgattatgctgcggttaaagttctcaaaggtggcgtgtcgggtgagattaaccttctcaagaggattaaccacttcaacagtataaggttgtcgggtttttgtgtctacaaaggtgacacctatcttttgtacgagttagcggagaatgattctcttgaagattggcttcacagtgttaacaagaagtatgagaattccgtgcctttgagttgggtgcagagggttcatattgctcatgatgttgctgacgcgcttaactaccttcaataa

SEQ ID NO: 60976 - DNA, 216 bp, Glycine max
  Peptide Sequence Number=SeqID_152661
gtgcgatcataccagcaatactgcaccggaccccatcagatctccgcagttaagcgtgcttgggcgagagtagtattaggatgggtgacctccagggaagtccccgtggctcgttcgcactactgcatcggatcccatcagaactccgcagttaagcgtgcttgggcgagagttgtactaggatgggtgacctcctcagaagtcctcgtggcttga

SEQ ID NO: 60977 - DNA, 863 bp, Glycine max
  Peptide Sequence Number=SeqID_152662
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatactggttttggcgatcagcttgctttcaatatcaatcccaacttctaccattacaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60978 - DNA, 399 bp, Glycine max
  Peptide Sequence Number=SeqID_152663
atggtgaaagttggaacctcttacgtgccgatcaacgtctcattttcgccaaaagttggcccagggcttcccgaggcaacagggacacttgttaaaaacagagatttgacttactgttgcgaagtgtcttccgtcacagccggggtgctgagtgagctaaccaccacacccgccgcgttaattgcttgccgctacagggctgcccgtttcccattcgaaccattcggtgccaactgcattaatgaatggcaacgcgcgggcgatcgagtgcgggcctttgcgtattgggccgctggcgaaagagtgtatactggcattaatgttggcactgatgaagctgtcagtgaagtgcttcatgtggcaggagtaaaaaaggcgacggccagtcagaatatgtga

SEQ ID NO: 60979 - DNA, 270 bp, Glycine max
  Peptide Sequence Number=SeqID_152664
atgaatgaacttaatcattgttatcaaaaaaggaaagaacacgctttacggtgcccttaccgaacccgtgctagagctagagtaatgggtgaagtagaggaggtgcaaaagcatatgaaggccgacacggaggccttgaaagagaaaatgtccacaatgatgaaggccatgatgagcatacaagagataatggaggtcaatgcggctgtaatagccgctatcaacaccattgctgaggtggacctaaccctccccccccccatatggtag

SEQ ID NO: 60980 - DNA, 591 bp, Glycine max
  Peptide Sequence Number=SeqID_152665
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatggattgcatggtcagcgcacggtgatgatgtcgcggtgcatgggggccaacagcgccagcaggcggttttgctgcgcaaacgcaatgccctgggccgccatggccgcctgcagcacttccaccagcgcgttgaaatcaagcttatcgataccgtcgacctcgagggggggcccggtaccagcttttgttccctttagtgagggttaa

SEQ ID NO: 60981 - DNA, 219 bp, Glycine max
  Peptide Sequence Number=SeqID_152666
atgtttaaaaaattaggatacaccccgtgtaagcatacttttgatagaaattttgataaattttgtgagttgagtcccctaataaaagcatggattgggaagatctcaaaagaaaaatggacaatggcatatgacaaagaaggacgtagatacggtcatatgacaaccaatctatcggaatgtgtaaataaagttttcaagggatgtctacccttgtga

SEQ ID NO: 60982 - DNA, 333 bp, Glycine max
  Peptide Sequence Number=SeqID_152667
atgtttctaaaagaatattatctcgcaaatcccaacggtggaagtgtgcccaatttaatttcgaacaacatatccaaattgcatgaaaatccaacggttaacgaaaccgagatctctcatctcaatgatgaaatcaaaatttccaacggtgagaatgctcgaaattgggctgcgaacgtagtgctcaaatttcatgacgatccaacggtgaacgagtccgagatcgttgtttttctgagacaggttaggtggctttcgggaaaaagaaaggattttgggagaagagagaagaaacgaaattgtgagacagaagaggctgaggagtcaatctga

SEQ ID NO: 60983 - DNA, 294 bp, Glycine max
  Peptide Sequence Number=SeqID_152668
gttataggttgtaccatttgtggtggtgctcatgaattcggccattgcattccttgtgaagaacaaacgcaggaagttagctacatgggaaatcaacaaagacaaggaaacaaccaaggaggattctcaggtttcctgcaaggttcctacaatcagcaaggaaaatggagatcacaccgtggtaaccaattcaataaggaccagggtggaccttccaataggccacctcaacaagggcctaatatctttcagaggactaccaaactggaggaaaccctagctcaattcatataa

SEQ ID NO: 60984 - DNA, 2100 bp, Glycine max
  Peptide Sequence Number=SeqID_152669
atggaggctcacgcgagctccttcgtgtccaaagcgcgaactgcgttccattccgcagccgcgaaagcggagcgtgttctcatggacttcaaaatcgatctagattctgataagcaatttcacgacgagtttgggaggcagcggggcgatgaatctgctcggagtgagaagtttcttgatgaactgaagcatataaagtggagacctccacatataggaacaaagcaggactggcaagatagaataaacaacatgcgaaaagggagaaaggaagtcgaagtaacagataaagttggcgatgtaagcatggcctctgctccattttatgatgaaaatatgtacatcctcaatgtgaaaaatgatcttgatgccaaggcttcagaagcaattccctcggttgaaggcttaactgctgcgaccaaataccccattcctccatcatctgtcctgaagcagttggctatagctattgagtctggaaggcaaacaaactcgatgaaagattttgtagcttcatcaagaggttcgtcacctgccagagagaaggcaggcttaagtctctcttcagtgaaggctttagtgttgcgtgaaaaggaggacaaactcacctctgagtttagtagtgatgagaaagttgtgtatttgattaattcattgtttgatcaagagggagagttccttaaaaggaactctgatccagaggaaactttcatatcatctttgccaagagatattcatggtgcacctcttgaaagcctagttgttaagctagctgaagtaatcggaaacttcaagacgcttcgagaaatgtctcttttttggtccagggttgttgatgaactgagaaaacattggtccgaagaaaaacatttgcctggaatccccccagatgacattccagatctgaagtcatgtcttctgtatcaacaatttcaagtaattaattgttgcatctctcggaaaaagcgccatattattgccactgaatctctggacactatggtgatggaagccaattcaaatgcattagagtcagcaaactacacgggcaaaattcctacaggccctttattatatgcaagattaagaactggagagcttgttctccgacttggtgctgattgcccatctggagatttgacattactggagactggcgagccggcatactctcctgtcacccaggagggacccttgcttacagaagatctgatcaaagagacagaggagtttgtgctgcggacagggagtgttggtgctggatgctctcaactcctctctgatatgcaggctttcaaggctgcaaatcctggttgcattttggaagattttgtgagatggtactctcctcctgattggagtgaaagtgagggaagtactgaggatagagattcttcttatggtggggagtcaatgtctaccagaggtcaactaagtttgcgaatgcaaaaagaaggtaatttgtggcgtgaattgtgggaaacatctaaaccagttccagctgttaaacaggcacctctctatgatgaggatttggcagtggaggacattctagatgcatttgaggacatccagccttcagagctttttggacagctgtttgtttctcttctcagttttggatttgcaattgctgaaactatgctgtatggcgaccttgatctctcaaagttgttcaatgattgcaaggagtacatagttaccacgtgtcagagtgacagattcaatgagaaaatcgatgaacttgttcagatgtatgaaacagtggagaaaatgttgctgaatccagatgaggcattgaagatgaagcacatggaagaatcaactatgactactgatgaatcaaagcgccggttttctactggtgagccaaagcaccggtttaagagacttagccatatctttggtggcaaggataaactgttgacaaggccggtctgtaaaaacgaggtaaacgatgaagaaacgcagattcgacattctttctcgagtttctttgacagcaagtcatctttattttcaaagaagccacctaagcctggaaacctataccctgctgagcaacctctctctctggaaagtgacaggacagttatttag

SEQ ID NO: 60985 - DNA, 1063 bp, Glycine max
  Peptide Sequence Number=SeqID_152670
atgaaaaatgatgttattgagggacaacagagggtggtggtggaggactggctgacggtgaaggagcagtgggaatctggcgagacgccggtgccagaggaggatattgagatgatcagagccaaacttggagaactagatgggaagtttgttcccaaaccaattgttgtaatgactgaaaaggattatgatagggacccagaaattcttaagcaattgcacccatttaaagtttttgttctctgttctgcattgaaggctcaaaaggctccagcagtttatgtgtttggagactcacttgttgatgttggcaacaacaattacttgagtctctccattgaaaaggcaattcttcctcactatggcattgattttccaactaagaaacccactgggagatttagcaatggcaagaatgctgcagatttaattgctgaaaacttgggcctacctacttctccaccttatctctccctagtatctaaggtccacaacaacaacaagaagaacgtatctttcttgggtggtgttaattttgcctccggaggtgctggaatatttaatgcctcagataaaggatttaggcaatcaatacctttgccaaagcaagtggactactactcacaagtgcatgaacaactgatacaacaaataggagcatctactctcgggaaacacctctcaaagtccatcttcattgtggtgattggtggcaatgatatctttggttactttgactcaaaggatcttcaaaagaaaaacacccctcagcagtacgtggattccatggcttccacattaaaagtgcaactacagagattatacaacaatggtgcaaagaaatttgagattgctggtgttggtgcaattgggtgctgccctgcatacagggtcaagaacaaaacagaatgtgtttctgaagccaatgacttgtcggttaaatataatgaagctcttcaatccatgttaaaggaatggcaattggagaacaaagacataagttactcttactttgatacttatgctgccatccaagaccttgttcacaatccagcttcttacg

SEQ ID NO: 60986 - DNA, 63 bp, Glycine max
  Peptide Sequence Number=SeqID_152671
atggagaatgacaaatataagggattcggaggaaggttgaagcacaattggacaaggtattga

SEQ ID NO: 60987 - DNA, 1566 bp, Glycine max
  Peptide Sequence Number=SeqID_152672
atgactccaacgatgtcgtttcgaccaacttcgaacatcgtggattgcgcatgccggttgggtggtggtgcgatgagggaacacgacgatgttggaggacggagtgagctctggctcgatgagaagtttaaggaaagtgaagagatggtggggtggggtggcattaaaagtttgagaaggagtgggaggggaaggtttcggagaaaaaagagactagagagaggtcgatgccggaaccattggctcttggagttattcggaaccgcaaatttagcaaccactccaccactcttcgctgccatagttcgaccaccccccgtcgcagcctccaccaccaccgtcataaattacttcctagttactacacgtttgatggagggtatggcaattagtgatgatgcaagcaatggtgaaaatggattcctggcaatgtttggtggcgatgaaagtggtggtggtggcagtggcggtgtcggtagcggtggtgatcagggtggtggtaatgtggaggatgtggctctgaagaagggtccttggacaactgcagaggatgttatcctcatggattatgtggcaaaatggcccaatttgaagaagggtgcattctcacctgaggaagagaagctcattgttgatcttcatgcacagtttgggaacaaatgggccagaatggctgctttgttgcctgggagaacaaacaatgaaatcaagaactattggaacacagggatcaaacgccgccaaaggcagggtctccctctctattcagatgagcatgatcaacacaatcgttccacaacaccaacccctccaaccacacctttcccatgcctcaccccaacaggatcaaaccccgacattgccacaagttttgagttgttcaatcaaaaccaacaacaacatcatcaacaacaacaacaataccaataccaacaacaacaacaataccaacaacaccctctgtctccaactgcatctcatcattcccctcttagttcccctctccaacatagacaacccttcacctcttcatcacctcacaatttcttagaccattcacctcttccactctcctcatcctattcaccttcccctctctccttcaccttccaaagaccagcaccaatgctaagcacccctcttcgcttcaagcgctattgcgcctctccaagctacaacaacaacaacaacaacaacaacctctctgaccctcctctcaccacccaattccctcaccttgatggattcaggttccctgtttcttcaggcttctctcagttttttcagccctctttgttagactccgatcgaggcgtttcttcttcctcctcctctttggctttccaacccaagttggagctccctttaagccagtactataaaccatcccaagagcaagacattaaacttgacattgagttcaatgatccttcttttcaaagtagtagtagtggcttgatgggggatcttctcttcgaggctcaggcaatggcttcgggcaagaactcaaagaaacgaggctacttgagtttgaatgagggaaataatgtgtttaatgcatgctga

SEQ ID NO: 60988 - DNA, 387 bp, Glycine max
  Peptide Sequence Number=SeqID_152673
atgggaaactgcttgaagaaccaatcacccacaaagtacgatggtggtagcgacgatgacaacgacgattgggattttctgacaggtgaggaggggtcttttgtcaccaccaaggccgccaccgctgccaaaacggtgacggaggtgaagatcaagatcacgaagaagcagctagaggagttgttgagcaaagtggacgtgagggagttgagggtggagcaggttttgtcccagttgatgaaccatagtagtggagggttccaatcatttcaaagaccatggaggcctgcacttcagagcatccctgaggttgtgttagtggttattgagtgcatgatggagttgatgatgatgaaaaagagaattggcctacttggtcaatcctga

SEQ ID NO: 60989 - DNA, 327 bp, Glycine max
  Peptide Sequence Number=SeqID_152674
atggatagctcaaaagcctctgaattggcaatggatttccctcaatatcgtcgatcccaattgagtagcaacacttaccatgctctcattcacctcctctctcacatttctgcgtacaacgcttcaattcaacccctcaacattcccgtgttgttaattagcggaacgaacgctatagatgtagtagcgggtttcgccgttaatgcgattgcgacggcgccgtgttgcggaggcgcgtgggcgtttagggttagtgtggtttgggtcttcgggtctccgtgcaaagtagcccttatgtggagaatgtgtttgaaattgccaaagtag

SEQ ID NO: 60990 - DNA, 1677 bp, Glycine max
  Peptide Sequence Number=SeqID_152675
atggccacgttagccattgccgttctcactctcactactcgcttttcttcttcttcatcaccttattattccaacttcttcttcactcgctccttcaaccatttcaccacaaacaactgcaaaagggcaatggcttcttcagcagccaccaccatcccttcactttctgagagaatcaccgcaccatatggctcctggaagtcccccatcaccactgacgtcgtctccggtgcctccaagaggcttggcggcaccgccgtcgacggccgcggccgccttatttggctggaatcacggccagcagaatcgggacggggggttcttgttgttgagccggaaaatccaggaggtgaggctgtggacattactcctaaggagtttggagttagaacagtggctcaggagtatggaggtggtgctttcacagtttcaggcgatgttgttttctttgcaaattacaaagatcagagattgtacaagcaatccatcagttctcttgatgtgcctcccatacctctcactccagactatggtggcccagtagtcagctatgctgatggaatattggacgtacgctttaaccgttttattagtgtaagggaagatcgttgcgagagcagtcaaaatccaactacaactattgtatctatagcacttggcagtaaggatgctcaggaaccacaagtactagttggcgggagtgatttctatgctttcccgcgtcttgatccaaaaagtgaaagaatggcttggattcagtggagtcatcccaacatgccgtgggataaatcagaactatgggttggctatatttctgaaaacggagagatctacaagcgggtatgtgttgccgggaataatccttcacttgtggagtctccaactgagcccaagtggtcttctgatggagagctgtttttcatcacggatagggaaaatggtttctggaatctccataaatggattgagtctgagaataaggtcttgcctgtttattctttggaagctgagtttgcaaggccactgtggatttttggtatgaattcttatgaatttcttcaaagtcatacacggaaaaacttaattgcttgcagttacaggcagcaggggaagtcatatcttggaattattgatgatgtgaagggctcaaaattaactgtgctggatatccctttcacagatatagataacattacttctagtaataattacctttttgtggagggagcatctgccgttcatccatcatcagtggccaaggtgactttagataatgataaatcaaaagcagttgacttcaacattatttggtcctcctctcctgatagtttgaagtatagttcttacttcagtaaacctgagttgattgaattcccaactgaagttcctggtcaaaatgcttatgcatacttttatccaccaactaatcctgatttccaagctagtgaagaagaaaagcctccattattattgaagagccacggtaaatctggtgtgggaacaacaagatcaaatcctcctcacatggctgctgtcgatgctctcgaagtcgatcttatcacgctgtttggaagcatccacttgtatcaagatagatcaatgtgtgcttttcttcttaaggttcaagagattgcagatgtgttagtgtcagttggaagcttgatttctcctcaataa

SEQ ID NO: 60991 - DNA, 267 bp, Glycine max
  Peptide Sequence Number=SeqID_152676
atgagaaagagaaccagtgaaccacacaaacagaaccacagacacagaggaacaaaacagagagtcagagatgaccttggatgtggccaagaagtgctctggactctggacatggtgaaaaaaagctctggtcacagtggtttctgcagcagttttgggcatggtttagagaggatgcagaatttgtgcgaggttgaagaacacgcagcaatgcctgctaagcagacaacggtgattctgagcatggatgaacatgcccaggcataa

SEQ ID NO: 60992 - DNA, 183 bp, Glycine max
  Peptide Sequence Number=SeqID_152677
atggctttgttcagggtgctaccttgtttgtctgatgggctggtgttgtattttgttccaatcgtggttttcatggtgtttgcgaggtttaatgggaagattgttgtgaagaatttgaagagtggatacgattctatggttgaagatcaagtttatgtcagtgggactattgctaattggtaa

SEQ ID NO: 60993 - DNA, 1872 bp, Glycine max
  Peptide Sequence Number=SeqID_152678
ggtccttgcttcactcgtggcggccttggtggttttgtttatgaccaaaagcgtggctccaatccctttgatgttaaagtcacctacacattactatatggtgctgtggccttagatctcgtgtccgcgttcatgctcattttttctgaccactcatttgcattaatttaccctcacatctctaaaaaaattagtgattctgatggtggcaaagaaacatccaaattagcctctattttaagttgtttcctcaagcttaagagaccgaaatggagagaacagaagcttaaggagccaaaatggcttcaaaataagagctataagatattgtgtaggttcatgttagttcgtagatggtctgagtccatttcggggttcaacttggtatcgtattgcctacataagaggaaactacgtttggtggataataaggtgatcgagtacattggattcaaagagccgttagaacaatggttatgtgagaagaagcagccattgctccaaaagctttggatttttatatttaccgagctggaaagaaaatcttcggacgcagatgatgttgaaactattcaaagaatatgctcttcaagaggtgagtgggttctccaagaaggcgagttaccgcgaaaggatctaaacaagttgatgtcttatgtggagcgcaacgaagttacctttgatcagtgtcttattctttggcacattgccactgacctcttgttctatgcagataaagatgaagaggatgagagaaaaaagaaacaacatgatgacgccaaaaaaaatgatgctctggatctcaagaaaggacctataagtggtgatgggcaaaaccataatgaaaatgatgatgctcaagatctggagaaaggaattattgataagaggcagaaaaataatgaaattgctccggatgatcatgtgaagaaagaaagttctgaagggcaaaaaaagaatgaaattgctccagatgatgtgaacaaaggaagtgctgaagggaaaaaaaagaatgaaaatgctggacataaagatgaccttgttaaaaatgattttggagatgttgatgagctcagggattttagtaagctactgtcggattacttgttgtaccttgtaatcatgcaacctaacatgatgtctgctgttaggggaattgcacagataaggttccaagacacgtgtgctgaggccactaacttctttagcaagaggcaaatgatggcagaaggagaaagaaaaatggaagcacaggggaaaaaaagaaagagagacgaagaaaaagcacttcaaaaatcaaacaccatgaggctcccaccggatcagcgtattgctctgcaggcaaaggacatgtgcaagacactttatgatggattcattgggttctttaaaaaggtgtttaacagcattagctgtcgtcgaaactttttccaagttaaagaagagaatggaacagaaaagagtgacgagcaggaggcatgcatgagactccgtgaagtgtgtgttgatcatgaaccctcagctgtgaagggagataggagtaaatctttgttatttgatgcctgtaaactggccagtgttatagacggtttaagattagaagagccagacaaatggaaaaaggcagacaaatggaaaatgatagcacaagtatgggtggagttattgtcatatgcagcagctaattgcatacccattacccatgtccaacaacttagtaaaggtggagagttcctttcccttgtttggctattgatgactcatttaggccttgccaagcagtttcaaatcaaggaaggccatgcgagggcaaaattgatagtaggtgaagaagaacagattgaacaaaacttagctaaaactaaacaataa

SEQ ID NO: 60994 - DNA, 717 bp, Glycine max
  Peptide Sequence Number=SeqID_152679
atgagaagaagaccaggaattggagggttgcagacgcacgccgctgcaagagatcaattccgtttgcttggtgaaaatgtcgcaaagatcagaactgatttgatgaaggagcagcttgccacctttcgctctcagctcgaagatttcgctcgcaaacacaagaatgacatccgcaagaacccttcattcagatcacagtttcatgagatgtgtgctaaagttggagtagaccccttggcctcaaacaagggtttctggtcagagctgttaggacttggtgacttctattatgaactcgcccacaatggaggactgatcgacctgcacgaactctgcagtctccttcgccagagacgaaaaagtgatcgtgaagttgtttctgaggatgattgtctgcgtgctattaagaagctgaaggtgctgggtagtggttttgaagttatttctgttggaaagaaaaaacttgttcgttcagttccaaccgagttaaacaaagaccacaatgaaattctagaacttgcccaggctcaaggatttgtgactgtagatgaagtagagaggcggttgtcatggagttctggccgtgccatcgatgcccttgatacattactcgatgaaggacttgcaatgattgatgatggccatagagatggtagacggcggtactggtttccttgcgtgtctcccatctcatcttcaataggagttgattcctaa

SEQ ID NO: 60995 - DNA, 756 bp, Glycine max
  Peptide Sequence Number=SeqID_152680
atggatgcttttgtcaatagtgggagtgaagttgagcatgaagcattccttgcaacttggttgtcaatgattggtttttcttccaaaggtttggtgagtacgttggttttccctatagctgttcatcttgctagagggaatcccattgctttgggaccagcagttttggccagcatatataaggatttgactttgttgaagaactcaatagtcggtatgacaaaacaactagtacttggtgataaattggaattggaggttactcttcagtcacctttttacttggtccaaatttgggtttgggagaggttcaagaatttgcaaccacagcccaggttgatcaaccatgaagatcctatgatgtttaggtggcacaaggttaaggccttgaaaattgacaatgtgagattggcactagagtcggctatggagcatttttgttggcgcccttatgttcaatatgccgatttggataaagaacctacgggactactagtatcttttgctacatgcttgagagtttctctgcttgttggtattcagtctactataaagaagtacctgccacatagagttgctatgcaatttggaatggatcaagatgttccaagttgcttgcctagatttgatgggactaaagactttgcttggaaaaattactgcaggcccatatctgataggagtttgtattttcctgctaggctttttgagggtgatattaccacacgttatgcaaagtgtggaagcgatctctaa

SEQ ID NO: 60996 - DNA, 915 bp, Glycine max
  Peptide Sequence Number=SeqID_152681
atggcgttgccgtcgacggtggcgacagtgatggcatggggagggttaggtgtttggttaaaggttacacagtcttctccaacgatgtcgtttaatgggaaacgacttgtcgtggatgagatagatttcttcgcagagaagaagaagaagaagaaaagtgaagttgatgatcaaatggtgcatcaccaaatggagcttcctaatactagtttagatctccttattacaaatagtacttcaacgagcaatagatcaaatatggaagaagaactgtccgaggcaaaggataataccagaaataaggagatgaatgctgaaaatcaacgcttgagagagctggttcataatctgaataataagtacaatgccctgcacaaggatcttatgaaacttacgcataaacaacatgaaaatgagattaatggagccataaaggagaatgataagagagatgatatgattattccaaggtctttgttggatattggaattgctacaaaggaagatccttcacagcaacattattcagaacgaaaactgcaagaaagcaaaaacattattgacaagttggattctggaaaggatagtgaaaaatctatggtagatcagcatgagagtccagctgatcacaaagctctttgggggtggatctcaactgaagcaacaagattgagttctttgagggatgttgatcaagcatcagaaaccatgtcaatgatcaagaaagctcgtgtatcagttcgtgcaagaacagattcatctatgtgctctgagactcggtatgtcttttttccttggcttgaccctctttttatagttgctggagtggacttggactacgtacttgcgctaagcctgcgctactcgcttaacgcgggtgcttgtattcacgctaagtttgtgttgctcgcttag

SEQ ID NO: 60997 - DNA, 480 bp, Glycine max
  Peptide Sequence Number=SeqID_152682
atggggttcctaaaagcaatattcgtcatagcaataaccatggctttgtccatcgcactaacgatgaaaaccatcactcatcaagaggaagcaaaaccagcttttgtgcaccatgattttccctcatcatcatcaacccctcatgatcaaaagaataataatgtgcatcttccttccaagagggtgagtcgcttcctcgctcaagtgaaaaaccctaatgctgctgatcactgccacaaggaccacgaggtttgcaccttggtgggtgccaagaactcaacatgttgcaacaacaagtgcattgatgtagggtatgactaccacaactgtggcgcgtgcaagatgaagtgcaagttaactgatgcatgttgtagaggggaatgtgttaataccaactttgacaagaggcattgcggggagtgtaaccatcggtgtgaagtgggtgcatattgtgtctatggaatgtgcggttacgcctaa

SEQ ID NO: 60998 - DNA, 420 bp, Glycine max
  Peptide Sequence Number=SeqID_152683
atggatagggatacactagggtatagtaggcgaagaggagtgaagggctcacccttacaaccaacaactttaaggttcaggagatgtagaggaagtcgcaccctctgcgagcttggcatagtagatagacaaaaagagtatggtcgtgttgggatacacatacgtcactttacacgtatcacactctggtgcacatggtgccaacagatagaacaaatgctacgcccatcaccatcaaacactctagatactgctacattcctcggagatttatgtcttgtctgcaactggagtggtttgaagacattaattttttatctaggcatgaaagtgtctcacgatactcaagaattcataatgaccccagtgaggtttgatgcaagaggtaatgtcctaaattggagattcgagttggcgtaa

SEQ ID NO: 60999 - DNA, 1095 bp, Glycine max
  Peptide Sequence Number=SeqID_152684
atggatggcattacccacatgaagaatggagcacatgggtccatcaaaatccaacacaagtatgaagatgtgtggatgaaagctgggatagaccaagcaatcaaagctttaacttttcaaatccgtaggaatgatgagttgatcattgagcttgcacaaaggtggtgctcaaagaccaatgcgtttgtgtttccatggggagaagcaactataatattggaggaaatgaaggtttgttggcggtattttgttaagggagcacctatttctagccctcttgtgagtaatgcggaaaaggaaatagaacaagaacttatccgtgcttttaggatgtttttcaaatctaaggccaaaagggctgatcataatccacggatgaagcacttcatgagtaatgagagcctagtggagcatgaggccatcttatcatatagaacaattttgataagtgtttctcctattgccatacatttggcaagagggactaagctaggtcttgctattgctgtcttagccagcatctacagggatttgagtttgttgaataacaaaattagaattgtggcgacagtggagttggaagttacattgtgggctccttttcagttgaaaggtgacaacttgaaactgattttggactctgttagagctggaaatggatacatttggcgcccatatgataattctccagctctccagctttacaatgaaaatgacaagtggtcagccagtaatggatacaaatttgtacactgcattatgtgcctgcattatgtggaagcaatcaaatccaaggaaagagacatgcatgatcattattttgaaaggagctcagaacatttgttaccgacatcatcatctgtgaagaaagagagcggaggattttatggcccaccacctagttttacttccaagattaacacagaacaagaggattttgatgaagagggaaaagtgtcaattattcaattatctgattcttctgatgagttagatgtcttggtgaggaagaagttggaaatggcaaggctttgtctagtcctctattggatgtttttccatcagcaagtgttgaaggagcaatacgtgtgttag

SEQ ID NO: 61000 - DNA, 223 bp, Glycine max
  Peptide Sequence Number=SeqID_152685
atgatgcttacctctgtgtcagtgtatgagcatggaactgattcagttataccatcagaaaatttgaatgaaattgaatcttctacagttgagctttgctggagaagacaatcagggctcactggaagtagaggaaatattcaaatcattcacatgatccttgatcacaatgaattacaacttgctatggtcatcttcaatttcaagatgattatatcagcac

SEQ ID NO: 61001 - DNA, 1314 bp, Glycine max
  Peptide Sequence Number=SeqID_152686
atgttgagcattaagagggttcctactgtggtttcaaattatcaaaaagaagagacaggggaggctgctgctgccggtggatgtggtcgtaactgcctcaaaagttgttgcattcaaggttttggatttggctcacttgtgttttatgtggtgttttgtgggacagatgcgaggctgcctttgtatgctttcaagaggggtgagaaggttggtggaaaggagttgcctttgcttggatgcaagaagcaccctgtggactttctggactcgcttgtccttggagaggtgtggcattgtgttttgagttttttaaggcctgtcattatgtgggaagatcgcatgcagagagggcttttccgctatgatgttacaacatgtgaaaccaaggtgattcctgggaagtatggtttcattgctcagctgaatgagggtcgccacctcaagaagagaccaactgagttccgtgttgataaggtcctccaaccctttgatgaaaacaagtttaacttcactaaagttgggcaagaagaggtcctgtttcagcttgaggctagcaatgatggggaggctcaattctttcccaatgtgcctattgatgttgagaattctcctagttttgttgccatcaatgtgagtcctattgaatatgggcatgtgctgctgattccacagatttttgagtgtttacctcaaaggattgaccatgcaagcttcttgcttgcacttcaaatggccgctgaagctaggaatccatattttaggttgggttacaacagcttgggtgcatttgcaaccattaaccatctccactttcaggcatattacttggctctgccttttccaattgagaaggcccctactaagaaaattgccaagttaagcggtggagtgaaaatatctaaactgttaaactatcctgtcagaggccttgtctttgagggcggtcattctctagagggtttagcaaatgttgtttcagaagcctgcatctgccttcagctcaacaacataccttacaatatacttatttcagactgtggaaggcaaatctttctcttaccacagtgttatgcagagaaacaagcccttggagaagtgagtgccgagcttctggagacacaagtgaatcctgctgtgtgggaaatcagtggtcacttgagaggttccaagaaagtcactgctcttgtttttcaagccattgcatcggttgagatgaatgtcaagcctcaattacttgaggaagttgatgctgttagcccaagcactcagcgtgccatggtggctggttcacatgaatgccttgttctccagtaa

SEQ ID NO: 61002 - DNA, 1314 bp, Glycine max
  Peptide Sequence Number=SeqID_152687
atgggagactttagaaaatggagttctttgatgaggttggaaatggactttatttggatagatgttgatgagtatgagaaacacattactttggatcttgaagaatccatggtacccaacttcagttcattgttaaggaaggaatgtaacaatggtaacctgaaaaatgcattgattttggtggaagaaatgctttgctggggacaagaattgccattgcctgaatccttgaacttagtgagacaactttgttcatctaggtcacaaaccaagtcagtgaccaagctgttggagacaatgccaaagtctgcccataaacttgacccggaaactctcaatttggttgtacaggcatacagcaagaaaggattactattgtgcattgtggggagcataaggaaagctgacactctgttccgtaatatgttgtctaaagggttaagtccagatgatgaactgtgtaacatacttattcagggccattgccaagctaatgacttgagaaacgtgggggagctacttggcgttgcaataagaaagggttgggtgctaaccctcacaagttacaggaatttagtgcgattggtttgtatgaaaggtagagtccaattcacgctgagcttaaagaaccttatgcttgcactatgtccacttgattggcttatcatatataacattcttatgttctatcttttgtctgctggaaacagtttggatgttaataagatactaactgaaattgaagagaagaaagttgacttgatgaagttgggactcaaaccaagtaaccgcagcttgaggaaggtaataagcagcccgtgtgatgcgggagatctgcaaaaagccttggagttgagtcaagaaatgagattcagaggctggatacatgattctgccattcaaacatctattgttgaaagccttcttttgtgtggtaagcatggaagacttgacaaggcagttcatcttatgaacacaatgctgaagaaacataatatttcaatttccaccagttatgattttctcattcatgggttctgtgcacaaaataaactggacatagctttgaatttttattccgagacgttgaattggaatctcaaaccaataattgacacagtggaaatgcttgtccatagattctgccacgatgggaagacagaactagcagaacaatacctagtggacatgactcatgcaggtgaaactctaatcagaaaaatgtattgcactgtaattaagagttatgacatggaaaataatcttaggaaggcatcagagctcatgcaagccatgcaggaaagtggctattag

SEQ ID NO: 61003 - DNA, 63 bp, Glycine max
  Peptide Sequence Number=SeqID_152688
atggttatctttgttggagaacctaatacaccaaataaggttgtcaagcaactagctaattgg

SEQ ID NO: 61004 - DNA, 286 bp, Glycine max
  Peptide Sequence Number=SeqID_152689
ctgtgatcgagaaagtctcgcccaaagagctctacagtagtgccttgcggggtcgtagagccggtcaacgggagctaagatccgattcttgcattcatcttaactgcagatttctacttcttcttacccatagactgagaggctttggcagaattgatcgaacttcttgctctcagggtgcttcgcttgagctcaaccatccgggatgcttgttttctgaggatgattctttcgcggaaggacatgactacgttaaccagccgcaagggtgtgccgaaatggcaca

SEQ ID NO: 61005 - DNA, 321 bp, Glycine max
  Peptide Sequence Number=SeqID_152690
atgtctcctccacctctaggacctcacaatcactcacaaactcatctcaagcttacaggacagcttcctcttccagctctggtctctgtagatctttacacaacaaattctctcaaactctttggaacttggacctttctctctctagaactctccaattatgcagaaacttcaagaaaaggccaaactgccttcaaaaatatgattttaggattaaataggtggctttgttcatgctcattcttcctcgcgcttagccgaggaatgttgtgctcaacggatggctcgctaagccagcagattggcttagcgagagggtga

SEQ ID NO: 61006 - DNA, 840 bp, Glycine max
  Peptide Sequence Number=SeqID_152691
gcgagggcgtgcaaccctctgaaggttaggacgtgtagtcctctgaaggttagggcgtgtagccctctgatggcgaggacatgtagtcctctgaaggcgagggcgtgcagccctctgaaggttaggacgtgtagtcctctgatggtgagggcgtgcatccctctgatggcgagggcatgtagctctctgaaggcgagaacatatagtcctctaaaggtgagggggtgtagccctataaaggtgaggacatgtagtcctctaaaggttagagtttgtagccctctgatggtgaggacgtgtagtcctcttaaggccagggcgtccaaccctctcctggcgaggacgtgtagtcctcagaaggtgagggcgtgtagccctttgaaggcgaggacgtgtagtcctctaaaggtgagggcgtgcatcccacttaaggtgagggcgtgtagtcctcttaaggtgaggatgtgtagccctctgatggcgaggacgtgtagtcctctaatggcgagggcgtccagccctctgatggcgaggacatgtagtcctctgaaggtgagggcgtgtagccctctaaaggcgagagcgtgtagtcctctgaaggtgagggcgtgcagccctctaatggtgagcgagtgtagccttctgatggcgagaacgcgtagtcctctaaaggcgaaggcgtgcagctctctgaagatgaggacttgtagtccacgaaaggtgaagacgtccagccttctaatggcgagggcgcgcatccctctgaaagtgaggacatgtagtcctctaaaggttagggcgtgtagccctctaaaggtgaggacgcgtagccctttgaag

SEQ ID NO: 61007 - DNA, 81 bp, Glycine max
  Peptide Sequence Number=SeqID_152692
atgtctggaacaccacaacaaaatggtgtatcagaaagggtttctagtaaggcagttccaaagacaccttttgaactatga

SEQ ID NO: 61008 - DNA, 588 bp, Glycine max
  Peptide Sequence Number=SeqID_152693
taccctggtcttcagaggactacactcctcgccaacagagggctgcacgccctcaccttaagagggctgtgtgtccttactttcagaggactgcatgtcctcaccttcagagggctacacgccctcgccatcagaggaatgcgtgtcctcaccttcagagggctacacgccctcgccatcagaggactacatgtcctcaccttcagagggttacacgccctcgccatcagagtactgcatgtccccaccttcgtagggctacacgccctcacctttagaggactacacgtcctcgccaacagagggctgcacgccctcacctttagaggactacacatcctcgccttcagaggactccacgtccttaccttgagaggactacacgtcctcgccttgagaggactacacgtcctcgccttgagaggactacatgtcctcaccatcagagggctgcacgccctcacctctagaggactacacgtcctcgccttgagagggctacccgccctcgccttgggtactacttaccctcaccttcagaggactacatgtcctcaccttcgtagggctacatgccctcacctttag

SEQ ID NO: 61009 - DNA, 183 bp, Glycine max
  Peptide Sequence Number=SeqID_152694
atgttacggaactttacggattgcacattaacgctttctttcgactctcgacatgtcgcggaacttcacggattgcctaaggatgggtgtcaagtacctcgaagtggtcaagcgaaggtatccttgaagaagagttggtacacagatagtggatgctctaaacataggacaggagatgcatga

SEQ ID NO: 61010 - DNA, 324 bp, Glycine max
  Peptide Sequence Number=SeqID_152695
atggttagaaggctccttggagcacaagcctctgaggaggatttgattctgatgtgggcttttctcaccggtcatcagatatactgggcccatttggttcggtaccgaatgcttaaggcattatgggccaatgcacctctaccttacccacagttgataactttgtttctgcgtcattttcaaattccgcttgatgatgaaccatttgttcaagtcaaatgttcctttgcaattggtgttggtgcagtgacttcctttggataccgtaaggatcagaatggtcaatggctgaagaaagacgcactccctcctcaagatgagtga

SEQ ID NO: 61011 - DNA, 680 bp, Glycine max
  Peptide Sequence Number=SeqID_152696
tctatggattaccacctaattacacgccaccagtcatacatgatgacgcgggtcatatccctccccccatccttgaaggggagcctcctcgacagtcggacgaggttcacgaggatcgtcgagagcatgcccaaggagacatatatttctactccccggtccccgtcgaggggctggcacccaacacactacctcagcccaacctcacaggagaacctcgaaaccccccaacacagccaatacctttgtccgcaggagggccacccccggcagtagaagaaaagaggaaactcgatctcatcgaaaagagattgagggctgttgaaggctttggcgactatccgtttgcagacatgactaatctttgcttagtaccggacgtcatcatccctccgaaattcaaggaagcagagcaactggggcaaagaggaaggaaggagaaacccaagcaatcacttcaatgcttgcatggatcaagccgtcgcagatctcccacggtacccaccaatatgcgcaacatcacccgagcttctcagctcgcaccagggactcctccaactcagcacccgtacaacctagggcacccgcgcccatccagagggaggccccccaagctccggctcaaaccccgactcgcctggccggcaatgcccactttggcgtcggttccaacgcgataa

SEQ ID NO: 61012 - DNA, 276 bp, Glycine max
  Peptide Sequence Number=SeqID_152697
atggggggtgaacttagtaattggggtgcgcttagaaatcttcctcaagaagcctctaggcggcaagcacctccctttttccctataaataggggaggggggcttttcgaaatattttggaccccttggctatgcatgtcagttgttttgggtgaaaaaatgtgttttcgtgaagaaaatccaagccgaggtgcttccgtaagcgattctgtggaaatttttcatcgttctttaccgttcttcagtcttcaaccattttcttttcttccgctttaa

SEQ ID NO: 61013 - DNA, 433 bp, Glycine max
  Peptide Sequence Number=SeqID_152698
atgactcttgcaactttttttagaaagcttcatgaacacgaaatggaacttatgagactaaaccaacatgaagaaaatgacaagaaaaataaaggaattgaacttcaagcctcatcttctattcaagaagaaagtaacaaagaagacttaaatgaaatagaagaaaatgatgatttcagattttttgtgaagggattcaataaatttcttagaaacaaaggaaatcaaaggagatcaaacttcaattcaaagaagaaaagagaagattcctccttagttccaaaatgctatgaatgcgatctacctgggcacttgagatttgattgtcctatctttaaaagaagaatggaaaaatccgacaagaaaaatttcaaagataagaaagaagagaaagcatacatcacttgggaagatgatgacatggatttatcaa

SEQ ID NO: 61014 - DNA, 312 bp, Glycine max
  Peptide Sequence Number=SeqID_152699
atgtcaaatcataagagtactgagttagtactaaagaaccttgaggtccaggaggaatgcaaggctatgatgactaggagtaaaaagtttgtggaagctgaggatgaagagagtgtggtgtacaaggagcaaatgggtgaaaaggcaggtgctgaggttaaggaaaatgatgtgaaggataaagagaatcaggaaaaagggaagataataatggtccaaaataaagagatggagaaccaagaaaaagaaaaagaaggagaaaaagaaatagaaaatgagaaaaatgaaaaagaagaaaaaaataagatttaa

SEQ ID NO: 61015 - DNA, 117 bp, Glycine max
  Peptide Sequence Number=SeqID_152700
atgggtttgtcaggcttaaaggaacactcaaacccggtgacccccaagacctacactccgaagagtccatcagggcctctccctcctgattcaggtccaacccctaaaatcatttaa

SEQ ID NO: 61016 - DNA, 297 bp, Glycine max
  Peptide Sequence Number=SeqID_152701
atgggggttgcagtgaccatgatggatatccctggtgagggaaatagagtgtttctcgtgagggggaatacttgtacttgggggcatgtcactcggtttggaactcccttaagactcaagctgatcaccatgggggagggaattgcatgtgcacgacagggtgaccttgacacttattgcctagttttcctaagtgagagtgtcgtgtggacacgcttaagctatttcctgatgaatggtaccacattgcatttgagagttgaggtcagatgtatgcatcatgttgagcatgattga

SEQ ID NO: 61017 - DNA, 174 bp, Glycine max
  Peptide Sequence Number=SeqID_152702
gttaaaaagaggctaagtcatgatgtgctaaaagtgacagttgagctcagctcatcagttgggctaagcgtgcatccatcgctaagcgtagcttcagtgtgcttagcgcaacagaagaatatggcagagcatcaatatgaaggccccgcactaagcgcgagatcagtgcactaa

SEQ ID NO: 61018 - DNA, 429 bp, Glycine max
  Peptide Sequence Number=SeqID_152703
atgcaatcacagggacttgcactgcctccagagccagaggttggtccctcaggtcctcgtgtcagcacaaaggagagttgtgttgctccctcggggaacgatctagagacaggtgactcagacaaatgcgggctatacattgaagaaaatccttcccgcctggttgccataggaagactttatgagggatccacagcagttcacaacatccctttgttgcatggccaagtcaaggttggtgttgaggaggttaaagatgcaaaggctctcgttcttgtacccattgacgaggttaccttagtggggcagacacttaacattttccttgcttggctgacacatcttgtgaagcgtttatcaaaacagttgtgtctccagcaaaacctccagaaagcccggatcatgaggtcgatgatcccctgtacctga

SEQ ID NO: 61019 - DNA, 303 bp, Glycine max
  Peptide Sequence Number=SeqID_152704
atgccagcatctctctcagctgcaagaagatcaactgcattgccaagctccaactctgcttttagctttagtcggctgagcgactctcctcctggagttaggaatcggcaagagataagagggacgtacttaacagcaaggaagtggaatcaatcccgtttgctacaggattctttcgatctgtcgagatcgtctctttctcctatcccggtagacgggcgagcatctccgaaccttaagaaacctccctacccaaccttacctaaggtcgagcagtttgaaactccgatccctaacctaaag

SEQ ID NO: 61020 - DNA, 405 bp, Glycine max
  Peptide Sequence Number=SeqID_152705
atggctaaggtgggctttcggacttcacacatcgggtttatattaggagttgcctttgttaagaggacaagagggaatacttgcaaaataaaggactttgacactcaattttttaggtcgacaaggggtttgctcttgctcctatgtatctccagggaggaaaaaggagaattgagtgatcatttatttgagtatttttactgtcataccctaatttcgtccggggacctttgctcgatgacgtgcgaccattctttggtcctcgtgaggtgcttggcacccatcattaggcaatttgtgaaattccaggacatgccgaaaaaccaaaaaaatattgatgcacaatccgtaagtttccgtgacacaccggaaatcaaatggaagcatcgttgcataattaagtga

SEQ ID NO: 61021 - DNA, 375 bp, Glycine max
  Peptide Sequence Number=SeqID_152706
atgactagaggcaatccatttgacttacaaccctttgatcctgagatagataggacatttcatagattagttagacatcatttagtaccttttgagcatcctgagcattatagttttgaacattctgattttgaacattctgagaacatggcacaacctccaccccgtgagaggactctaagggaaatggttgcacctgatttcaaactggtccatttgcttccaaagtttcatggccttgcaggtgaagacccgcacaagcatcttaaagaattctatattgtctgctccaccatgaagccatcagatgtccaggaggatcacatatttctgaaggcttttcctcattctttagagggagtggaaaaggactag

SEQ ID NO: 61022 - DNA, 600 bp, Glycine max
  Peptide Sequence Number=SeqID_152707
atggaaagatttgaaaggaaaaccttccatgacaagaaagcaaagaaagcttacatcatttgggatgataacgatatggattcatccgaagactcagaaaatgaagtcgtgaatctaagtcttatggtaaaaaattatgaaagtgatgaagaggtaacatcttctaacaataacttacctatttcctttgatgaacttcaagatgcattcactgatttacataaagaatctgtcaaacttgcaaaactagtttctttttctaagaaaactatttcaaacttagaaaaggaagctttaaaattaaatgaagaattagaaaatcttagaactgaagtcaaaactttaaaaccaattgacacaaatcaatcttctaccataaaagtaatacatgatagtaaagaagcatctaattcatgtaaatgttgtagcaagtttatagaagaaatcaaagatttgaaaaattctcttgccaaatttactattggaaaaaataatttagatattatactaggaaagcaaggatgtgtgtctgataaggctgaattaggatatagacctgataaacagcaaaaatttctttggatgtactcaaaagaatag

SEQ ID NO: 61023 - DNA, 270 bp, Glycine max
  Peptide Sequence Number=SeqID_152708
atggcgcctaccaggcaccctatggacccggataagtccaacagggccctgggatttccagctttgatcataggactctgccagtcgttcgaagtccccgtcgcacctactaagcctcagcatgcagagtcaaggcttcactccttttccgtgccctactccagaccagttcagggcagaggtcgcatggcccggggattggcccgaggcccaagcaggggaggcacccgcaaaggctctcgacgatggagaggaggccggcatggatga

SEQ ID NO: 61024 - DNA, 309 bp, Glycine max
  Peptide Sequence Number=SeqID_152709
atgcaatctcagggacttgcactgcctccggagcctctagttggtccctcaggtcctcgagtaagcataaaggagagttgtgttgactcctcaggaaatgatcctgagacgggtgactcagacatgtgcgaattgtacatcgaagcaaatcctgcccgcttggttgccctgggaagagtttatgagggatccaatgttgttgataacactcctttgttgtctggccaagtaaaggtgggtgtggaggaggctaaagatcttgatgctccaattcctgtacccactgatgaggtttccttagtggggtag

SEQ ID NO: 61025 - DNA, 476 bp, Glycine max
  Peptide Sequence Number=SeqID_152710
aggtgaactctaaaggtggtggtggtgcgtctattgcctgctaccgaccatccccaggctgctgtggtgtttcgccctgcgcctgcctggagacgcagtacttcttgatgaaagctcgattactagggggcctgatgcccttgctggaggtgacaggactgatagaggcccgtaaccagagctggaaaccccagggccctgttggacttttcgggtctactagggggagattggcattgtggtcgttgggcagaatgttgctaaatagcaacatcattcatatccatgtaagagtggtcatattggtgcgcatgatccgcactcgtctctttgcagcggcacgggtgaaatcttgccccagtatgcatagtagatgcgtgatagcctccctctctggatatgctcgcacagttggtcgccctccaatatcagggggtggcccaggaactgataaaaggaaactactggccccttaa

SEQ ID NO: 61026 - DNA, 114 bp, Glycine max
  Peptide Sequence Number=SeqID_152711
atggagcatgaaacattccttgcaacttggttggcagagattgatttctctcccaatggcttggtgagtctactgaagaaaacaatagttagtttggctgatgataagaggtaa

SEQ ID NO: 61027 - DNA, 180 bp, Glycine max
  Peptide Sequence Number=SeqID_152712
atgattcacggtactgatcgaaaagaattccagccgacgtcggccaggaaagaacagaccgatcgaggtcggctagggtttttcgtgcgagctgaaccgagattgtgtttcggccgacactggcatgctctcatttactcggccgggaaaacattagcccacctcgtcagaaaaatgtga

SEQ ID NO: 61028 - DNA, 131 bp, Glycine max
  Peptide Sequence Number=SeqID_152713
atggcggaaccatcaaagaagagaaagggtacttcgagtcggagtcaacggtattccgagacacaggaaatgccgattccttcctctattccctctgcctcattgttttcatccgaagaacagcggatacg

SEQ ID NO: 61029 - DNA, 327 bp, Glycine max
  Peptide Sequence Number=SeqID_152714
atggctctggagcggacatggatgcctcgtgtcttgctggaacagttaaatgtgtcaaataaatctgccaagacagctaccaccggactttccttgctatggtggtacttccgtggtaggcccgctatgccgtttcgagactgttttatgcggtccaaccctctggctgaatccttgaccacagttgcaattctactcaaagaggggagacacccggaggaaaggtatggttttcttcccccgagaggacatcctagaatttcctcaaattcttcaatggttggtaccaattggaagtctccgaacgtgaagcatctcaaaggctaa

SEQ ID NO: 61030 - DNA, 159 bp, Glycine max
  Peptide Sequence Number=SeqID_152715
atgccgatctccacgtgcggaagtatcagttgggatcgcacccctagtggacccggagaagtccaacagggtcctggggtttctagctctgattacgggcctttgtcagttctacggagtgcccgtcgcccccaacaaggtcatcaggccccctattaa

SEQ ID NO: 61031 - DNA, 465 bp, Glycine max
  Peptide Sequence Number=SeqID_152716
atgactagaggcaatccatctgacttacaaccctttgatcctgagatagataggacatttcatagattacttaggcatcattttataccttttgagcatcctgagcattctgttactagtgaatttgtgcattctgttattggtgattttgaacatcctgattttgagcattataattttgaacattctgagaacaaggcacaacctccaccctatgagaggactctaagggaaatggttgcacctgatttcacctatgaaagcttgtgcatccaataccctgatgaggatgtcccatatgttcttaaaactggactaatccatttgcttccaaagtttcatggccttgcaggactcagtaacatggagagaagtatgatagatgctgccagtggtggagcccttggagacatgacccctgctgaagccagaaatttaattgagaagatggcttccaactcctaa

SEQ ID NO: 61032 - DNA, 501 bp, Glycine max
  Peptide Sequence Number=SeqID_152717
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcccccgtccttatgcctcccatggctcacgtggattgctggaagttggttttggtttgctgcccacagacagtcattttgaggcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 61033 - DNA, 753 bp, Glycine max
  Peptide Sequence Number=SeqID_152718
atgatgctgctgcattcgccggagcaggagcaaatcctgaaaaccgggacgcgaattttgctggcggttgagccgccggaagtattggcacgaatgttgcccactgaagaggacaagtcgcgcgtgctggccgcggcggcagtgctggaaaaagcgcgcatgatgacggtgaagtcgccggccggcagtgattttcgcgccccgctcggccagtaccccacggtaacggaatatggctacgcggatgagccgggccgctgggatcactggccgagcggcttcctgttcacctggccgaatgaagagcaggctgaaggcgtgctggtgctggacgtcggcgacatcctgctgccgtttaaatcttacgcgcgtgaacgcatcacgctggagatcgagaaaggttttgtcacccgcattcacggtggctttgaagccgagtatctgcgcgattacatgcgctacttcaacgacccggaagtgtacggtatttcccacatcggctgggggctacagccgcgcgcacagtggacggcgatgggattacacgacaaaaacgacggcatgtgtatggacgcgcgcgccttttacggcaacttcctgttttcgaccggaccgaacaccgaagtgggcggtaagcgcaaaacgccgtgccatatggacattgctctgcgccgctgcgacatcaaagtggacgatttgctggtggtggcggaaggtgaagtggtggcaccggaggcctcacgcgcgcgttaa

SEQ ID NO: 61034 - DNA, 240 bp, Glycine max
  Peptide Sequence Number=SeqID_152719
atggaggaaaaagaacaaaagggaagtcatagtaaggaaagcacactgattgattggcctaactctctaacaatcgtccccagtggagtcgccaattgttgcaacctacccttcggcgggagggcgacgcgagggctcatgggtgcgtcttccaagaaaggaaaatgtgcggagtcgccaccaatgtttattcaaggaaaacgtcgaaaaaatcggaaaggtgtggtctacgaactttaa

SEQ ID NO: 61035 - DNA, 150 bp, Glycine max
  Peptide Sequence Number=SeqID_152720
aatgtcacagaactttacggattgcgcaataatgttctttcaactcctgacatgtcgcgaaacttcacggattgcctaacgatgagcgtcaaggatctcgaagtgatcaagagagggtcgcatcccaacaaacagatggtccccgaatga

SEQ ID NO: 61036 - DNA, 390 bp, Glycine max
  Peptide Sequence Number=SeqID_152721
atgactgataaaaccacgggaaaagcaattgagctggataccccgctgctgcgcggcaaaaccgaaatcacccacatcaccgtccgcaagccgcagtccggcgctatgcgcggcacccgcctgcaggcgctgatggatatggacgtcaacgcaatgatgcgaaatggacccggccgacctgctgtcgctctccgtcgaggtggtcacttttttgttgccgaagtcggcgctgtcagctttcccgacggcctgacggtagaggatctggtagcggacatcgctaccgtttttcactggccgccgccggtcatgtacgcggagtcgctgacggacgtgcaggagtggcggcacaaagcaattcagcgaagcggagccggcgacgatgagtga

SEQ ID NO: 61037 - DNA, 399 bp, Glycine max
  Peptide Sequence Number=SeqID_152722
atggtgaggttgcatactaatttctttaccagaattaaagagtggtgtattccgaaaaataacgaagcttgtggagtaccggaagtttcggttttaacaacaaaaactcttatcagttcgccctcaaataagtcgtacggctggaatataaactcttttccaatagctttaatatcctcttctgacctcacctatagcactccggaaactatgatccctgaaacatccagtaaaatagaagttttcaaattgtcagcagaaaccgctgtacctatgctttctgatgagaaatcaagcctcatttttttgttgttaacacctcctgcatcatcaaaacttcccataaaattaaagcatatgctcggatccgatgaggatttacttttttcattcaggtag

SEQ ID NO: 61038 - DNA, 87 bp, Glycine max
  Peptide Sequence Number=SeqID_152723
atgcgtcctccaccatcaagcgcggagcctccggtgattgggaaatgtgagaaagaagaaggagagatggaagtcgtcatagactaa

SEQ ID NO: 61039 - DNA, 123 bp, Glycine max
  Peptide Sequence Number=SeqID_152724
atgtggagcttatcaatgacagcagaatggagaaggaaaaaagatgattggagatgccacttcaagaagaagatgagtcaagaacaagctcaccatcataggaagccatggacaagagcttga

SEQ ID NO: 61040 - DNA, 579 bp, Glycine max
  Peptide Sequence Number=SeqID_152725
gttatgtgggatgcttccctattcaggctgcttaattcagacttccccttgtacataaagcatgaagatctgtctgaaatagcccacggtggtcaatgtctcagcatctctgttatacagttgtggattatgcatctgactgagacaagtatgcgattggggaattccaatgtttatggattactcgagccacagtccatccagagatttgggcaatcgcagtttgaatcagaaagttacatgaagaattggatgcagagttcaaaacgggatgtctacctgggagcctacctgaatggtgcacactggcaaatggtcgtcattttgtctaagaaaagtcttgttgtctggttttattccttgcatcataggccagacaattatctgaaaggaataattaacagtgctttgaaaggagttgatggtactccacaacctaaatccaaggctgccgtaggtgctaggtggattgttgttaaatgtaataaacaaaaaggaagcactaagtgtggctattacgtgatacactggctgtcaactataatctcaggaagtttcaggaataatgggaaatggtaa

SEQ ID NO: 61041 - DNA, 735 bp, Glycine max
  Peptide Sequence Number=SeqID_152726
atggaaaccgatcatccgcgttataccctgcgcggcatcgatttacacgctttcgccgatatggcgagctttcttcactttctgctgccggacggcaagccgcgcagcggcacgctggtggcgatcaacgccgaaaagatgctgacgctggaagaggatgcccagctgcgcgcgctgatcgccgccgcggagatcaaatacccggacggcatcagcattgtgcgttcgctgcgaaaaaaatacccgcagctgacggtgaaccgcatcgccggcgccgatctgtgggaagcgctgatggaacaggcgggccgcagcggtattccggtgtttttaatcggcgggcgtgagcaggtgctgcaggaaacctgcgataaattacgccgtcagtggaatgtcaacatcgtgggcagccagaacggctacttcgctccagccgaacgcgaggcgctatttgcacgcattgccgccagcggggcgcagattgtgaccgtggcgcagggatcgccgcgccaggagctgctgatgcgcgactgtcgcgaacactggccgcacgcgctgtatatgggcgtcggcggcacctatgatgtctttaccggccacgtcacgcgtgcgccgcgcatctggcagcaattagggctggagtggctgtatcgcctgatacgtcagccatcacgctggcgtcgtcagttaaagctgctgaaatatttacgctatcactggcgcggcgatctgtaa

SEQ ID NO: 61042 - DNA, 777 bp, Glycine max
  Peptide Sequence Number=SeqID_152727
atgcccgaggccgagctcaagcagtcggagttcttccgcaatttcctggagccggtggatgtgtttcacatcctgggggtggacatcaacaccaacgacggcgcccagtgccgcctgcgtatcagccgcgggcgtgacgatgcgcccttcgtcgaatcggaaaaacacctgctggcgcggttcatcccgcacctggaacgttcgatcaagctgcacatgcagctcaaccgcatcgagactgaacgcaacctgtatgccggcgccgtggaccagatggccgtgggcacgatcatcctcgacgacaccggcaaggtgctgcagaccaaccaggtggccgagcgcctgctgcaggaaaaggacggcatcaagcaggccatgctctcgcagaagggcaacctggcgtcggtggtcgaggccatgcgcgtcaagcgcccctccgggcgtgccgacctgggcatcatcgtgcgttcagtaccgctgtcggcctggagcgagggcaaacaatgcccgaccgtggtcattttcatcagcgacccggagcagcaatcctcggcgccccaggagatcgtccgcgccctgttcgacttcaccccggccgaaacccagttggcgatgctgctggccaacggcctgaccctcgacgaagcctccgaggagctgggcatcagccgcaatacctcgcgtgcgcatctgcgctcgaccttctccaagaccggcgtcacacgccagaccatgctcgtgcggttgatcctgcgcagcgtcgccaccttgggctga

SEQ ID NO: 61043 - DNA, 351 bp, Glycine max
  Peptide Sequence Number=SeqID_152728
atgccgctgcaaagagacgagtgtggatcatggatcgcgcccgcaagacacccagtggacccggagacgtccaacagggccctagggtttccagctcgggttacaggcctctgtaaatcctacaggacgcccgtccccccatcaagttcatgccatcgtgacctagggatcgtgcccgcaaaacactctgtggacccgaagaaggccaataggttctacggagtgcccgttgcccccaacaaggtcattaggtcccacattaaccgggctttcatcaagaagtactgcgcccccaggcaggcgcatggtgaaacaccacacagcattgggatggccggtagtgggcaatag

SEQ ID NO: 61044 - DNA, 393 bp, Glycine max
  Peptide Sequence Number=SeqID_152729
atgatggtggcccgggtgatgttggggaatggttacgagcccggaatgggtttaggcaagaacaacggcgatagaaccagcctgataagcaccagaggaaaccgtgggaagtttgggttaggctataaacccacacaagtggacataaggaaaagtgttgcgggaaggaagagcggaagccaaggctcgcaattgggacgaaaaatcgaagagggcccaccctgccacatcaataggagctttataagcgcgggtctaggacacgaaggccaagtcgttgcgatatgcgaggatgactctccgaatgggtcagatctggtacgaccatgtcctcctagttttcgactaggaaatttacgcgacaagcataatgtaaccctttgtggcttttaa

SEQ ID NO: 61045 - DNA, 489 bp, Glycine max
  Peptide Sequence Number=SeqID_152730
atgtgggcttttcataaaggcctacaaattgattgggcatacttagttcgatatcgcatgcataaggcattgcaattaaatgctccattgccatatccacacctagtcacccttttccttcaacactttaacatccctcttgattctgaaccttatgttccaatcaagagatcctttctaataggctttgctgtcattggatcctttggttatcaaaaagagcatgatggctcttgggtgaaaaatggtgctcgacccgttgatgaagaaggacatttacatggtggagaagattcctctcttcttcaaaagattttggataggttcgatggtcttcaaacctttgttggtgaaaggtttgatactttggagttacaagtggacatgcgcttcaatgagatgaagtcaagaatcaccaaggtcgaagaagatgtttctcacattcgtacaagctttgatctaccaccaccactgccaccatcatcttag

SEQ ID NO: 61046 - DNA, 400 bp, Glycine max
  Peptide Sequence Number=SeqID_152731
atggggaaccagccaagaccaaactttaatgcaggtggatattttggatttcaacatggccagcaatataatcagcaacagggacaatggagaactcaccctggtaatcaattcaataaagaccagagtgggccatctaacagaccacaacaacaagggcctagtctctatgacagaacgatgaatctggaagagactcttgctcagttcatgcaagtctccatgtccaatcaaaagagcacagagtcaaccatcaagaatctagaagtccaggtgggacaattggcaaaacaactggtagaccgaccgtcaagtagctttggagccaacacagagaagaatccgaaagaggagtgcaaggatgttatgactagaagcaaaatggtgagcatgagtgaag

SEQ ID NO: 61047 - DNA, 271 bp, Glycine max
  Peptide Sequence Number=SeqID_152732
ggaagatgaaggtcccacagctcaggtacctcaacatgtggaggatgagtcatctgaggccaccaactcggagccatttgttataggagaagaggcagaggagacacagctggcaacaaacccctccactcctcttctagagatgccaaaggaccctactacaccagtcctggctatggacacttctcctccagctactccaatattgcatctgatagatgaggaggatgttcagacacaggacacccaggaccagtcacaggaattttga

SEQ ID NO: 61048 - DNA, 1095 bp, Glycine max
  Peptide Sequence Number=SeqID_152733
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 61049 - DNA, 405 bp, Glycine max
  Peptide Sequence Number=SeqID_152734
gttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtatgccaagatatcagcagaaagggaagcaagggaaagggtaattgattcattgcaccaagaggcaacaatgtggacggaccgatttgctcttaatggggcaaagcagtggcggacacctactccgcccccgaggagatccacggacttctcagctatt

SEQ ID NO: 61050 - DNA, 360 bp, Glycine max
  Peptide Sequence Number=SeqID_152735
atgggggagacacatgaaatgccccaccacaatctagccgacttcgagccttgcctcggatatgccactgaagggcaagcagttagtgatatacccctgcaaaacactttggagggccctcagtatcacccacaaccacacgtcttgcattccacaacgggtacaaaccctcatgttatggcagaaattggaaagttggatcgtctagaggaaaggctcagggtcattgaagtatgtgaagattatgcctttgctaacctagaagagttgttggactttgacaagtacaagggaactacttgccctaagaaccatctaaagatgtattgtcggaagatgggggcatacgcaaaaagatga

SEQ ID NO: 61051 - DNA, 471 bp, Glycine max
  Peptide Sequence Number=SeqID_152736
atgactaggggaaatctaggtgatttacaaccctttgatcctgaaatagatagaacctttcatagattagttaggcatagtgtgtatcctgatcattctgtgcattttgagcattgtgagcatttggagcattctgagtattctattgcgagtgattctgaatattctaattttgagcattcgactactaatttttgtactgagaacatggctcaacttccacctcgtgagagggctcttaggatgatggctgcacctgatttcacttatgaaagcttgtgcattcaatatcctgatgagggtgttccatatgttctcaagactggactaatacatttgctgcccaagtttcatggtcttgcaggtgaagatcctcataagcatcttaaggagttccatattgtttgttccaccatgaagccccctgatgtccaggaagatcatatctttatgaaaaagaggatgagatag

SEQ ID NO: 61052 - DNA, 321 bp, Glycine max
  Peptide Sequence Number=SeqID_152737
atggagggtacatccactaggttgttcaaagagaacaagggagggtacatcccttgtggatctttgcttgtaaaggaattttacaaggttgaaaagaaatctcaaggaccgcaggtcgcttggggactggatgtaggcacgagttgttgccgaactacattatctgtagaagcaagcttcatgatgatgaaccaagcaattttgatgatgccaaaagcccaagtaattgattcaagacttcaagatcaagcatcaagaatccaatccaagattcaagagaagaaatcaagaagcaaaaagtcacgacttcatatagtataa

SEQ ID NO: 61053 - DNA, 447 bp, Glycine max
  Peptide Sequence Number=SeqID_152738
ggccgtacaatgctcaatggaacatcccagaacttctccatgacaagcacacattgcgttcgagtcgtatcctcggagaaatggaggttggggaaccttggttggggttatggctactgtcataccctaatttcgtccggggaccatccgatgttgggatgcgaccctcgtttgaccacttcgaggtatttggcacccatcgttaggcaatttgtgaagttccgagacatgccggaagccaaaagaaaagcgttgctcactagggccttcctggatgttcctccagaaggcggttgcttcgggaggaagcaacctagctcgcctgggcgagctggaaaatccaagctgaagcgcttccgtaacgttttcgtgggtgatttcgcgaagattttcaactgttcttcgacgttcttcgttcgttctttgtcgttcttcggtcttcaaccg

SEQ ID NO: 61054 - DNA, 219 bp, Glycine max
  Peptide Sequence Number=SeqID_152739
atggatgaggtgaggttcaacttggaaactaatcttgtgcttcgagcatccgctaagcgcaacactcctggactaagcaggaggaagaatccaaaagaagatgagctgtacaggttcgctaagtgcactgcttcagttcatccgctaagcgagaaaggcgcgctaagccaaaaatcactaacgtgcgctaagcagtccatacgtgtgctaagcacatga

SEQ ID NO: 61055 - DNA, 537 bp, Glycine max
  Peptide Sequence Number=SeqID_152740
atggcttctaggaaacgtaaaaatgcttggaccagatacacagataatgtcctggggagaaacattttaccagagaggaaagtagagatatatcactctgagcaaaatgagtttaaggctgaattggagaggcgtaatttccataaatgcctcaccaatttagtcgatgggggcatagacctggctttggtgaaagagttctatgcacatttatacagttttgaggaccatccaccaaagaagtccagagtcagaggtcatttggtgaagattgatggtgacagtctcaacacattcttggagacacctgtggtattagctgagggggagaccttaccagcttactatagatactacaggttgcctactgactatagagagatagaggttgctttatgcatacctggtcgagggttcatcttgaactctgagggccatcctgggaagattcttaggaaggatctgactacactagctcaagtgtggagtgtcctctcatactccaacttggccccacatcacacacttctgacttga

SEQ ID NO: 61056 - DNA, 198 bp, Glycine max
  Peptide Sequence Number=SeqID_152741
atgaaggaggagaagaagaaggagaaaatggtggaggatgacaaacaacagctgaaaaagaaaaagagagaaaagaagagaagagaaaaagcaagagtgagtgtgctagagagaaaaagaaataagcatcttcacatgaagggagagaagtaccatatcctttggtaccttctaggaaagacaaagaaagacatctag

SEQ ID NO: 61057 - DNA, 363 bp, Glycine max
  Peptide Sequence Number=SeqID_152742
atggttaagggggagtgtaaggaggtaagtgtctcctccaagaggttagcaaagaaggaaagacattttgaaataaagacaaatattaaagaaatttcccctcttagacaacctccatattttctcctttgtaaaaagacactcgttagcattgccacacctcttaggcttgaatttattcctcaagtaaagaagttgttggatgagggtttggtttgcaagagcttaaatccttgtgctttgttggtgcccaaaataggggttcccatgaaccctaagagaataaaggtcattcctgagtggcccgctccaccaagtgtgttaagggaaggagcccagagtatcaagaacctcaggatttga

SEQ ID NO: 61058 - DNA, 432 bp, Glycine max
  Peptide Sequence Number=SeqID_152743
cgctaggcaatgacattaatggctctccgaataaaagtggagaatggagaattggcggacagcactacgcaataacttcgcgcggctatagactcgaaggtggaggacacatgaatagcgctaggaaattacattcatgggtctccgaaaaaagtagagaatggagaattggcgaacagcgctacgcaataacttcgcgcggctctagactcgaagcgctagggaatgacattaatggctctctgaataaaagtggagaatggagaattggcggacagcactacgaaataacttcgcgcggctctagactcgaaggtggaggagacatgaatagcgctaggaaattacattcatgggtctccgaaaaaagtagagaatggagaattggaggacagcgctacgcaataacttcgcacggctctagactcgaag

SEQ ID NO: 61059 - DNA, 830 bp, Glycine max
  Peptide Sequence Number=SeqID_152744
attcaaactcagtattctatcaacatttcaaagatccaaaagaacaaaccttaaacacccactcaaccatccaaatactaaaagttcttcaaccaagacactttggttcggacttgaacaaaggaaagagattttcagttccatttgatccggtaggttatacctattgggattacgttgatgcttggaccaaggtgttttggcaccaaaatacccgcttcaagcattcatggctgatatatttcaagaccaacacaatttacaattttcccaattggtttttgcaatggtgggacttctttggaccaatcccagagatattcccagaaacggtccaacaaggattttcccaatttaagaaacaatacaattcgcaggaatcacgaattccagcagatcttaaatacttttcaagctttgcactgtcatggatattctcatggcaatatcgttacagcaagactgaaaagacaaaccaatatccatcactacaaagacacgcatttgtaaaatggtggacacaatttgactcatccaaagcggatccagaacaagtaaaactatggttcaaatcccatccagaattcctcaaaacggctgatccagagacttctgtgtttttgaaccaaaagtctcatctggcagcatttttagcaggatcgacatcaaaggaggtcttagctaaaaatctgaaggaagttctacaaatgttacaacaagaagaagaagtttcatcctcaaagaaggaagaaacaagttctgccgaagaagacgaagaagatcccttttaccaaaacgaagatgattgttttggtatctgtttagattaa

SEQ ID NO: 61060 - DNA, 366 bp, Glycine max
  Peptide Sequence Number=SeqID_152745
gtcctgggcatcctgagtctgggcctcctccttatctatcagatggaaaaataggggaatcagagagagcaacaacatctctagataaggaatcagaaagatcaacagcttctctagttggggattcagggggagcagtagcttctccagatggggaatcagagatgataatcaaaggtggagatgggggaactacttcaagctcaggagaagaaggtggattcaccactagagattgtggatcagctggcactggttcaacccgtgcagagctttggacatccggtcctatggttgctaacagaggagttgaagtggatgatgaagggatgtcatctgcgctagccctttttctcgatgccatct

SEQ ID NO: 61061 - DNA, 303 bp, Glycine max
  Peptide Sequence Number=SeqID_152746
atgaccatgattacgaattcgagctcggtacctctcccaattcagattggaccccacgtgtgccagatcactttccaagtaatggatatcaacttagcctatagttacctattagggcatttgatcatagtctcgggggaggaagacattcttgttagttgtccttcttctacaccctatgtggaggtcgcagaggagtccttggagacggcctttcaagcattggaagtagtgagcaatgctcatgtggagtctccccaagtgcaactgccctcatccgatgctgcattggggatcctctag

SEQ ID NO: 61062 - DNA, 246 bp, Glycine max
  Peptide Sequence Number=SeqID_152747
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcagtctaaacctaggagggctgtctaaattaagcctagtccaacaagacggatatgaggacgaagcttggattgattcagtctaa

SEQ ID NO: 61063 - DNA, 1254 bp, Glycine max
  Peptide Sequence Number=SeqID_152748
gaaacagatagtttaactttaaatcaaaatcaaaggcctgattctatttctgttgctaaaaaagagatcaaaacaaagctgatcgatgatgtggtggtgacaggaaccataaaacctatcagcagatccaaaagccctgtagctgtagaaatctatagccagaaatttttccagaaaaatcctactccgaatgtttttgaagcgatttcaatggttaacggagtccgccctcagctcaattgctcggtttgtaataccggagatatccatatcaacggccttgaaggtccttatacaatgatccttattgacgggatgcctattgtgagctcgttatctactgtttacgggcttagtgggatacccaacagcctggtcgacaggatagaagtggtaaaaggtccggcttcatcaatttatggatctgaggctatgggtggagtgattaatatcatcacaaagaatgctttaacagctcctaaattaagtctggatgtaatgacaagtacctggagtgaagataatatagatttatctaccaaatttaacgtaggtaagaaagccgcctctttattgagtttgaactattttaactttaccaaaagaatagaccagaacaaagataattttacggatgccacactacagaacagaatttctgttttcaacaaatggaacttccagagaaaagagaacagactggcaagcttagcactgaggtatctctatgaagaccggttcggcggtgagatgcagtggacaaaggctaataggggtggtgacaaaatatatggtgaaagtatttatacaaatagggtagaagccttaggggtataccaatggccattgaaagagcagatcattacccagttttcatacaattatcataaccaggattcgttttatggtaccaatccttatgacgcacaacagaaagttgcttttgtacagacttactgggacagaaaattcggaaatcatgatctgatcttaggagttacctacaagaggacattttatgatgacaatactccgggaacttcgtctgcagacggactcatcaatcaacctatgaaatctcctattttgggtgccttcatccaggatcagtgggatttggattctaaaaacacaatattgctgggctacagatttgcatggaaattttctcctaatccttaccacacgttacggtttaattttggaaccggctttagggtagtgaatttatttaccgagatcatgcagcattaa

SEQ ID NO: 61064 - DNA, 599 bp, Glycine max
  Peptide Sequence Number=SeqID_152749
ggctacacgccctcgccttcagaggtctacacgtcctcaccttcagaggactacacgtcctcgcctttagagggctacacgtcttcaccttcagagggctacacgtcctcgcctacagaggactacacatcctcgcctttagaggactacatgtcctcaccttcaaaaggctacacgcccttgccttcagaggactacacgtcctcgccttcagaggactacacatcctcgccttcagaggactacacatcctcaccttcaaaggactacacatcctcgcctttagaggattacatgtcctcaccttcagaggactacacgtcctcgccttcagagggctacacgccctcgccttcagagggttgcacgccttcgccttcatagggctacacgccctcaccttcagaggtctacacgtcctcaccttcaaaggactacacgtcctcacctttagagggctacacgccctagccttcataagactatgcgtcctcgccttcagagaactacatgtcctcggcttcagagggctgcacgtcctcactttcagagggctccagatatgcaccttcagagaactcaaggttctccgcccttaa

SEQ ID NO: 61065 - DNA, 670 bp, Glycine max
  Peptide Sequence Number=SeqID_152750
atgcgttcatgggtgaggggtcaatggattccttttgacgcagatgccctcagccagttcctaggtgacccgctagtgttggaggaaggccaggagtgcgagttcagtcagaggaggaacagggccgacgggttcgacgaggaggccattgcccagctgttatgcacaccggggcaccctctagacccggataagtctaacaaggccctggggtttccggcattaatcacgggcctctgccagtcattcggggttcccgtcacccctagtaaggtgatccgaccgccgatcacccaggccttcatcgagaagtattgcacgcctaggcaggcgcagggtgatgcacctcaggccgcagacgcaccgccaccaccttatcaggccgatcccgctagatcactaggcatggagtgttatctacagcacttggttcgccagcaggcggccaaccaccgggggcaggtacagatacatgagtgtctctactggttcagcctcagtcaacaggggcaaggttttgctccttttgcatgccctactccagagcagtttagggctgaggtcgcatggcccggagattggcccgaggcccaggccggggaggagcctactggatctcccggcgatgcagaggaggcccgtatggctgaggagataacggacttgctcg

SEQ ID NO: 61066 - DNA, 684 bp, Glycine max
  misc_feature (24)..(24): n is a, c, g, or t
  Peptide Sequence Number=SeqID_152751
atgacatctgaggcagcaaaaganatagctgacagaattgattctttggacgagcaggcgtcacagggatcgttcatcccccatggacgtcaggatatcctgactgctgccattgggcgaccagagcaccctggccgtgttcgtgctattggagccggtgtcaccataaagcaatactttggatcggcttcacgaacgtcccgcagttcttcctccatgcctcctgaagacctagaacagttgacccaacaaatcagagaccaactggaggagtcaattacagaaaaaggacttgcactacctccagagccagaggttggtccctcaggtcctcgtgtcagcacaaaggagagttgtgttgttcactcagggaacaatccagggacgggtgactcaaacaaatgcgggctatatattgaagaaaatccttcccggctgatgcaagaggctctcgttcctgtacccactgacgaggttacctcagtggggcaggcacttaacacctttcttgcttggccaacacatcttgtgaagtgtttatcagaacaggcagctgtgtctccagcaaaatctctagaaagcccggatgaagaggtcgacgatcccctgtacctgatgacattgaccatcccacaactgtttttgaagccgctccaggttatgtgggatgctaccatattcggg

SEQ ID NO: 61067 - DNA, 237 bp, Glycine max
  Peptide Sequence Number=SeqID_152752
atggaagggttagtggacctagcagcgattgacgctttcctcgcctttcatcatggcaaggaaagcccggtcgtcgccattttggccatgtatgacacgttcgaccggggatgtgaaaagagcaacgcaagaattgtttgttgtgcactggctctctatgtaggcccgtctatccgctacaaggtcaccgctcgtgcgtcgaaaaggaaaggcgaattgggaccaactcttggctag

SEQ ID NO: 61068 - DNA, 549 bp, Glycine max
  Peptide Sequence Number=SeqID_152753
atggaggagaagaaaaagaaacaactagatgaagctgctaaatctagaagcacatacactgtcattgatcctccatcttccatcagacgacacgtgaagtggaagatggcccacactaagaaaattggacaaatgacttatgaggcagctaaagaaattgctaacaagattgtaagtcacattcaattgattccttggaggagcaagcctcatagggttcctttgtcgcccatggacgtcaggatccgatgtcatgatcaagcaatactttggactggctccaaggacctcccacacgtcttcgtccatggctcccaaagacttagagcaacaggcgcaaaaaatcaaggactagctggaggaggactaacactacctcctaagcatgaggttgatctttcagctgcttgtgtcagcacaaaggagagttgtgttgatccctcagggaacgatccaaaaatgggtgacttagacaaatgcgggttatacgtcaaggttagtgttgagaaatttacaaatgccgatgcttacattcctgtacccacttga

SEQ ID NO: 61069 - DNA, 179 bp, Glycine max
  Peptide Sequence Number=SeqID_152754
agaaagaaagagttctgaagaaggcccagcctaacactcgcgctaagcgcgcgtcaggcgctaagcgagaaaagaaggcaggcgctaagcgaggcgttaagctcgaagatgcagaatctgttacgcgcgctaagcccagctacgcgctaagcgcgcgatccaacagaagcataggctaa

SEQ ID NO: 61070 - DNA, 609 bp, Glycine max
  Peptide Sequence Number=SeqID_152755
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctctgcgaaacagaatcaccaatggaagtgagcgaatcaacaagcgtctgaatgtggagaagataatcaatgatcctgtaattttccagagagacattgcgcagatccatacaaagctgccttttcttcgtgcgagcaatagagtaaaaatgcgcatggagtttctcccagagctgccataa

SEQ ID NO: 61071 - DNA, 317 bp, Glycine max
  Peptide Sequence Number=SeqID_152756
atggaggatggccagtcttgcagaatggcagagttcattgtggggattctcattggtggagggacctcaggaagatatatcagcataatgacttcaagattattcatcaaaacatggcttggaaggcagcaaaatgatctcatttcaaacatgggtagcttctaccagaacaattggagatgggatctgaaatggaggagacacttattcgagcatgacgagggagtagctgtggctttcatggaagagatcagtgcttatcctattcagtgtcatctgaaagataacttactgtggaaagctgatcctactgggat

SEQ ID NO: 61072 - DNA, 246 bp, Glycine max
  Peptide Sequence Number=SeqID_152757
atgcacatgcctaactcatgggcccctccaaagatgttgcacaacatgcaattgttgaggaagcttgttcatcatttctgtgagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61073 - DNA, 336 bp, Glycine max
  Peptide Sequence Number=SeqID_152758
atggagtgcctagagggagcttgggagaccctcgaaggcaatgcgaggtgccgattccgtggcacgatccgactcacggctacttcgttggtacatccagaggaaccagcacgcacgcttcagcgcactgtgacgtcatttgaggaagaccccgaggaggacccagaggagctacctcttcagcctgctgtggatgctcttgactttctagagggtgatgatgacccactccctgaggtggactctcccgaggacgtcatgtcgacatctgaggcagactctacagaggagagcggtcccggagggataacgactagtggaggttcttcatcatag

SEQ ID NO: 61074 - DNA, 312 bp, Glycine max
  Peptide Sequence Number=SeqID_152759
atgtgtagccctctgatggtgaggacgtgtagtcctctcaaggcgaggacgttacccaaggtgagggcgtgtagccctctcaaggcgaggacatgtagtcctctagaggtgagggcgtgcagccctttgatggtgaggacgtgtagtcctctagaggtgaggacgtgcagtcctctgaaggcgaggacgtgtagtcctctggaggtgagggcgtgcagccctctgatcgtgaggacgtgtagtcctctcaaggcgagggtaactagtacccaaggtgagggcgtgcagccctctgatcgtgaggacgtgtag

SEQ ID NO: 61075 - DNA, 204 bp, Glycine max
  Peptide Sequence Number=SeqID_152760
atgggacccaccggtgcaaggtattcagaaaacggaatccatctatcagtaatatcttctaggcataatgttgatgcagtagggtgtggaggaatggtctacacatactcaaaatgtcgcacaaccctctctggtcggtgtatgacaatagatggaccccatcggacatgtccgaaagcaaagcaattagttcaaattctctaa

SEQ ID NO: 61076 - DNA, 219 bp, Glycine max
  Peptide Sequence Number=SeqID_152761
atgagggatctttatgaggaaaggttcatgccaaattattattggtggacaacccatggtgaagagttaccacaatttcctcccatagtgttgcaaggttcatactacaaaagtggtaggcaaaggaaagaattgaatccttatgagcaaatgatcatggatcatgctggaccatcaattggccaatacatagagcaacagggtgtaattgagacataa

SEQ ID NO: 61077 - DNA, 570 bp, Glycine max
  Peptide Sequence Number=SeqID_152762
atgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgatggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 61078 - DNA, 135 bp, Glycine max
  Peptide Sequence Number=SeqID_152763
atgaaggaccttgagttctctgaaggcacaaatgtggagtcctatgaaggcgagggcatgcagccctatgaaggtgagggcgtgcagccctatgaaggcgagggcgtgtggccctctgaaggggaggacgtgtag

SEQ ID NO: 61079 - DNA, 321 bp, Glycine max
  Peptide Sequence Number=SeqID_152764
atggtggaagagtttgaagagatcctgggatgccctctagggggaagaaaaccatatctcttctcgggattctatccctccttagctagaatttctaaaatagtcaaaatcttgacacaggaattggaccgcgggaagcaagttgaaaatgaggtggtaggggtaccaaggaaattttcggaagcaaaggcgaaagtcttggcaagtcaagacgaatgggccccgttcatggataccttgcctgtattttactatgagaaattagtgggctacatgccttccagcttcgcggacttggtcttcgccggagaaaggatcgag

SEQ ID NO: 61080 - DNA, 254 bp, Glycine max
  Peptide Sequence Number=SeqID_152765
atggctaccgtagatattactggcttaaacagcaatgacctccacaaaccttttaggtttgaagggtatcatttcaaacgttggcaacaaaagatgatgctttctttaactatgagaaaagttgcctatgttttgaacattgatattccagtgatgcctaaagatgctgagaaggaagtgaaggataaaaagactatggaattagctctttggaatgaaaatgattacctatgcaagaatttcattctgaatgg

SEQ ID NO: 61081 - DNA, 405 bp, Glycine max
  Peptide Sequence Number=SeqID_152766
atgggcgaaggccaggttgccgttgttgccggcttccagggcatcggtcccgataaccgcattgcaacgcttggccgcggcggctccgacacctcggccgttgccattgccgctgccgtgaaggcggatcgttgcgacatctatacggatgtcgatggcgtctacacgaccgatccgcgcatcgagcccaaggctcgccgcatgaaaaagatcgccttcgaggaaatgctcgaaatggcgtcgctcggtgccaaggtcctgcaggtccgctcggtcgagcttgccatggtacacaaggtgcgcaccttcgttcgctccagtttcgaggatcccgatgcgccgggcatgggcgacctcatcaacccgcccggaagtcgtaaccggcatcgcctatgccaaggatga

SEQ ID NO: 61082 - DNA, 192 bp, Glycine max
  Peptide Sequence Number=SeqID_152767
atggtgtggttcaccataagaagacgatgttactctccttgcgtcaacgggctcatttgcccctggttgaccaaaggtgcgggtaaccataacgtaaccccgcatatcatgacttcacgggtcaggatgtcaaaaggtgcagaagacgatattagtctcagcgtgtcaacgggctcgtttgcccctggttga

SEQ ID NO: 61083 - DNA, 777 bp, Glycine max
  misc_feature (120)..(120): n is a, c, g, or t
  Peptide Sequence Number=SeqID_152768
atgagcgtcgatgccaggcaggtcattggacagttgcgactcgcgcatctcttcttcaccttctgggttgcactctgtttgctaacaagagtgcaaccaatgtccatgttttctacttgngaggcccttcgtgacctcagtatgacgaagaggtacgcttggggagtggctgctttggtgcatatgtacgaccagctgaacgatgcatctatgagccacagccgacagtgctggatttacgagcactttccgtcggtcgtggactccactggtgaacaggagtacgacgaggattctccgtgtgcgtgtaggtggattgcaaccaagaagaccctgaagagcattcgtacgccggcgtacagggagcgcctggatcgactccagattttggatgtttgttggatcccttatggggaccaccgggaggtccgggactttcacgtcagatcatgttattccggtttcttgcgctgggggcctgttgctgtttattaccgaccggagagggtcgtgcggcagtttggctacacgcagaccattccttctcctcctatcgattcatgggtctcgtatgatgatatacacgacaggtggatgcactacgaggatcatattgttccagcaggtgaggtatgcgttgtgccaggccagtgttctagtgactacatggactggttcttccgcatctcccatcttttcattacactaggccacgcattagatcctctgcctcattgtcacgccctgcaggcccaagtcatccctcaggccccgtag

SEQ ID NO: 61084 - DNA, 675 bp, Glycine max
  Peptide Sequence Number=SeqID_152769
tacctatcgcctttagaggactatacatcctcaccttctgagggctacacgtcctcgccttcagaggactgcacgtcgttgccattagaggactacacgtcctcgccttcagagggctgcacgccctcaccttctgagggctacacgccctcaccttcagaggactacacgtcctcaccttctaagggctacacgccctcaccttcagagggctacacgtcctcaccttcagaggactacacagggttacacaccctaatcttcagaggactatacatcctccccttgagagggctacatgtcctcgccttcggagggctacacgccctcgcctttagagaacttcacgtccttgccatcaaaggactacacgtcctcgccttcaaaggacttcacgtcctcaccttcagagggttacacaccctcatcttcagaggactatacgtcctccccttgagagggctacacgtcctcgccttcggagggctacgcgccctcgccttcagaggactacatgtcccccttttcagagggctacacgccctcgcctttagagggcgacatgtcctcaacttcagagggctgcacgcctacgcctttagagggctacgcatccccactttcagtgggctctacatccgcaccttaagagaatttaaggtcatctgcccttaa

SEQ ID NO: 61085 - DNA, 183 bp, Glycine max
  Peptide Sequence Number=SeqID_152770
atgggtgtacttgggccttccagaaaattcctccagaaggcggttgcttctggaggaagtaacctagctcgcctaggcgagctgggtggcaagcatctcccccattttcctataaatagggggagaggtgaagaggaaaattgttcaaccctcctgaaaatccgagccgaggcgcttccgtaa

SEQ ID NO: 61086 - DNA, 536 bp, Glycine max
  Peptide Sequence Number=SeqID_152771
aggatccccagcgcccaggtatagccgaacaggatcaggcggccgatccaggacgagaacaatgcattgacggtgttgaagcactcttcgctgaccgcagccgaaatcagccaggccgccagcagcagggtgccgaagtaaagtgcgccgcctgtgatgcgatggacgatggacatcgtcatcgtaatgaccggcttgtagatagacaggtgcggcgacaaaggacgctggcgcgttacagtcggttgtgtcatggctctgtaggcttccctgacgtttctctccggccacacccggctgacgatcatcagcaaggcagccgggttgcgggttctcccgaaccctggttcgatgccgtccgagacacagggaaccggactttacgatcccgcgccggtacgacccaagaaaatatggctggaccgtggcgtacggccctatgtggcgctttctactgcgcttttaccatcacgtcaaagaagctttttcacgaaaagactaacaattggtcgcacctgggcgacacattcgcgtga

SEQ ID NO: 61087 - DNA, 347 bp, Glycine max
  Peptide Sequence Number=SeqID_152772
cgaggaagcggaagagcgcccaatacgcaaaccgcctctccccgcgcgttggccgattcattaatgcagctggcacgacaggtttcccgactggaaagcgggcatcggaggaaaaactggaggaatctcaggaaaccgctagagatgtcgctatcgttgtcggaaaacacgtgagtccgcttagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61088 - DNA, 84 bp, Glycine max
  Peptide Sequence Number=SeqID_152773
atgaaggcccaagtggagaaagatgaaggcccggaggcagaggcactaccaagactattaattgttgctgaagatacactataa

SEQ ID NO: 61089 - DNA, 519 bp, Glycine max
  Peptide Sequence Number=SeqID_152774
atggccccgaggaaacttgcctcaaagagatccaggaaggataaagcggtcgaaggaaccagttcctctcccgagtatgacagtcaccgctttaggagcgctgaacaccagcagcgcttcgaggccatcaagggatggtcatttctccgggagcgacgcgtccagctcagggacgacgagtataccgatttccaagaggagatagttcgccggcggtgggcatcactggttacccccatggccaagttcgatccagacatagtcctcgaattttatgacaatgcttggcctacagaggagggcgtgcgaaatttgaggtcctgggtgaggggtcagtggatcctgtttgatgcagatgctatcagccagttcctgggataccctttagtgctggaagagggtcaggagtgcgagtatggccagaggaggaaccggtccgatgggttcgatgaggaggccatcgccaatttgctatgtataccggggcaggattttgcccggactgctgccgggagacgg

SEQ ID NO: 61090 - DNA, 468 bp, Glycine max
  Peptide Sequence Number=SeqID_152775
atggcttctccacctgcctcgcctcctcctcctcctcctcctccttcagacgcatcagcttcaccatctgccatgaagcggacatgcaaagcctcacatctacaatccttgtctaccagaccacctggtgctgacacaccagtggtccacgttgatcctactaccggcaaggccgacggtccccacaggaagaaattaagaacatatttggggattgtggcgcgtgataaggtggacatcacgtacgagaactggaaggaggtccctactgctcagaaggacttgatttgggaggatattcaggcggaatttgaaatcccagaggcttctgacagtagcacgaaaagaagtttcttcagactgttggcaagagatggaagcagtttaaatcagacctcaagaggaaatgggcccttgcagtcgatcgggatggtgtggacgacactatctgtgagaaatatggcataa

SEQ ID NO: 61091 - DNA, 201 bp, Glycine max
  Peptide Sequence Number=SeqID_152776
atgggtgaggaagagaaaaaaccagaggaaaacaaagtggaggagaaaaaagcagaggaagaagaaaagaaagaagaagagaaaaaactagaggaatcaaaagatgacaaggaatccaaggaggaatatgtgccgctagaaatcgtgcaaggcacaaccttcgcaatgcatggactaagcatgatttctgacatcttttaa

SEQ ID NO: 61092 - DNA, 307 bp, Glycine max
  Peptide Sequence Number=SeqID_152777
atgcaatctcagggacttgcactgcctcccgaccctctggttggtcccttcggtcctcgagtaagcacaaaggggagttgtgttgatccctcaggaaatgatcttgagacggggatccatgttgttcataacactcctttgttgcctggcctagtaaaggtgagtgtggaggaggttacagatgcagatgctctagttcctgtacccactgatgaggttagatgggatgccaccgtgttcggggtctttaatccaaatttcccgctctacataaagcatgaagacctctccaaaatcacacacggtg

SEQ ID NO: 61093 - DNA, 1101 bp, Glycine max
  Peptide Sequence Number=SeqID_152778
tccctgagaaactggttccccgaagacaacagggagtgaagattgctgaaaaccctagccctgcaacaagtcctagggaagtagacacggagatggacaagaaaatccgcagtattgtgagtagcattttgaaagaagcctctgtgcctgaagctgatgaagatgttccaacatcttccaccccgaatgtttctgtgcctgatgttgagaaagatgttccaacatcttccgctccaaatgctgaagtactctcttcccccagcaaagagagatcaacagaggaagatgatcaagcgacaaaggagacccctgcaccaagggcaccagaacctgctccaggtgacctcattgacctggaagaagtcgaatctgatgaagaacccattgccaacaggttggcacctggcattgcggaaagacttcaaaacagaaagggaaaaaccccccttaagaggtctgtacgaatcaagactatggcacagaagaagagtactccaatcactcctgccacatccagaagaagcaagatgtctcgacatctaagagggccaagatctggaagaaaggtgcctggaaatgttcctgatgcaccattggacaacatctctttccactccattggcaatgttgaaaagtggaaattcgtgtatcaacgcagacttgccttggaaagagaactgggaagaactgccttggattgcaaggagatcatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtgttagattcacccctgctgtgatcaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 61094 - DNA, 174 bp, Glycine max
  Peptide Sequence Number=SeqID_152779
atgggggtgcaaatagcacccaggcccacttgggccctccagaatattcctccagaaggctgttgcttctggaggaagcaacctggctcgcctgggcgagctgggcggcaagcacctcccctattttgctatatcaagcttatcgataccgttcgaccctcgagggggggcccg

SEQ ID NO: 61095 - DNA, 254 bp, Glycine max
  Peptide Sequence Number=SeqID_152780
tatgtctcttgccacattatttggaaagttgcaggaacatgagatagaattgcaaagacttaatcaaaatgagaaagagcaagcaaacatatgcttaatgaccaagaatcatgaaagcaatgaggaggagcccttgaagaaaaagtggtacatagacagcggatgctctaaacacatgacaggagatgcctcaaagttcacaattatctctcctgagaaaagcgggcatgtaacctttggcgacaacaacaaag

SEQ ID NO: 61096 - DNA, 468 bp, Glycine max
  Peptide Sequence Number=SeqID_152781
atgacattgaccatcccagagattttcttgaggccttaccaggttacatgggatgccactgtgttcggggtctttaatctagacttccctctctacataaagcacgaagacctctccgaaatcgcacacgatggtcaatgtctcagcatatcaatgttacagttgtggattctgcatctgactgaaacaagtatgcgagcggggaattctgatatctatggattcctcgagccacagtccattcagaggtctgggcaatcacagtttgagactgaaagttacataaagagttggatgaatggtgctttaaaaggtcttgataatgctccacaacctaaatcaaaggctcctgctaggtggactatcgtcaagtgtaatagacaaaaaggaagtactgagtgcggctactatgtcatgcactggatgtccaccatcattttaggaacttttaggaataattgggaagcg

SEQ ID NO: 61097 - DNA, 324 bp, Glycine max
  Peptide Sequence Number=SeqID_152782
atgaaagaaagggggggtgcaaatagcagttttcaaattttcgaatttgggcccttccagaatattttcgaagcagggttgcttctggaggaagcaacccagctctcctgggcgaaaatgggctgttccaaagatccctcatccccttggctatgcatttcagctgctttgggtgaaaaaaattatttccgtgaagaaaatccgagccgaggtgcttctgtaacgctttcgagacgtttccgtgggcgaatccgtgaaggttttccgtcgttcttcatcgttcttcatccgttcttcgttcgttcttcgttcttcaacgggtaa

SEQ ID NO: 61098 - DNA, 264 bp, Glycine max
  Peptide Sequence Number=SeqID_152783
ggatcgcgcccgcaagacatccagtggacccggagaagtcaacagggtcctggggtttccagctctgattacgggcctctatcagttctacggagtgcctgtcgcccccagcaagggcgagacaccacaacagcctggggatggccggcagcgggcaacagacgcaccgccgccaccttcaaagccccttagctcatctacaaaagctagagcgttgcctacgacccgtggtcgaccagcaggcgaccaagtccaaagccaaag

SEQ ID NO: 61099 - DNA, 471 bp, Glycine max
  Peptide Sequence Number=SeqID_152784
atgcatctaggaaacacaaccactaacagtgtttgggaagcaatgaacaatatgatggcacttcaacacacccagattaaagcatcttttgtgtttaaagttaccttgtacaaaaaactacttggtatggtatcaaggaaaaaaccattcacgttgtggatgtgtcatgaggagtacccacgcttcataccactagagacaatccatatttttttgcgaagacttagtttttcagatcaagggttatgtgaggcacaagtgaccataactgaggagatggaaaccatatcgaaacgctttgagcaactcaatgcttgtggcaaagtacatttgaagacaaagttgcgagaaattacttatcctgatatgaactccatgtgtcctcctctagaaaaggtgaagaccaagggtgctccaaaaaaattgctgaccaaacaacaaaagtcaacaaaacacgatccatcttattag

SEQ ID NO: 61100 - DNA, 378 bp, Glycine max
  Peptide Sequence Number=SeqID_152785
atgtccaaatcttgtgaatttgggatgaccggccctctcgatgagtcgatctcttgctttctcataaggttggacccttgggtactagtacctatcaccttcagaggactgtacgccctcaccgtcagaggactacacgtcctcgccttcagaggacttcacgtcctcaccttcagagggctacacgcctttgccttcataggactagacgtcctcaaattcagaggactacacgtccttgccatcagaggactgcacgtcctcgcctttaaagggctatatgccctcaccttcagaggactacacgtcctcaccttcagagggcttcacgccctcacctttagagggctacaccccctcatcttcagaggactacac

SEQ ID NO: 61101 - DNA, 678 bp, Glycine max
  Peptide Sequence Number=SeqID_152786
atgtacctatcgcctttagaggactatacatcctcaccttctgagggctacacgtcctcgccttcagaggactgcacgtcgttgccattagaggactacacgtcctcgccttcagagggctgcacgccctcaccttctgagggctacacgccctcaccttcagaggactacacgtcctcaccttctaagggctacacgccctcaccttcagagggctacacgtcctcaccttcagaggactacacagggttacacaccctaatcttcagaggactatacatcctccccttgagagggctacatgtcctcgccttcggagggctacacgccctcgcctttagagaacttcacgtccttgccatcaaaggactacacgtcctcgccttcaaaggacttcacgtcctcaccttcagagggttacacaccctcatcttcagaggactatacgtcctccccttgagagggctacacgtcctcgccttcggagggctacgcgccctcgccttcagaggactacatgtcccccttttcagagggctacacgccctcgcctttagagggcgacatgtcctcaacttcagagggctgcacgcctacgcctttagagggctacgcatccccactttcagtgggctctacatccgcaccttaagagaatttaaggtcatctgcccttaa

SEQ ID NO: 61102 - DNA, 258 bp, Glycine max
  Peptide Sequence Number=SeqID_152787
atggggttgaaccatgctcatgctttttcgaaaaaagttcatcaagtcaagttgaagtatggaagtaatcatcttgcaaaaattggggcaaaagatgaatcgagttacatcactgctagagtaatggatgaaatagagaaggtgcaagagcagatgaaggccgacatggaggccatgaaagagcaaatggccacaaatgatggaggccataataagcatgaaaaagataagggaagtcgatacgagcgttgttgctaa

SEQ ID NO: 61103 - DNA, 382 bp, Glycine max
  Peptide Sequence Number=SeqID_152788
ccccgcgaatttacagcctagcgctgttcgccaattctccattctccacttttttctgagccccatgaatttattgcctagcgctgttcatgtgtgctccaccaacgagtttggagccccgcgaatctactgcctagagttccccatgaatttattgcctagcactattcatgtgtcctccaccaacgagtaccggagccccgcgaatctactgcctagagctgttcgccaattctccattctccacttttttctgagccccatgaatttattgcctagcgctgttcatgtgtgctccaccaacgagtttggagccccgcgaatttacagcctagcgttgttcgccaattctccattctccacttttttcggagccgcatga

SEQ ID NO: 61104 - DNA, 541 bp, Glycine max
  Peptide Sequence Number=SeqID_152789
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtactcaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61105 - DNA, 404 bp, Glycine max
  Peptide Sequence Number=SeqID_152790
atggaagccattaaaccaaagtcaatactcatgaatgctagaacatccatcaagaatgataacaaagcagaccctatacagctgcaatgtgacatcttgaaggaaatgggcttgtcttataaggaagaagatagcaaggccatttcgggagactccactggtcattgggattttgttccatctgtggaagctgctggtggccttttatgtatgtggaataactccacctttgtggtagaaaggaaggaaaaaggtagacccttcttaatgcttgaaggcacatgttgtagtaataatcagaagttgatatttgtcaatgtttatgctccttgtgatctagttgggaagaaagctttatgggatgagttgaggcagctgaaggcttctaatcctagtggaatgtg

SEQ ID NO: 61106 - DNA, 369 bp, Glycine max
  Peptide Sequence Number=SeqID_152791
atggcacttaggcagagggagatcggagttgtgatcgcaaggcaagacattgctgagcagcagtgtcatccatgtctgggtcaaagtggtcatgctggtgcgcatgatccgcaccctcctccctgcagcggtccgggtgaaatcctgccccggtgtgcacaaaagttgggcaatggcttcctcatcgaacccgtcggccctgttcctcctctggctgacctcacactgctagccttcctcaaaaacaagcgggtcacccaagaactggtagagggcatctgcgtcaaagggaatccactgacccctcacccacgaacgcatgtctcgcactccctcctccgtgggccaagcattagcatagaactctag

SEQ ID NO: 61107 - DNA, 783 bp, Glycine max
  Peptide Sequence Number=SeqID_152792
atgcctctatggtgggaatttaattcgtgggttaaggaacctagagtgttccattgtaggcctatggataatttccttcagcactctcccatggcaggattaaaggataccaacacaaggtggaaaatttggtggatagcagctacaacatcaatatggaagctcaaaaatgacattatcttcaacaatcatccttttgtcatctcgaagctggtggataatacaattttcctctcttggtcctggatgaggggtgggaaaaggattttaatgttccttttcaccaatggtcctcatctatggctttggcttttaagtagtgtttgtgttgttgggctgggatccatagagggggataaggagaaggatttgcctcttgaggtaattctgcctcacaacagcaattcgaatataaagaagaaaagcagggtcaatgtcccctttggtcaatatgacttaaaggtagcaagtgaggaagtgggccagcggataaatggcccaactcattctgccacaaaggtttatgtgagaataaaggaggtgttgagaagtaatggaaaggcccaacaatttaaggaaccagctgtggactcaaactcaatttctataactgattccatgccttcaatacaacaaggcccaatagagctgcaatgtgctcttttaaaggaaatgggcttgacttatggggaagatgccaataaggttaaggggcttatattggatatggaaaatagagatgatatgatggcagctgagaggggaattaaaaaacatcaatag

SEQ ID NO: 61108 - DNA, 94 bp, Glycine max
  Peptide Sequence Number=SeqID_152793
caccactcattgagttggtgaggaactatgttctctcatgggaagatggtgttgaggaaaaaagcccagagtttcaagaacctcggcatttgag

SEQ ID NO: 61109 - DNA, 282 bp, Glycine max
  Peptide Sequence Number=SeqID_152794
atgccaatctccccctgcagatgtatcagttgggatcgtgcccacaagacgcccagtggacccgaagaagtccaacagggccctggggtttccagctctggttacgggcctctgtcagtcctacagggtgcccgtccccccagcgagggatcgcgcccacaagacacccagtggacccgaagaagtccaacagggccctgggatttccagctctggttacgggcctctgtcagtcctacagggtgcccgttcccccagcaaggtcatgccatcgtgacatag

SEQ ID NO: 61110 - DNA, 57 bp, Glycine max
  Peptide Sequence Number=SeqID_152795
atgcaggtcattctgagtattcagacaaagttatcaaatttgaagttattgaactga

SEQ ID NO: 61111 - DNA, 240 bp, Glycine max
  Peptide Sequence Number=SeqID_152796
atggtaggtcagggaggcaaagagttgggaagtgtgggcggcccccattttgtgcaagttcagaacaagcattccttcccaccatatggcttgcctcccaactatacaccaccaaatgttgcacacactctcgatgagaatgttgataactccacacccatgcaaattgagagccaacaaccccaatctgatcatgcacatgtctctcaacccatgggggagacacatgaagcaccctga

SEQ ID NO: 61112 - DNA, 297 bp, Glycine max
  Peptide Sequence Number=SeqID_152797
atggagaattggcgaagagcgctacgcaataacttcgcggggctccagactcgttggtggaggatgcatgaacagcgccaggcaatgacattcatggggctcccgccaggcaaggacattcatggggctccgttaaaaagtggagaatggagaattggtgaaaagcgctacagcaataacttcgcggggctccagactcgttggtggaggatgcatgaacagtgccaggcaatgacattcatggggctccgtaaaaaagtggagaatggagaattggcgaagagcgctacgcaataa

SEQ ID NO: 61113 - DNA, 456 bp, Glycine max
  Peptide Sequence Number=SeqID_152798
atggcaagagctggtgacaatggtggtgtatatcatcaactggacgaatctcaacgcttatttctggacgcgtggactacacaaatgcaacgtttgttgaaccgtaacaaagaagagccctacaaacgaatagccaaatcttcctcgtttactcttaaacctctatcccctagagaagtgtgtgatgaccaaatcagaatgagagaaaagagagaacaagagaaagaaaatagtgaggcaccgcaaaggaatatgaaaaagaagagtgatacacccgaggaaaagagtgatacacataagagagagagtgatacacatgagagaaaatttaattattttgcagaggtgagtgaagtgaggaaagtgttacctgctcatgaaccactcaatctacagaatttaaaaatgtctttcctaaggagattcctcatggactgccaccttcaagaggcatag

SEQ ID NO: 61114 - DNA, 620 bp, Glycine max
  Peptide Sequence Number=SeqID_152799
gatcccccgagcgtcgcgacgacttcgccgatgtcgcacgcggcaacgtggagacgttcttcggcgcgacgccggacacctggcgagtggtggtcggtgacctcgtcgaggcgcttccggccgaggtcgcaccggcgtcggtcgaccgtgtcgtgctcgacatgctcgcgccgtgggagtgcatggacgcggtcgccgacgcgctcactcctggcggcgtggtcctgtgttacgtggccaccgccacgcagttgtcccgggtggctgagtacatccgcggcaccggcctgttcaccgaaccggacgcctcggagacgatggttcgtggatggcacgtggaagggctcgccgtgcgtccggatcaccgcatggtcgcgcacaccgggttcctgctcacggctcgtcggctcgcgcccggcgcggtggcgccgtcggtcaaacggcgcgcctccaagagcagctacagcgacgacgacgtggaagcctggacgcccggagctgtcggtgaccgtgagatcagcgacaagaatctgcgcaagcgcgccagggaggcggagaaggctgcggagggggcgcgactggccgccgcgtcgcgcgaatcggggcgcgtgacggaatag

SEQ ID NO: 61115 - DNA, 180 bp, Glycine max
  Peptide Sequence Number=SeqID_152800
atgcagaattcacagagagatgtgtacctaggagcctacatcaatgggcctgataactgcttgaaaggaattattaacagtgctttgaaaggattcaacaatagtcaaggaagtaaatccaaggttgctgctagatggattgtagttaaatattttactgattcaagaccattggaatga

SEQ ID NO: 61116 - DNA, 627 bp, Glycine max
  Peptide Sequence Number=SeqID_152801
ggctacacgccctcgccttgggtactagttaccctcaccgtcagaggactacacgtcctcgccttgagaggactacacgtcctcaccatcggagggctgcacgccctcacctttagaggactacatgtcctcaccttgagagggctacacgccctcaccttgggactacacgtcctcaccatcagagggttgcacgccctcaccgtcagagggctacacgccctcaccttcagagggctacacgcccttgcctttagaggactacgcgtcctcactttcaggaccagtagtttccttttaacggttcctgggccaccccctgatattggagggcgaccaactgtgcaagcacaaccagagagggaggctatcacacaactactatgcataccggggcaagatttcacccgtgcctgcaaagagacgaggattgcacccaagagacacccagtggacccggaaaagtccacagggcctggggtttccagctctggttacgggcctctgtcagtcctacagggtgctcggatcgcgcctgcaagacacccagtggacccgaagaagtccaacagggtcttggagttgtcaagctctaattacgggccggcgcagggtgaaacaccatag

SEQ ID NO: 61117 - DNA, 162 bp, Glycine max
  Peptide Sequence Number=SeqID_152802
atggcctcctatggtgtggcgtctcctctccctcttccttctccattccgctgccagtcatcttccaagaagcaaaggaatccattgatgaagaagatcctaggcctacaagctccaatggagcttgcatcatgtggtatcagagcatcttcatctaggtga

SEQ ID NO: 61118 - DNA, 147 bp, Glycine max
  Peptide Sequence Number=SeqID_152803
atgaaaattctaagttcgggagttatatttacgcttgaggaaggtcgacaaaagcagggcttttgctcctacgtaccctccatcgaagagaaaatcagacctacgcagttctttcttaagggtgaatcacacgattcttttacttga

SEQ ID NO: 61119 - DNA, 667 bp, Glycine max
  Peptide Sequence Number=SeqID_152804
ggtccgctcttgacggtgaagaacacgttggagaatggaaagatcccatcgggaaaataacaaagatcacatttcccagtcaagaggggtccgctcttggcggtgaagaacacattggagaatggaagaatccaatcgggaaaataacaaagatcacatttcccagtcaaggggggtccgttcttgacgtcgaagaacacattggagaatggaggaatccaatcgggaaaataacaaagatcacatttcccaggtccgttcttgacggtgaagaacacattggagaatggaggaatccaatcgggaaaataacaaagatcacatttcccagtcaagagggtccacttcttgacgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 61120 - DNA, 243 bp, Glycine max
  Peptide Sequence Number=SeqID_152805
atgaaaggtgacctattggaggctcctaacttacttccaatgaaaggcctttttgttacaaaatttgaaagcaatgaagttggagtgcttcttagtccaatagctcttaaggtggttggccccttgcttcttgactcaaattcttcaagggatgacaccaatcctcctttccaattccctatatggcaactcacaaacaaggaaacaaagacaagcaataaccaaagacccaaaaaaaagtga

SEQ ID NO: 61121 - DNA, 270 bp, Glycine max
  Peptide Sequence Number=SeqID_152806
atgactcaaaagctggtagcccgcggaaacaccttacggttatccgcacctcgtcattcagtgaccccaagtgtgattgatgagcagaggccaatatggtcatctgcgccctttccggaggcggcgggcccgatgtcagcatcttccggtggagactttttcaagtctcacaagttatctagactacgtaggtctgagttcctcattggaggatacgtaggagcaagagccttgcttttgtcggccgccccacaagatctgtcatactga

SEQ ID NO: 61122 - DNA, 234 bp, Glycine max
  Peptide Sequence Number=SeqID_152807
atggagtctcacaacttccctggaaaagagttttcagatgtgggaagcatcatccaccttgtggcatggtataaagtgtatcatcttgctaaacctatccaccaccacaaagatagagtctacacctctttgggttctaggaagcccaaggacaaagtccatactaatgtctacccaaggtgcagaggggatggggtccacttggaccttatttctaccaactacaaaacctaa

SEQ ID NO: 61123 - DNA, 378 bp, Glycine max
  Peptide Sequence Number=SeqID_152808
atggagaggagtatgattgatgttgctagttgtggagctcttggtgatatgacccctgttgaggctatgaatttgattgagaagatgacttccaactcccaacaattcagtgcaaggaatgatgctattgtccttagaggagtccatgaggtggccacaaattcatcttcatctgctgaaaataaaaagcttgagggaaaacttgatgccttggtcaacctagtaactcagcttgccatgaatcagaaatatgcacctgttgcaagagtctgtggtctatgttcttctgcagatcaccatacagatctttgtccttctttgcagcaatttggagtcaatgggcaatctgaagcttatgccgcaaacatttataaatag

SEQ ID NO: 61124 - DNA, 647 bp, Glycine max
  Peptide Sequence Number=SeqID_152809
gtgactttagcattgggaaatgtattgttgccttagaacttgatagaagcaggagatttgttgctggtgatttaattcccatagatttggagattaacgctacttctaggagacgaaacacaaagagaattataaattttttgcaggacttagaagcagcagcaactccaggagaagaacctcgatcttctgaggcatcttctagttttcctactcaagggcaatctcatacagcagttagaggagacactatcgtggataagcagccaaggagagtgacccttgaagactattcaaatgcaattcgatcgagcttgttttcattctcattgtctggagaggctaagagaaatatttccctgagtgagaccttagaaagattccatggtctattgagaaagacactcactcatggattctcagaaccgattcaggtcaacatttttatagatgggttaaggccgcagtccaagcagctgttagacgcttctactgggggaaaaataaagttgaagacccccgaagtagccatggaactcattgaaaatatggctgcaagtgacattgctattttgagggataaagtccacattccaacaaaaagaagtctgctggaactcacatcacaagatgctttgttggcatag

SEQ ID NO: 61125 - DNA, 345 bp, Glycine max
  Peptide Sequence Number=SeqID_152810
atggactcctctaagaacaatagcatcatttcttgcactgaattgttgggagttggaagccatcttctcaatcaaattcctagcttcaacaggggtcatatcactaagagctccaccactggcagcatcaatcatactcctctccatgttgctaagtccctcatagaaatattgaagaaggagatgttcataaatctggtgtactcatacaagctttctccactaagttgcctgatgcctgaaatgtcttttctgatggcagtggtcctagatgcagggaagaatttctccaagagcaccttcttaaggtcatcccaactgaaaatggacctgggagcaaggtag

SEQ ID NO: 61126 - DNA, 492 bp, Glycine max
  Peptide Sequence Number=SeqID_152811
atgcatgtgcgtcaagatttgccgattatggttagaactagagggttaggtcatgccttaggtaggattataggcaaagccctggggagagaggatcatcatgatttagatgatgttccccaggggcaaaggcctacagcattcgtacgtaggcaacgggaagttgcccctattgctgaggatgatcctgtgttgcatgaagacgtatatgcacatgctgcagaagctattcatgatgttgagggatttccaagtgggccgcgtgacccatcagtgctaactaactatggtgaccatgttgcagtcatcgtatggaatggagaggaacgtcttgaattgaagttatcctcccatggaaggaaggttcagaaatttgggaggcctgctctagaaattgaagggctagtcgctgccataggattaagtcctttgatcgcatgttcagtagacactggcgattggggacttatatccgcttttgtggagaggtga

SEQ ID NO: 61127 - DNA, 486 bp, Glycine max
  Peptide Sequence Number=SeqID_152812
atggagagaagtatgatagatgttgccagtggtggagcccttagagacatgacccctgttgaagccagaaattttattgagaagatggctttaaactcccaacaatttagttccagaagtgatgctattgtcattagaggagtgcatgaagtagccacgaattcatcttcatcagccgagactaagaagcttgaagatcaccatacagatctttgtccttctgtgcaacaatctgatgcaattgaacagcctgaagcttatgttgcaaacatctacaatcgacctcctcaacctcagcagcaaaatcagccacaacagaacaattatgacctctccagcaacaggtacaatcccgggtggaggaatcatcccaaccttagatggtcgagtccttcacaacaacaaccttattttcataatgttgttggcccaagcagaccatacattcctccaccaatccagcagcagcaacaacaacagcaatag

SEQ ID NO: 61128 - DNA, 228 bp, Glycine max
  Peptide Sequence Number=SeqID_152813
agggctttttccggaggagccctggtgcttaccaacatggatggcgaagagctaccttcacccgggcaggatcaccttgggctaccttctggagtgaagacaaaaatgaatggcagaaaccagtcaagatacttaaggatgaacgcaagcggggatggggtcacgaccgaccgatcgttgcccttctctgtgcgaaacaagcatggaatgtcgctgcaaggcagcccc

SEQ ID NO: 61129 - DNA, 1065 bp, Glycine max
  Peptide Sequence Number=SeqID_152814
atgccagcgcgatcactgcctctggcgcagcagctgctgagctttaacaccatcaatccaccgggcaatgagctggcctgtgtgcaattcctcgccgcgtggctgcaggagcagggcttcgtggtcaaactgacggcgttcggcgagcagcgcgccaacctgatcgcccgcctgccgggccagatgccgggcaaaccgctggcctttaccggccatctggacaccgtgccgctgggtaatcagccgtggcagtttgatccgtttggtcacgacatcgatggcgaccggctgtacgggcgcggcgccagcgatatgaaagcggcggtagcggcgtttgtgctggcctgcgtgcagcataaagcggcgattgctgccgggcgcggcgtggtactgctgctgaccggcggtgaagagaccggctgccatggtgcgcaggcgctgatcgcggccgggcagttgcctgaaattggcgcgctgatcgtgggcgagccaaccgccaaccagccggtgatcggccacaaaggcgcgctgtggctgcgctgcgaaacgcgtggcaaaacgcgcacggagccatgccggagctgggcatcaacgccatctacctggcggctgatgcgctggccgacgctgaacgtcggtcgcattgagggcggcctcaacattaactcggtgccggaccgcgccgcgtttgatgtggatatccgcagcgcgcccaacctgcaacacgcggtgattcgccagcagctggcgacctttctcggtgacagcgtgcacatcagcacgctggtcgatttgccggcggtgctgagcccggagcggcaccagtggattcagtcggtgtaccgtgcctgcgaagccgtgacgcaggaacctgcggaagcgcgtatcgtgccctattttaccgatgcctcgctgctgctgccggcgctcagcgatccgccctgcattattctcggtcccggtgagccgacgctggcgcatcagactgatgaatactgcctggtgagccgtctgagcgaggctgagcagatttacgggcagctcattgctggctggatgcgctga

SEQ ID NO: 61130 - DNA, 474 bp, Glycine max
  Peptide Sequence Number=SeqID_152815
atgacataccaagctagctctaaagccaatcaaaactcaattcaaaatttggagattcagggttgcaagagttactccatggaaaattgtcagtgggagcaagagttacaaccctacaatcaatatgaagaagaaagaatttctaagcttgataatttgttgatgcaactcaaggagtcatatgaatctactcaacacacaattaaaaatctgaaaattcaatttggtaagctagaaaaagaagtgactaaatttttggtcacaagggaagaacacattgtagaggttgaagctcatgaggaaagtcttgtagaagagcatgattcaagagaaaaaaatgaagaaaaaagtgaggagagaacacaagaacaattggagaagtgttcacaagtagaaattcaacaagaaagtattctccaagtcaatatcacttctcatcaactgattgtcaaggaagaaagacatggagaatga

SEQ ID NO: 61131 - DNA, 527 bp, Glycine max
  Peptide Sequence Number=SeqID_152816
atgggatcaagtcaaatgcctttgcttaaaaagaggttctatcaagtcaaggtcaagagcctagggatcaccagtctaaaagagttagggcagttgatgggtcagctccagcggcaagcttttcgcaaagcttacggtaaaatctgggacctagccatggtagaagtctctacggaggccattgcctccctcgcccagtattatgatcagccgttgaggtgcttcacctttggggacttccagctatcacccatggtggaagaatttgaagagatcctaggatgccctctaggggggaggaaaccatacctcttcgcagggttctatccctcattagctagaatttccaagatagtccaaatctcgacgcaggaattagaccgcaggaagcaagtcgaaaatggggttccgagaaaatatttggaggcaaaagcaagaatcttggcagataaaggcgagtgggccccgttcatagatattctcacactattgattttcgggggagtcctctttccgaatgtggatgg

SEQ ID NO: 61132 - DNA, 204 bp, Glycine max
  Peptide Sequence Number=SeqID_152817
atggactcaaggatcacaaaggttgaagaagatgtcaccatcatttgcgactgccttgatttacctccaccaccaccatcagattgtcatcatcaaaaagggggagattgtggaagcaatgccttccaaggttattttgatgatgccaaagaatcaagagttaagcaaaattccatagattcaagaatcaagattcaaggataa

SEQ ID NO: 61133 - DNA, 330 bp, Glycine max
  Peptide Sequence Number=SeqID_152818
atgaatggcgcagaagacgacgttagtctctgcgtgctatcaggtttttcggcttacagcaacaaaaagtttatacggataaccactcaggcttgtcggtcgcgattgacgaagggcgcagaagacgacattagtcaatgcgtgctatcaggcttttcatcttacagacagcaaaaagtttatacggataaccactcgggtatttccgcccgtcagcatgactcaaaagtcagtatgacagatcttgtgagcgcggaagatgacgtaaatctccgcgtgtcaacgggtttgtcagccgcgattggcgaagggcgcagaagacgaccttag

SEQ ID NO: 61134 - DNA, 449 bp, Glycine max
  Peptide Sequence Number=SeqID_152819
agtggtcatgttggtgcgcatggtccgcactcttctctttgcagcggcacgggtgaaatcttgccccagtatgcatagtagctgtgtgatagcctccctctctggttgtgctcgcacagttggcccctcctccaatatcaggggcccactgaaagtgaggacgcgtagtcctctaaaggcgagggcgtgtagccctctgaagttcaggacgtgtcgcctttcaaaggcgagggagtgtagtcctacgatggaaatgacgtgcaatcctctaaaggtgagggcgtgtagccctacaaaggtgaaggcacatgaccctttgacggcgaggaagtgtagtcctctcaaggcgaggacatgtagtcctctggaggtgagggcgtgcagccctccgatggtgaggacgtgtagtcctctcaaggcgaggacgtgtagtcctctcaacggtgagg

SEQ ID NO: 61135 - DNA, 410 bp, Glycine max
  Peptide Sequence Number=SeqID_152820
atgaggattcttgaacacaagggaagggttgtccctgtgtggttcagactttgtaaaaagagttttacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 61136 - DNA, 105 bp, Glycine max
  Peptide Sequence Number=SeqID_152821
atggtggggaaagccttgtggactggaattagaagatcctgtgtgcaagccttccttgccaaaaaggactgtgttcgactttttggtcctctgttctggtactag

SEQ ID NO: 61137 - DNA, 369 bp, Glycine max
  Peptide Sequence Number=SeqID_152822
gcattacgggccaatgcacctcttccttatcctcaattggtcaccctatttctccgtcattttcaaattcctcttgatgatgaaccttttgttcaagtcaagcgatcctttgctattggtgctggtgctaaggatgcgctacctcaacaagacgagtgtactccttctcctcctcctcaacgagattattcctcagcccttatgaatgaagttctttcagagttacggggcctccgcacatatgttggtgaacgatttgattccttggatggtcgctttgaaggcatggatacctgcatcacccaacttgtagaagatgtgacttatcttcgtcggtgcttcgatcttccaccaccgtctaagtcttag

SEQ ID NO: 61138 - DNA, 411 bp, Glycine max
  Peptide Sequence Number=SeqID_152823
atgccaatctccccctgcagatgtatcgagatcgcgcccacaagacgcccggtgggcccgaagaagtccaatagggccgtggggtttccagctctggttacgggcctctatcagtcctacagggtgcctgttcccccaacgaggaatcgcacccacaaagacacccagtggacccggagaagtccaacagggccctggggtttccagctctggttacgggcctctgtagtcctacagggtgcccgttccccccggcaaggtcatgtcatcatagggatcgtgcctgcaagacacccagtggacccgaagaagtccaacagggtcttggagttgtcaaattacctctggaaagactttgattctcaaagatgtgatgcatactccagagatgagaaagaatctggtttctga

SEQ ID NO: 61139 - DNA, 356 bp, Glycine max
  Peptide Sequence Number=SeqID_152824
atgaattttgcagcgagaaagcctgtagaattcatcccaattccagtgtcctatgctgacttgctcccatatctacttgataattcaatggtagccataaccctagccaaggttcatcaacctccatttctccgagaatacgacttgaacgcaacgtgtgcttgtcacagagacgccccggggcgttccattgagcattgtagggctctgaagcgtaaggtgcaaggtctaattgatatgggctggctgaaatttgaggagaatcgcgtgattttcaactttcaccggaagtgggtgcaagccattggtctgtttgctcaagcgacctgtgctcctgagtttggacttccaagacc

SEQ ID NO: 61140 - DNA, 243 bp, Glycine max
  Peptide Sequence Number=SeqID_152825
atgcagaaaaagctgtcaaattgtgcagcaaattttgccaattatgcagaaaaatggttgtgcagtgctagtcacgcgaaagcttggagggttgatggggacccggtgcgagaggaacgaggagaaggctatgtatgtgcacgtgagctaaaatttaaaggtgggcaactggggatggtttgcttatgcttggcttgtggaaatgggaaagttgatttgtgccatcgcccgatcgccacctag

SEQ ID NO: 61141 - DNA, 210 bp, Glycine max
  Peptide Sequence Number=SeqID_152826
atggtcctttttggtaacctagttcagcctcctatagtcgatgcagactctccaattgttctgcacccgagtaggaatcagctcctccttctcatttttgatctctgtgagaggcttcaattctggtgtggtcggctggatagtggtagaaggagatggtttctcagcctgtacctcataaagaaagtcagcggtatgtgtacttcctga

SEQ ID NO: 61142 - DNA, 159 bp, Glycine max
  Peptide Sequence Number=SeqID_152827
atgctccaaccatatgggatcagcataggattaaaggagcactcaaacccggtgaccccaaaggactacactccgaagagtccgtcaaggcctctccttcctgattcagacactgctcatgaattatataatacccccgatctcacactcgtgttttaa

SEQ ID NO: 61143 - DNA, 751 bp, Glycine max
  Peptide Sequence Number=SeqID_152828
atggccccgaggaagcttgcctcaaagaggtccaggaaggacaaggcggccgaaggaactagttccgctcctgagtatgacagtcaccgctttaggagcgctgtacaccagcagcgcttcgaggccatcaagggatggtcatttctctgggagcaacgcgtccagctcagggatgacgagtatactgatttccaggaggagataggtcgccggcggtgggcatcactggttacccccatggccaagttcgatccagaagtagtccttgagttttatgccaatgcttggccaacagaggagggcgtgcgtgacatgaggtcctgggtgaggggtcagtggatcccgttcgatgcagatgctattggccagctcctgggatatccgttagtgctggaagagggccaggagtgtgagtatggccagaggaggaaccggtctgatgggttcgatgaggaggccatcgcccagttgctatgtataccggggcaagattttgcccggactgctgccgggagacgggtgcggatcatgcgcaccaacatgaccaccctgactcagatatggatgactttgctgctcagcaacatcctgcccaccgaccataattccgacctccccctaccgaagtgtcagctggtatggcgcctaccaggcaccctttggatccagataagtccaacagggccctggatttcccgcgctgatcacaggactctgccagtcgttcggagtccccgtggcacctaccaag

SEQ ID NO: 61144 - DNA, 78 bp, Glycine max
  Peptide Sequence Number=SeqID_152829
tatattaacgatcctagaccattggagccagagagattaaaggtgcttcagatccagtgggcacaatattatctctga

SEQ ID NO: 61145 - DNA, 276 bp, Glycine max
  Peptide Sequence Number=SeqID_152830
atgcgtgctagagctagagtaatgggtgaagtagaggaggtacaagaacatatcaaggctgacatggaggccttgaaagaaaaaatggccacaatgatggaggccatgatgaacataaaggagataatggaggttaatgcggctgcaatagccgctaccagtgttgttgctaaggtgaactcgacgcccccatctggcctcaaccaaatgaatcatccaacctcagatatggtaggcaaagatttgggaagtacgggcggaccccattatgtgtaa

SEQ ID NO: 61146 - DNA, 177 bp, Glycine max
  Peptide Sequence Number=SeqID_152831
atgacatctgaggcagcaaaggaaatccttgagaagatcgcatcacagggatcgttcgtccctcatggacgtcaggatgtcttgactgttgccattgggcgagcagagcaccccagctgtgtccgtgctgcaggagccggtgtcaccatcaaacaatattttggatcagctccatga

SEQ ID NO: 61147 - DNA, 134 bp, Glycine max
  Peptide Sequence Number=SeqID_152832
agttagaaaatgatgcaatcctccccaggaagggaccagtcaccagagtcatgagcaagaggctccaagaggattgggctagagttgctgaagaaggccctaggattctcatgaacctcaggatagatttctaa

SEQ ID NO: 61148 - DNA, 302 bp, Glycine max
  Peptide Sequence Number=SeqID_152833
atggcctctggtaatcgattaccaagggtgggtaatcgattacaaggctttaaaaatgaagacaggaggctaagatggtctctggaagctaagggagcctctggtaatcgattaccagcctgtgtaatcgattacacagagggatgggtcactggctgtgtaatcgattaccagagacgaaaagccttaagatacccttcttacttgcatgtaatgatcgtgatggcggcgcagctaatccgtgatcgagtagagacggagtgcctaaagggagcttgggagaccctcgaaggcaacacgag

SEQ ID NO: 61149 - DNA, 702 bp, Glycine max
  Peptide Sequence Number=SeqID_152834
atgctggatatcgactatttcaagcgctacaacgatacctacgggcaccaggcgggtgacgactgtctgacgcgggtggcgcgggtgctgaagcagtcggtgcgcacacctgaggatgtggtctctcgctacggcggggaagagtttctggtgattctgtttaattgccctgaacatcgcggaaaaggttgccctgcgtattcaggacggcctgcgcgcagaggccatcccgcacggtgcctcagcggtcagcgaccatgtcacggtgagcatggggattacgagtatggcggaggggctagccggcaccgaaatcatcgcccgcgccgacgcggcgctgtaccgggcgaaagaggccgggcgggatcggtggtcacggtgataaagcccgcgcacgcacaccgatttagtttcacaccagccgtccagccagtccgggccaaagtcgcgtccagtgccggactgcttcatcccgccgaacggcaggttggcgtcaatcagcgtgtggctgtttacccaaacggtgcccgcctgcagcctgtcggtatactccagcgccttgctgatattctgcgtccagacgctggccgtcaggccatattcggtgtcgtttgccagctggagcgcctcttccccgtcggagacgcgcaccaggttgaccaccgggccgaacacctcttcgcgggtcaagcgcagcccggc

SEQ ID NO: 61150 - DNA, 465 bp, Glycine max
  Peptide Sequence Number=SeqID_152835
atgggttactccatgggtgcgcgcatttccgccttcttggccatggcgcatcccgagcgcgtgcgttctctggtcttcggcgggctcggtatcggcatggtcgaaggtgtgggcgactgggacccgatcgcagaggcgcttctcgcgccttcgctcgatgtcgtgacccatgagcgcggccgcatgttccgagcctttgccgatcagacgaaaagcgaccgcttggcgcttgccgcctgcatcgagacatcgcgggttctcgtcacgcgcgaccaggcggcaaagatagatgcgccgacgctgatcgcggtcggaacgaaggacgatattgctggctccggtgaagagctcgctgccatcatgccgcacgcgcgggcgatcgacattcccggccgcgaccacatgctggccgtcggcgaccgcgtgttcaaggcggcggtgctggatttctaccgttcgttctga

SEQ ID NO: 61151 - DNA, 873 bp, Glycine max
  Peptide Sequence Number=SeqID_152836
atggccaagttcgatccagaaatagtcctggagttttatgtcaatgcttggccaacagaggagggcgtgcgtgacatgagatcctgggtgaggggtcagtggatcccgtttgatgccgacgctatcggccagctcctgggatatccgttggtgttggaagagggccaggaatgtgagtatggccagaggaggaaccggtctgatgggttcaatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccagcgatcataattctgacctccccctgccgaagtgtatggcgcctaccaggcatcctttggatccagataagtccaacagggccctgggatttccctcgctgatcacaggactctgccagtcattcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttgatgagcctcagcatgcagagccagggcttcgcttctttttcatgccctactccagaccagttcagggcagaggtcgcatggcccggagattggcccgaggcccaagcaggagaggcacccccagaagctcccgacggtggagaagaggcccacgaggacgaggagatggccgatttgcttgacttcttgggagggagtggagatacgtga

SEQ ID NO: 61152 - DNA, 589 bp, Glycine max
  Peptide Sequence Number=SeqID_152837
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaggatgaagtggtttcgaaaccatcccacccaagtcacaacaaacttcgaggaaaaagtatggttgattatgagtatttgaagatcgttgttgggggtggagtttctagtgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaagatctgcttgtaactttgatttggaattcatgtacgttcttagcgggtgggagggttcagcacatgattccaaggtgttaagtgatgctttggcaaggaagaatggacttaaagtgccccaag

SEQ ID NO: 61153 - DNA, 237 bp, Glycine max
  Peptide Sequence Number=SeqID_152838
atgtgtggcatctcttgtcaatccagtcggcatcaattagaccttgcaccttacgcttcagggccctacaatgctcaatggaatgccccgaggcttctctatgacaagcacacgttgcgttctagtcgtattctcggagaaatggaggttgatgaaccttggctggggttatggctaccattgaattatcaagtagatatgggagcaagtcagcataggacaccggaattggggtga

SEQ ID NO: 61154 - DNA, 306 bp, Glycine max
  misc_feature (7)..(7): n is a, c, g, or t
  Peptide Sequence Number=SeqID_152839
atggtgnttggtcagaattccaaaatggtagtgacaaacggggcttttcccactggtggagagacattagaaatctgtatcaccagtcgaattgcagtatctttaaagacaacttggcttggaagctggaggtgggacatgaggtggaggaggaatctctttgatcatgaaagccatttggctgtgcattttatggaggaaattagttctgttcctattcaaagacaggaggatgtatgtcatttgtttttcaactgtaagctgacaaatggcctgtggtgggaatctatgcgctggttcgggtag

SEQ ID NO: 61155 - DNA, 431 bp, Glycine max
  Peptide Sequence Number=SeqID_152840
ccgatgatgctggctatctacgaaagacccatccgtgggcagagcgcgatcgcgtgccgatggcggatttagcgggtgaaaagctgttgatgctggaagacggacactgtctgcgcgaccaggcgatgggcttctgctttgaagcgggtgcggacgaagatacccacttccgcgcgaccagccttgaaacgctgcgcaacatggttgccgccggaagtggtattacactgctgcctgcgctggcggtgccgcaggagagaaaacgcgatggcgtggtctatattccgtgcattaagccggaaccaagacgcacaatcgggctggtttatcgtcctggttcgccgctgcgtagccgctatgagcatctggcggaggccatccgcagtactatggatggccacttcgataaggcgttaaaagaggcggtttaa

SEQ ID NO: 61156 - DNA, 294 bp, Glycine max
  Peptide Sequence Number=SeqID_152841
atggatgccaaagcaccctcacaaggaccaaagaaaggtcgaatgtcatcaagcaaaggtctccggacgaaattagggtatgacaggcctcatctcttggtcctcctgagctattatcctctccagctctgggggaagtcccacatcctcgtcctcttcactctccgtccgacccgcttcttcctcgaaatcgacggcagggtcctaggtatcagtccctttgagggactcgtcgtcggatctggcatttttaagcgtaaagaaataaacatgcaaatgaacgagaatgggtag

SEQ ID NO: 61157 - DNA, 258 bp, Glycine max
  Peptide Sequence Number=SeqID_152842
atggctgaacaatctgaaatattatttaatcaactggtgtattcctgtgcatttgaaaaacacaggggacatgaggaatttattcctgatcatttccttggttttcagctgtctggtgaaacccacgctttccatgatcaggggaaaaccgttataaaggaaaatacagtggttctgatgcctttgcaaagcttacagggcgtagtctttcaggcttcaagcgtgatcctccagaagaccattcaatatgcctcctaa

SEQ ID NO: 61158 - DNA, 1347 bp, Glycine max
  Peptide Sequence Number=SeqID_152843
atgtcccgattcaccgagcagcatttatacattgatggtcaatacgttgccgcagcagcgggcgacacattccagaccatcaacccggccaatggcgaagtgctggccgaggtccatgaagccgcgcaggcggatgtcgatcgcgcggtcgccgccgcgcaaaaaggccagaaaatctgggcggccatgacggcgatggagcggtcacgcatcctgcgccgtgcggtggatatcctgcgcgagcgtaacgatgagctggcggcgctggaaaccctcgacaccggtaaaccgctgagtgaaacccaggcggtggacattgttaccggtgccgatgtgctggagtactacgccggcctaattccggcgctggaaggccagcagatcccgctgcgtgatacctccttcgtctatacgcgccgcgaaccgcttggcgtggtcgccggtattggcgcatggaactatccgattcaaatcgcgctgtggaatctgcgccggcgctggcggccgctggcagaaatctacagcgaagccggcgtaccggacggcgtgttcaacgtgctgaacgggcgcggcgcggtgaccggtcagctgctgactgaccatccgggcatcgacaaaatctcctttaccggtggcgtggccagcggcaaaaaagtgatggccaacgcggccggctccacgctgaaagaggtgaccatggagctgggcggcaaatcgccgctgatcgtgtttgacgacgccgacctcgatctcgccgccgacatcgccatgatggcgaacttctacagctccggccaggtgtgcaccaacggcacgcgcgtgtttgtgccgacagcattgcagcaggcttttgaggccaaaatcgctgaacgcgtggcgcgcatcaaagctggcgatgtcaacgatccggccaccaacttcggcccgctggtcagcttcccgcaccgtgacaatgtgttgcgctatatcgaatccggcatcagcgaaggcgcgcgcctgctgtgcggcggtaaacgcatgagcggcgcggcgtttgataacggtgcctgggtagaaccgaccgtgttcaccgattgccgtgatgagatgaccatcgtacgcgaagagattttcggaccggtgatgtcgatcctgacctacgacagcgaggaagaagtggtgcgccgcgccaatgccaccgaatacggcctggcggcgggtctggtcacccgggatctgaatcgcgcgcaccgcgtcattcaccagattgaagcgggcatttgctggatcaacacctggggtgaatccgccgctgaatgccggtgggcggttacaagcactccggcatcggccgcgagaatggtttga

SEQ ID NO: 61159 - DNA, 309 bp, Glycine max
  Peptide Sequence Number=SeqID_152844
atgagcatagaactcatccacgaatcttctaaactctggattcagcacatcccagaattccttaataaaattgaagttaaggccatcaggcccaggacacttatcccctccacaactccacactgcttctttgatctcttggtcagagaatggggcaatcagctgttctctttgcctctgagaaatagatttgaagtgaactccatccaaggacaatgcccccccaacccccctgctgatccttttaccaggcctccctcaccattttttggtaccccttttgctgcagccaccagtcaaacaccctaa

SEQ ID NO: 61160 - DNA, 543 bp, Glycine max
  Peptide Sequence Number=SeqID_152845
atgtccgagagatttggcgacgtcgtggttttgactggcctgattctctgtctgtacctttttaatttcgatgttccctcgtcggtacgtgcattattttttatatttgtgaccgtaagcggtctcgggctcgcggttttttttgcggttactaaggttttcgtatatctcaatagacacttggtgctgtctagtcacactccccgtggactccggatattaaaaacaagttatgcattgacggcattcgagaccacgattcagcgctccattgaaggccgtctctctgcgctgtttttgatttccataatgatttggggctgcgaaattgccgcagtaactgttgcaacccgtcagattatgacggcatacccagacatcgctgaaatcgtgacctcagggttactcgctagcattactggttcgagcttgcaagtcgaggcagccgcgctcgtctatcaatccggcgcggtgattgtgttgtccttgctgttcatcaccatgctcaccctgacattccaccgcacacgcagaagcaaatga

SEQ ID NO: 61161 - DNA, 216 bp, Glycine max
  Peptide Sequence Number=SeqID_152846
ggtttcattgaccacattgtggatgtgaaagcagacgataactgtggatatcggtccattgccgctttgttaggtatgggtgaagattcttggtcgttggtgcgcaacgaattgattaaagaacttggcaaatggtcgcatgactacatcaacctcttcggtggcacagagagatttgaagaattaaggttagtgtggacaagtggatggatataa

SEQ ID NO: 61162 - DNA, 306 bp, Glycine max
  Peptide Sequence Number=SeqID_152847
atgttcaagaaaagaatagagaaatctgaaaagaaagtttttaatgaaaagaaggcaaagaaggcctacattacatgggatgccaatgatatggactcatctgaagattcagaaaatgaagtagtaaacctaagtataatggccaagagttatgaaagcgatgaagagaaaggacatggcatatgtcgcaacctactcttcggcgggagggtgacgcgagggctcacgggtgagtcttccaagaaaggaaaatgtgcggagtcgccaccaatgtttattcgaggaaacgtcgggaaaaccgaaaag

SEQ ID NO: 61163 - DNA, 144 bp, Glycine max
  Peptide Sequence Number=SeqID_152848
atgaagaatttccacagaatcgcttacggaagcgttacggaagttttcggaaattttacggaagtattacggaagccgcagaagccccgaaaaccatttttcaaaaacgtggaggagcttgccgcccagttgcttcctccttaa

SEQ ID NO: 61164 - DNA, 141 bp, Glycine max
  Peptide Sequence Number=SeqID_152849
atgggtgccaagtacctcgaagcggtcaagcaaaggttgcatgccatcaaacaatggtccccggacaaaattagggtgattgaaaaaatcattcaatggaagtcaagagcacgaaactacgccgataccgttgacttgtga

SEQ ID NO: 61165 - DNA, 134 bp, Glycine max
  Peptide Sequence Number=SeqID_152850
cgctaggcaatgacattcatggggctccgaaaaacaatggagaatggaggattgcactagagggaacagcgctaggcaatgacattcatggggctccgaaaaaaagtttgttggcagggccaaacggtccaccg

SEQ ID NO: 61166 - DNA, 219 bp, Glycine max
  Peptide Sequence Number=SeqID_152851
atggttcaagttgaagccagagaccataacatggctggactttgtggagtgtccaaaggctttggtcttggaatcataataataccaactgttgccactggtatggagtcctctgccacaaccttacttcccatcttcttcagcttcacctcagctcttcagattatgctttctacgatgaggaagcttatcggagatggagctttggtggagagataa

SEQ ID NO: 61167 - DNA, 597 bp, Glycine max
  Peptide Sequence Number=SeqID_152852
atgtctcctttccttgtgagggatttcggcgcacaaaattccaagactatacaaagaatccataaggcgtgggaaactccgttaaagaaagatcaagagcttagaggcattcgtaatggcatcattggtgggtaccacgaatggctgaaagttcatatacgagcaagagagtttgaagcatcggaagaggacgaagaagtccaaactctcaaaagcgagttaggaaaggcaaaactcgccaaggagaagttcaagttggctgctacacacgttcggaaggagtgcgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaagaagcttgtctcagcgtttatgcgagacggagaccaacatgttagctatcatcgccaagtaccaagaagagttaggtctagccacggcccacgaagcatag

SEQ ID NO: 61168 - DNA, 363 bp, Glycine max
  Peptide Sequence Number=SeqID_152853
atgattatgaggggccaagacatttataatagccaagatgaggctactacttcaccttactctagtgaaagtgaagaagcaaaaggggaagaatctagtgaagaaatctaccccaaagaagaaggacaacctttaatggttaaggagaagtgtaaggaggtaagtgtctcctccaagaggttagctaagaaggaaagtcattttgcaataaagacacacattaaagaaactttctctcttagacaacatccacatcttcttctttgtaaaaagacacttgttagcattgccacacctcttgggcttgagattgttcctcaagtaaagaagttgttggatgaggtttggttcgtaagagcttaa

SEQ ID NO: 61169 - DNA, 243 bp, Glycine max
  Peptide Sequence Number=SeqID_152854
atggggaaagcgattgtagttgcagctaccagcgctgttgctaaggttaacccaatgcccccatctgatctcaaccaaatgaatcatccaacctcagatatggtgggcaaagatttgggaagtatggacggccccatgatgtgcaaattcaaaacgagcatgtcttccctcccaactatacaccacccaatgtggcgtacactcccaatgagaatgtcaatactccactccgatactcattga

SEQ ID NO: 61170 - DNA, 552 bp, Glycine max
  Peptide Sequence Number=SeqID_152855
atggagaagagggtattgcccgaggcatcaagcaagagtttcttctcattgggaatggaatggcaaggccacgttttggaagcaacaacagcaaacccatggaggaaaggtggcactcaaggaagttctgcgcatgaaggccaagccataattgagggattttctagccacattccttgtcttatcccatgcctccaccttactaaagaatcgtcctcctcctcttcctccactgctcatagccgtgacaagggagttcttgaaggcaagaaccaaagcgggagaagttggagtgagaagttggggaacacgtcatgcgtgatgacgatgacaaggtgcgagttctgcaccagtgagttcaatgtcaaatttttccaaggtgttgctcttgaggaggatgacaataaggctgaggctctcgattcgaggatgtgttcgacgaggatgccaccaaagccatcatatatgctatcaaaggagattcgacaaagaaatggctttgaggcaagagtcgaagggatatttgggatgtctcgaaagagggaagtgtga

SEQ ID NO: 61171 - DNA, 2235 bp, Glycine max
  Peptide Sequence Number=SeqID_152856
atggcgcgagggctaattctatcttcgccaacactcactgcaacaacttgtctctttgcttccatctccaaaaccccgccaaaaagtttcaatctttcattcggtcttaaacttattcatcaccactatcatcttattccatcgccttgctccttcagcgtggattcttccccttcccaatgttcaatcgacatttccaagtacacagaaacattttccaggcgaatggccatggctggtctcaaaccccatcaccgaattggtcagcttctctttgtgtcactcatcttcccagcagaaaaattgaatcttttttgcaaaatgcaaatatttgctcaacttgctctgggagtgtctggtggccctgacagtatggcactctgtgtgttaactgctggatggaaaactgctggtgctgatgctgtcacatctgagaatggtggtttcatagatggactactggcaataattgttgatcatggtctacgagcagagagcaaagaggaggcaaatattgtttctcaccgagtttcaaaaatgggaatcagatgtgagattgcatgttgcgattggccaagtggcagaccaaaacagggtcagttgcaggaagctgcccgggaaatgaggtaccaaatctttcaagaagtttgtgcccaacaccggattggggtattgcttattgcacaacatgctgatgatcaggccgagttatttattttaaggctttctcgaaatagtggtgtgcttggacttgcaggcatgcctttcacctcccagattttccctacatatacacagtcctacagggaagttcaagcaaaccagggtatccttcttgtgcggcctcttctggaattttcaaaggaagatatgtacaagatatgccaaggaggtagtgagaattgggtagaagacccaactaatcaaagtccattatatgcacgtaataggataagaatggtgctgaataatttgtcatcttctgcgttcaagtttgaactccaagcactgatttctgcatgccgaataacacgcacatatgttgatcaaattgcctatagcttgatacgtgatgctgtggttatcaaggatcatgggtatgttgttattgatttacagattctttgtcctttgaaagttgaggacatatgcctgatgaagtttctttccttgatactgcagtttgtatcacaaaggcagaggcaaatcagaggtagtgctttgaaattgctaatggactacattcgtacttttccgtgcaagaattctgttacagcagcaggttgttacctttgcccggatcctggttctagagggtccagagtcttggtctgctgttgttctaatggttgtgcttttcctttaaagattgaatattttgagtcacaatctcaaggacaacaagggtgttgtgttgccaatgagttagaaaagattatagaggctgagaagtcatatgcaaatcacttggttctggatgcatcagatgtccactttttggatgtgaatcctgagttagttttgactgaagccaaaaggctaaacataattggtgaatcaacctacaatagcatttttgcattgcagaagcaagaaaccgctcacttcaggtctaaaactgaggtcatttctgactctgcttcaaagcatggggttaccccttttagcaaatcacttcagccagggcagttctgttacttcatggatcgattcattctcacatggaaattgaaaaataatattgataatgataaactttctggtttagttgattatgaaatggatttgggtgaagaaaccagaagcttgtgttgcacatcttgtgtagctggtaataataaagtacctgaggtgcgacacatgatagaatctgattggctgtatcttgctgaattatcaaaatatccactttccaaaaacttccctcaatacgaggttaaatcagtgaatggaaccaagcagataatggacagaacatctccatgtttgcactatgccagtgtatcagcaaaacaagctctccgcttgttaaaatctatcccagttgctgcaaggagaagcctgcctgttctgatcaatcaacaaggacaattactaagcattccacactgggacctaattctacattccggaatatttcagagtgttaatttcaagcactgccccttcttgatggtgcatatggaatttaagccaaaaataccgcttggaggaggtcatacctcattcatatag

SEQ ID NO: 61172 - DNA, 228 bp, Glycine max
  Peptide Sequence Number=SeqID_152857
atggttgtttatgtgcttgaaacaactcctaagtttagtgtaggaggtatgccaaaagaaaagaaggttcaagtagctgatgactcgcttagtgagtggcatccgcttagcaaggcatacagctcgcttagcgggttgggaaaccctagaagagaaagagtcagagatgtgttcgcccagtgcgcagctagccaacccatcgaggatggtgtctcttctcgcgcttag

SEQ ID NO: 61173 - DNA, 324 bp, Glycine max
  Peptide Sequence Number=SeqID_152858
atgccatccttgactttcctttcaaatccttatttctttgcagcattgtctgcatctttgactcttttgatggttcaagttctgttcagaaaactgaacaaaaggcatagtaaaaagaagtaccacgctgttgctggcaccatcttcaatcagatgctgaacttcaacaggctgcaccattacatgacttatcttgctgccaagcacaggacttacaggttgttcaaccctttcagatatgaggtttacacttctgaaccaactaatgttgagtatattctcaaaaccaattttgagaactatggaaaggtagatatttgttaa

SEQ ID NO: 61174 - DNA, 534 bp, Glycine max
  Peptide Sequence Number=SeqID_152859
atgacaccacctgatatactaagatggttcttaaggaactgtcttcgtttcgatttcgtaaaaagtgatttttctagtagtgaaaattatttcttggcaagtatggagtttactgttatttcgacaaatctcaagacaatattccgcaacccaaaagcaatcaaaccatatgctgttccatcccctgagcactgcaatctaccagcggctgctatgcatacatcttcacatatggttgaggttgttggtttgaatgcaccagcagctcaggttgcacagcacaagtggcaacccaacacacctgatggccagggtacaccatttttctttcaacatggaaaagctacatcaggctctgtgggtgggaatcttacacgcacgttcaaaggtcctgctggaactggcgaagagtggcaatatccccaagcattggctttttctgtttctggaattagaagccaagctattgtttctataacatgtgacaaagaaattataactggtaattatattgttaagatatgctgcctctag

SEQ ID NO: 61175 - DNA, 348 bp, Glycine max
  Peptide Sequence Number=SeqID_152860
atgttgaagatgtggagaccctacagctcagctagaaaggctttaatgctatggggaaggtggtgtttggaatctgggaaaatgggtttgttttctgggatttttatgggggtgttgttcggcatcgcattgatggctggatgggcgcgcatgatgaagtaccgaagtgccaaacgaattgcaaaggcaatgttggaaaaattgttgatcaacagagaagtgataagtaggaagacagtaccaaaaacacctactacagaattgcatttaggttttgtccttgataaaaattgggtgagcattgggttcatgggagtgtcaaactgtcagcaatcaatccactggtga

SEQ ID NO: 61176 - DNA, 615 bp, Glycine max
  Peptide Sequence Number=SeqID_152861
atggttggagcattctcgcaaaacatcatgaccctgactggtctccctatgatcttacttagtgagagtgacctgacaaacccattgtgtggtgtgtcttgttatgtactcctaagcgccccagggtggtttttcactgacatgggtgtcataagtttcaatctagctgaggaactgcattacatgtcatcaaaccgcatcaactatttcaactttgtgatttttgccatggttgatgagcttcatgagaagatgttggagtactcaaggagggaaaatgctgagagggaatcaaggagtacggaagaaacccttaagcttgcaatggagctgttgtcagatatgtacttgcagtcattgagacaaataaccgagagttcgggatttaggacattctggtcaggcatattgagaaggaaggacacatgcatgaaggctgatttgggacagtatggtccatcaactttgggtgaaataatccctgatttgttgagaaagatcataacacaaatgaaggaagagggaattttggaaccaagatatgtgggagattacatatacttagatacagtggatatatgccctcatctcaaggatgagttatttcccttatag

SEQ ID NO: 61177 - DNA, 204 bp, Glycine max
  Peptide Sequence Number=SeqID_152862
atggattatggtattattgtcactataacatggggcacagagaaatccattcaatttagaagcacaccatgtacgctatggcctgtttgccgagttgagaaaaagtacggtacagtgggcatgggtactcactggcccaataatagcccacagtctatagactcaagtcaagaggaaaagaatggctacctcactaagccatag

SEQ ID NO: 61178 - DNA, 3390 bp, Glycine max
  Peptide Sequence Number=SeqID_152863
atggaaggggcgagacagggtgaggtggagacagtctcgccaatgggaggggcgagacaggctgatgtgatggtgccgccacccaacggcaacgtcactgccgctgtcaaccaacggccaccggccgatgacgtcagaggaaccgacacgccaccggaaaaggtgccgcggcgcgttttaccggcaaatttcgcgccaaacgagaaagaatctggtccctccctgtttgaaagcatcatgcacaaatttgtcaaggtcgacgacaacgaaagagttactcagagagtttgtgtttcccatatttaccaagaggggaatgcctgtgtggatgctttagctaaattggcctgcaatatggaagttgatgtcttgatgtatgagcagccaccggcttatctgactttgttgctttgctctgatgttattagggtcactgcccctcaattaatttcgttgagccactcattgaatggtagtttgcctaaatcttctttaccagtgggaatatgtgctgatactgattgtaaagtggtgaacaaggcagaagcagcttttcaacctttggtgaaagtgaaagataatgctgtgaatttcaaggaaaaggctaatcaagagaacattgtggtggttgaaactgatgataatgtcactggaccagaaaccccagggatgctgcctcttgcttctcatgtgaagcgaagtcgagaggatggatccaagtttggttcgttgctgaattctggcaaacgagttagatttcttgacggttcattggaattggacatgactaagaaggaagcagaagtggctagcaagtttgaatggctcgatccttctcgaatcagggatgctaatggaagaaggccggataatcctttgtatgacaggacaacgctttatattcctccagaagttttggggaaaatgtcagcatcacagaaacagtattggagtgtcaaatgtaaatatatggatgttttgcttttttttaaagtgggaaaattttatgagctttatgaaatggatgccgacattggccataaggagcttgattggaaaataacgttaagtggtgttggaaaatgtcggcaggttggtatatctgaaagtgggattgatgatgctgttctaaagctggttgcacgtgggtataaggttggacgagtggagcaattagagacatctggagaagcaaagtctagaggagctaactctgttgttcggagaaaattagttcaggtactcactccatcaaccaatgtggatggtaatattggtcctgatgctgttcaccttcttgcaataaaagaggaaaacaatgtcttggataatggtgcagttgtgtatggatttgcttttgttgattgtgctcggcttagattttgggttggctccatagacgacgatgcttcctgttctgctttgggggctttattggtgcaagtgtcacccaaggaagttatatatgatagtagaggttcgaggacactacagttcactccagttcagtccatcactgacttggtgaacaatgaaattagggatttaattcactcaaagggatacttcaaaggctcgtctcatttgctggatcatgtactgagcaatgtgattcatcgtgaaatcaccttgtctgccctaggcaggctgattggtcatctggatagattgatggtacacttttgtacttacaatgatgcccttctagagaggaatggggatttatatccataccaagtttacaagggttgcctcaaaatggatggtccaacaatgataaatctagaactctttttcaataatgaggatggttcattgtacaattgtcttgataagtgtgtaacttcatctggaaagcggcttcttaggaactggatctgctgtccattaatagatcctgaaataattaacaaaaggcttgatgtagtggatgatctaatggctaacccagagattgtgccacatattgctcaacatcttcgcaggcttccagacttggaacatttgcttggccgaattaagtccagccttcaattatcaggccctctcttattgcccctattgggaaagaaaatattgaagcagagggtgaaagtgtttggatcacttgtgagaggccttcggactgctttgagtttgttgcttcttctacagaaagagcagcctctaatatcgtctttgaccaaagtttttaaacttccaattctgactggtagtaacgggcttgatcaatttcttgctcagtttgaagcagcagtagacagtgacttcccaaattaccagaatcacaatgttgcagattctgatgctgaaacactcaaaatacttgctgaattatttttggagaaagctgctcagtggtttgaagttgttcatgccatcaattgcattgatgtattaagatcttttgctgttacttctaccttttcttgcggaactatgtctaggccagttatagtggcatcaaaaggtacaagtaaagacaatggcagaacagtgctcaagatgaagggactatggcatccatttgcccttggagacagtggatgtttgcctgtccccaatgatgtgatccttggtgagaatgaagatgggttgtatcctcgaactttgctgcttactggaccaaacatgggtggaaagtcaacacttctgcgttccacctgtctggctgttattatggcccagctaggctgttatgtgccatgtgaaagttgtgttctctcagctgtggatatcatcttcacacgacttggagccaaagatagaatcatgacaggcgagagtaccttctttattgagtgtactgaaacggcatcggtgcttcagaatgctactcaagattctcttgttatccttgatgaattgggtcggggaacaagcacttttgatggctatgccattgcttatgcagtattccggcatctgattgaaaaagttaactgtcgcatgctatttgccacccactaccatccactcacgaaagagtttgcttctcatccacgtgttataatgcaacacatggcttgtgctttcaattcaaaatcggatacccactccatgcgtgatcaggaactagttttcctatatcggcttgcctccggaccatgtccagagagctacggcttgcaggtggccctcatggctggaatcccagaaaaaacggtaaacattgcttctaagtcaagccagaagatgaaaaaatcaattggacaaagttttaggtcaagcgaacagagatcagagttctcaacccttcatgaagaatggttgaagaccttggtatctatctcacgcatagaggattgtaactctttggatgaagatgctttagatacattaatctctctgtggtatgaacttaaaacttcatttatatcaggcaagtaa

SEQ ID NO: 61179 - DNA, 582 bp, Glycine max
  Peptide Sequence Number=SeqID_152864
atgtgtcacccaggagttccttttgtgaaccgagagggcttgatggtgcatagaagatggcttgtgtcaccactggcaaggcatgcaccgaggcaggttcatgatggtggtggctctggagagagtggttcggtgaagcactgcgtgtgctcgccgtcgcagcatccgggttcgttccggtgccggttgcatcatggcgatatcgaatggaatgacgcccttagcgatatcttcgagcaggtagaacgcgtcgtagataacctcaaatccgtcaatggtgagcgtggcgtcgacgtaggaggagccacgcgccctgatgcggccgccgccgccgccggtgacgaagccgagctggcggccgcggtagccgacggagacggcgagggtgtcataggtgagggagaagaagtctctattgtggactttaacggtgatggagaaggagaggtcgagaatgggcctcgggttggttcggatcccgatgcggttgagtcggattcgggtaaggcggatctccgggtcggaggggtagaggaggaaagcggcgccggcgatgaggaggaagaggaagagcgcggcgga

SEQ ID NO: 61180 - DNA, 718 bp, Glycine max
  Peptide Sequence Number=SeqID_152865
atgaggctatggtggaaaggtagtgatggtgagtataacaagattactatggacagtcatgcattggagttgtctaattatgtcattgctaacagttgtgaggtggagttgtttgtggaatgtgctggtggtaataaggtggttgtggatggaaatttttctggtgattctaaagacagtagtgatgaatcagtgaaggatgaaggtgattcaagtaatgatgcttgtgctagtgtttttgttcacaaagatgatgacatagctaacaaccaacgtgtatgtgttgaattaattgaagtatctaacgattacttcaaccaggaggaaaacttaaacctaccaagtgaagtgcaaagtaatgcacattttaggctggtggacaaggttgatggaggtaaaaaggttgttggtaagggtgagaaggctagtagtggaggtaagaagcttcctggtagagatcataatactaggagatgttcattgccacctctagtagtacctgaagaagtaaatgaggaagctagtagagctattgaagttgtagctgaggatacaactcaaggtgcaaatgttgaggttcagactaggcaactcaatgtagttaagggaggcattgagggagcaactgagggtggaaatgcggttcagaccggacaagtcaatgttgttgagggtgacactaagggagtagctgaagctggaactgagggtggaggtg

SEQ ID NO: 61181 - DNA, 429 bp, Glycine max
  Peptide Sequence Number=SeqID_152866
atggtcaattggggtgtcatccctaccctagcaatgacccttcttcctgcagctcctgaccttgacgtccagaaaggatgtgcatatacatccttgattggctttcttgcagatgatgataaagaacatcctgttttcccaaccaacttgaagctccttctaccaaaaccaacagcatcatcatccatggcatctcaaggtcacggtaacaagctcatcgtttcaacatcaccaaagagtgatagtggcggcggcggtggcggcacgggatcattgcccaaaggacagtgcttgtgctcaccaacgacacatgaagggtccttccggtgccgtttgcatcgtgggcatacagcttcaccagctaattggatgaaacgctccaagtccatgcctgccaataagcctgtggtttctgactccacatgctga

SEQ ID NO: 61182 - DNA, 2079 bp, Glycine max
  Peptide Sequence Number=SeqID_152867
atgccgcgatccaattccgctgtgcaccaccaccgtcagagctccgataacttcatgttcgacgctcacggaaggtggttactctcttcgacttacgcgcaggagttcgggactcgatcttcgagcttgaggagaaacgacgatgatcgcgttttagccagtggcttgcttgatctgcattcgttcgataccgagcttttacctgagatgtatggtgttcacaatgaatatttaaccaatcacactgttcggggtcagagttctgatgactacgagtctattctctctggcaacaaacttgtaccaaggtctcggggcttgcctgagagccatcttcttaaaagtgtctcaacagaaaaagagagagcaaagaatgctgccaagatcaaagttgtggttcggaagagaccactaaataagaaagaaatagcaaagaaagaggaagacattatttccatagattcaaattttctcacagtgcatgaaagaaaactcaaggttgacttaacagaatatattgagaaacatgagtttgtttttgatgctgtgctgaatgaagatgtttcaaatgatgaagtatatgctgagactgtggagccgattgttccactgattttccaacgaacaaaagcaacttgctttgcatatggtcaaactgggagtgggaagacatatactatgcaaccattgcctctcaaagcatcccacgatcttttaagattaatgcaccacacataccggaaccaaggtttccaactgtttgttagtttcttcgaaatatatgggggaaaactttttgatcttctcaatgatcgaaaaaaactttgcatgagggaggatgggaaacagcaggtttgcattgttggcttgcaagaatatagagtatctaaagttgagacaatcaaggaatttattgagagaggaaatgccacaagaagtacaggtacaactggagcaaatgaggaatcctctcgatcacatgctatacttcaactttgtattaagagatcagctgatgggactgactcaaagcctgctcgacttgtgggcaaactatcttttatagatctggctggaagtgaacgcggtgcagatactacagataatgacaagcagactaggattgaaggggcagaaataaataaaagcttacttgctctgaaagaatgcattagagctctagataatgaccaagggcatatacctttcagaggaagtaaattgactgaagttctgcgagattcatttgtcggtgattcgcgcactgtaatgatatcatgcatttcacctagctcaggttcatgtgagcatactcttaacacattaagatatgctgacagagttaagagcctgtcaaaagggaacagctctagaagggatcccctttcctcctcaaaccttagagattccactgtgttgcctggctcttcagtcttatctcgtgatgaaaccatggaggatgaaataacttatgtttctagtgacaagaatcgatttggttggcccaaacagctggaaagagaaccctctcctccaaacaatgtagaccgtgttccaagtggtagaatggggggaaatttggcaccatctatgtattctgatccacaaaatggtcaaagaggtagtcaaaatgccagaactgcaaatgaatatgattacctaggactggcatatgaacaagacagaagaagaaaaacaagtaagagggtggataacaaccaattagctgctgtggaggacaataggaagatagaatctcgtgttaaacatgtggatgaatcagattttgaggctaatcattctgatccccatgataatttaaatgccctcctgaaggaagaggaagatcttgtaactgctcaccggagacaggtggaggaaacaataggcattgttagggaggagatgaatttgctcgttgaagctgaccaaccaggaaatcaactggatgattatatttacaagttgaataccattttatcacaaaaggctgcaggaatctttcaattgcagtcacagttggctcaatttcagagacgtttaaatgagtataatgttgtcgtaacttctggtaattga

SEQ ID NO: 61183 - DNA, 435 bp, Glycine max
  Peptide Sequence Number=SeqID_152868
atggttgccaaaaatcatttctaccatattgcatttgcaatgcttctctgcatggcattcttggcttttcaagtcacatgtcgcactctccaagatgcatccatgtatgagaggcatgagcaacggatgactcgttacagcaaggcaaaagggagcagttacaccgtcaaggaccaaggtcaatgtgaacttgttgattgtgacacaaagggtgtggaccaaggttgtgagggtggtcttacggatgatgctttcattttcatcatccaaaatcatggactcaacactgaagccaattacccctatataagggtgttgatggaaagtgcaatgcaaatgaagcagccaagaatgctgctactattaattactgggtatgaggatgtccctgccaacaatgagaaggcacatacttcaaaaagctgtggccaataa

SEQ ID NO: 61184 - DNA, 267 bp, Glycine max
  Peptide Sequence Number=SeqID_152869
atgactgttgcagacagtattaagattgctctccctaagaccgataatgctaaagagtttatggaattagtgggagagcgctctcaaacagctgataagtttcttgttgggacattaatgagtacattgatcaccatgaagtttgatggttcacgtactatgtatggacatgccattgatatgacaaacattgcaataagacttaagaccttaggaataattgtgaatgagaacttccttgttcaatttattttgaactcattatag

SEQ ID NO: 61185 - DNA, 745 bp, Glycine max
  Peptide Sequence Number=SeqID_152870
atggagttgctcgaggtgtttggtgaggaggctagagccgagacagtacgagcacgcggggcatatgtacgcctctcatgggttcgggagatctatgagatgagatgtcggacacgacgatggattgtagcagctcatgcttatctcctgcacctggtcggttggactcttttttctaacaagagtgcaacaaatgttcatgtggtgcatctagaggcttttcgcaacctgggtcagagtgggggctatgcctggggagctgcggccctggttcatatgtatgaccaggtagatgaagcttctaggatcacgacacgacagattggggggtaccttactttattacagtgttggacctatgagcattttccgagtgtgcatcagtgtgtcaccgatgatgcgtataaggagacgtcccctcgtgcctcccaatggctgataacaaaggctcatatgaagggaattataggagcgtcgtaccgggcacgttgtgatgatttgacggtcatagacgtgtgctggtttccttacagtgaccatcgaggggttagggggtttgagatgatttcatcgttccagggtcagctgagatggggtcctacgttggtcacagttcgaccggagagggtgctacgccagtttgggtacattcaaagcatctctccgctgcctgttagtgcttcattgtcatatgatgatatagatgacaggtggatgcatttctcggaccacgtagtagctgcgg

SEQ ID NO: 61186 - DNA, 870 bp, Glycine max
  Peptide Sequence Number=SeqID_152871
atgggaacaaatcaaaccggcaagaagttctaccaagtcaaggtcaaaagcctagataccaccaacatcaaggaattaaggcggttgatggaacccctccaaatgcaagccttccgcaagacttacggaaagatcttagagttgaccatagcagaggtgtccatagaagccattgtatcacttacccgatactacgaccagcctttgagaattgcaactgtggtcaaggattcagcaagaggtttggaccgcataaaacagactcggaacggcatagcgggcctaccacggaggtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcataccaccataggaaggaaagtccggtggtagctgttctggcagatttatttgacacatttgaccgaaggtgcgaaaagagtagcgcacggatcatctgttgcttgcccgccctctgtgtttggttggtttcgcacttgttcaagcaagacacaaggcatccatgtccgctcttgagccatcgctcgtgtactgaaaagaggagaatagattgggaccagcttttggccgggataggaggtagaacaatcaattggttcccccaatggaaggaaggaaaggaaggagtccttttctcatgtggaggatacccaaacattccgctgataggaacgaggggttgtattaactacaatcccgcgctcgctataagacaactagggtaccccataaggggagcaccgacggaagaaagcatgtctcttttcctt

SEQ ID NO: 61187 - DNA, 963 bp, Glycine max
  Peptide Sequence Number=SeqID_152872
atggggcattacgagagaaaaagctcgtcgtgggtcaagaccagagagctacaggtacaccaggggcaacagagcactcgggcggggtcagggcaagggcagcacgtcacggaagttctcagcttaatcttaccaatgctatatcttgggtgcgcgatatggtgggactgtctagcacagacacccccaagcatccctgagttacagcagctggcagaggcaacacaaatcggggaaccggcaagttcttccgcagaagtaaggcagctagtagaccacctcaatgagcaagccagggaggtggccagtgaagcttcaatggaaagaacacccagagctcttgcaatgtggacggctgggctaacgctagcattcgctatctccttagcgcttgctcaaaagacgagtgaaatgggaaagaaaggtggaggtgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgcaaggctactagagaaggggtgaaaccagccaagggcgggctccaaggcgacaatagcaatcgagtggccaagcgttga

SEQ ID NO: 61188 - DNA, 141 bp, Glycine max
  Peptide Sequence Number=SeqID_152873
atgaacaaaaagctcaaaagatcaaagaacaactcaagtgaatcaaagaacaactcaagtgaatcaaaggacatctcaggtgaatcaagaacaagtcaagagttcaagaatcggggaaggattccggactcgggaagaagg

SEQ ID NO: 61189 - DNA, 500 bp, Glycine max
  Peptide Sequence Number=SeqID_152874
tcaatgagcaacctgaagcctatgctgcaaacatttataatagaccccctcaacagcaaaaccaacaacaacagaataattatgatctttcaagaaatagatacaatccaggttggaggaatcatccaaatctgagatgggcaaatcctccacaacaacaacaacagtctgtccctcctttccagaatgctgttggtccaagtaggccatatgttcctcctccaatgcagcagcaacatcaaagacaacaagcaactgaggccccttctcaaccttccttagaggagttaaatccgaaaaatgtgagtgccatcaccttgaggtctggcaagcaaattgaagtgcctccaccagtagctgcacctgcacctgaacctgtcaagcttcattctacacctgaaaaagaggatgagctagcttcacaaaagagaaagcttcctgatcatgagggagctaacaaaaattttcatgcaagtggaccctcttccatttccacctag

SEQ ID NO: 61190 - DNA, 276 bp, Glycine max
  Peptide Sequence Number=SeqID_152875
atgatgacaaaggtgatgaacaaaaagctcaaaagatcaaagaaaaactcaagtgaatcaaagaacaactcaagtgaatcaaaaaacatctcaagtgaatcaagaacaagtcaagagttcaagaatcaagaagaattcaagactcaagaagaaagcctacaatcaagaatcaagattcaagattcaagatctcaagaatcaagatcaagattcaagactcaagattcaagaatgaagaaaagactcaatcaagataagtattgtgggatcctctag

SEQ ID NO: 61191 - DNA, 234 bp, Glycine max
  Peptide Sequence Number=SeqID_152876
atgcaatctcagggacttgtagtgcctcctgagcctctggtttgtccctccagtcctcgagtgagcacaaaggggagttgtgttgatccctcaggaaacgatcttgagatcggtgactctgacaggtgcggcttgtacctagaagcagatcctgcccgcttggttgccatagggagagtttatgagggatccactgttgttcataacacccctttgttgtatggccaagtaaag

SEQ ID NO: 61192 - DNA, 648 bp, Glycine max
  Peptide Sequence Number=SeqID_152877
atgggtgccaagtacctcaaaatgaggtctagaagagacgccgcagcggaagggtccaatgccacccccgagtttgatagtcaccatttccggagcgccgagcaccaacagcgcttcgaggccatcaaaggatggtcattccacaaagagaggtgtgtccagctcagagaggatgagtatacggactttcaggaggagatagctcgcagacattggacgtcgttgccgactcccatggctaaggttgaccctgagatagtcctagagttctatgctaatgcttggcccacagaggagggagtacgagacatgcgttcatgggtgacgggtcagtggattccctttgacgcagatgccctcagccagttcctgggtgacccgctagttttggaggaaggccaacaatgtgagttcggccagaggaggaacatggccgacgggttcgacgaggaggccatagcccagctgttatgcacaccggggcaggatttcgctcggaccgctgcagggaggcgggtgcagatacatgagtgtctctaccggttcagcctcagtcagcaggggcagggtttcactccttttgcatgccctactccagagcagttttgggctgaggtcgcatggcccaaagactggcccgaggcccag

SEQ ID NO: 61193 - DNA, 444 bp, Glycine max
  Peptide Sequence Number=SeqID_152878
atgatcttcttcttcaagaaatgtggagcatcgattgggtgcgggcgtagggaaacacgtagaactgcacccgccagtcaggagagcagtcatcgctacacatcacgcagtggaggtgctcaccagcgcggagggcctaggtcatgccttgtgtcattgattgaatgttgtggttggatgtgctggttgcatgcaaaaacaatgcaaaccgccagctccattggcgcatttgctgtggctgtgacacgtggcgaatacgccattgccactagcgggttccatggtatcgccagccccattggcgatttcgccatgcaagggggagtagccagtcaaactggtgagttccaagcacagggcgcaggcttctcagccttttcaggcttttcagttggcaggctttttcagttggcaggggcaggggtacaggctaaagggaagtag

SEQ ID NO: 61194 - DNA, 504 bp, Glycine max
  Peptide Sequence Number=SeqID_152879
atggcggccgacgatcagaagctgctgatggcgtccgatgccggttacggcttcgtttgcaccttcaacgatttggtggcgcgcaaccgcgccggcaaggtgatgatcacgctgccggacaacgccagggcgctgccgccgatggaaatccacggcgcagacgatatgctgctgtcgatcaccgccgccgggcgcatgctgatgttcccggtcgccgatctgccgcagctgtcgaagggcaaaggcaacaagatcgtctccattccggcagcccaggcggcggccggtgacgacaagctggcctggctgttcgtgctgccgccgcaggcgtccgtcacgctgcacgtcggcaaacgcaagctgacgctgcggccggaggatttgcagaaattccgcgccgagcgcgggcgcaagggcacccagctgccgcgcggcctgcagcgcatcgatcgcgtcgaagtggatgcgccggtgcgggcgtcgggcggcgacagcgaagagtaa

SEQ ID NO: 61195 - DNA, 135 bp, Glycine max
  Peptide Sequence Number=SeqID_152880
atggcctccatcattgtggccatttgctctttcatggccttcatgtcggccttcatctgctcttgcacctcctctactccacccattactctacctctagcacgggttcgaggaaaatgcaaggatcatgcatga

SEQ ID NO: 61196 - DNA, 381 bp, Glycine max
  Peptide Sequence Number=SeqID_152881
atgggcccagttttgccagactcgcaaagacccttcttgggaggatgtgcggaaaaaggcaaagagttggaggaagctgcacagtcaggaagtgttgatggcgtcattgacacttcattcctcgtcagacgccacgtgaagtggaagatggcccgcaccaagaaaacaagggagatgacgactgaggctataaaggaaatcgttgagaagatcgcaagtcattttcaactaaccattagaattatatttctttattttgtgaatgccatgtgcaaatgtgtcttttctgtgcaggattcctttgaggagcaggcgtcacagggatccttcatcccccatggacgtcaagatgttctcatcgctgctattggacgtccatag

SEQ ID NO: 61197 - DNA, 348 bp, Glycine max
  Peptide Sequence Number=SeqID_152882
atggtcattgaccaatccctattctatgacttgacccaattatctagtgaaggtgtaccatttcaaggtgcagtgaaagatgattggaaatttgatttctctgtgcatgatgcccgccagttggtttacaccaaccaagtggatatgaccggaaggctgcttgtaggttcattggcttttgaaagccgcatccttcactatcttattgtacgtattttacttccaagatcttcaaaccttgcacaagtttctgaagaagatcttattgtcatgtgctcttctcttcctctcccttcattcatcttcttctaccttcaagctcttatccatggcttcctatggtggtga

SEQ ID NO: 61198 - DNA, 264 bp, Glycine max
  Peptide Sequence Number=SeqID_152883
atggctactactagcactattagtattgctcaagttgatgctatggatgagtttatacaatttgaagatgaagatatgtcgcaagtgggtaaatctcaactagatacatatttggaagaggcaaatattccaaataaatatcatcccaatcttgatgttttgcaatattggaaggacaatcaagcagtttctagatctttaattattggcttgtggtattttaagcatccaaattacgaccgtggcttccgaatcggcatttag

SEQ ID NO: 61199 - DNA, 49 bp, Glycine max
  Peptide Sequence Number=SeqID_152884
ggtgaatgctgtgaaaattttcccgaacgcccaaaatggactcgaatga

SEQ ID NO: 61200 - DNA, 451 bp, Glycine max
  Peptide Sequence Number=SeqID_152885
ccagttcctgggagacccactggtgttagaggaaggccaggagtgcgagtttagtcagagaaggaacagggccgatggggaggcgggtgcagatcatgtgcaccaacatgacttccctaacccagatatggatgacgttgttgctcagcaatctggtgtatgccatcctgacacggatgagcgccatgtggctcagttgattgctgacgccatctatttatttgcaggtatgccacccaccaagcaccctctagacccgaataagtctaacagggccctggggtttccagcatttatcacgggcctatgccagtcattcggggttcccgtcacacctagtaaggtgatccggccgccgatcacccgagccttcattgagaagtattgcacgcctaggcaggcgcagggtgatgcgccacaggccgcagatgcaccgccaccacctcattag

SEQ ID NO: 61201 - DNA, 237 bp, Glycine max
  Peptide Sequence Number=SeqID_152886
atgatgggtaaatctccgcgtgtcaacgggcttgttgggccgcgattgacgaagggtgcagaagacgacatagcaaaagaaagttttgaaatggacaaccaatctgggtatctccgcccatgtcacgtgactcaacggtgtcagtatgacagaaattgtgaggcggctgacaaaagcgaggctcttgctcctacgtatcctcaaatgaggaattcagacctacgtagttctggataa

SEQ ID NO: 61202 - DNA, 300 bp, Glycine max
  Peptide Sequence Number=SeqID_152887
gccgcagacacgccgccaccttatcaggccggtccagccgaattgtttgatacggagcagtatttgcggcatttggttcgccagcaggcggccaaccatcgggcacatagccagggctttacttcttttccgtgccctactccggaccagttcagggcagaggtcgcatggcctggagattggcctgaggcccgggcaggagaggcgccagcagaggctcccaacgaggcagatgaggcccacgaggacgaggagatgaccgatttacttgatttcttaggagggagcggggccacatga

SEQ ID NO: 61203 - DNA, 199 bp, Glycine max
  Peptide Sequence Number=SeqID_152888
gtacacgatgaattcgattataacagtgttgtatttcaatggaagggcaagtaaaaaagcgattcagattaaacgtggaattagtttcaatgctttgaagaaaaaaattggagataaggaaaatatattgccttgcaaatttgtgatgacgaagacgttgagacgatgctggaaactaaaacttatcaaattaaattaa

SEQ ID NO: 61204 - DNA, 232 bp, Glycine max
  Peptide Sequence Number=SeqID_152889
atgtcagctcaaaacaagctcttggccaagactttagaaaccctcacaacaactctaagtaatctccctcaacagttgcatgcagtgcaaccttctccatcttcagtcatgcatattgggggatgcaacatttgtggtggtgctcatgagtcaggctcgtgcatggctcaagaagacgcatctatcggccaaggttggaaatcctatccagggaataacttcaaccaaggag

SEQ ID NO: 61205 - DNA, 279 bp, Glycine max
  Peptide Sequence Number=SeqID_152890
atgtgctattttagacagatcttcattctttatgtcctaggggaagtgtttattaaacaccctaagcatggtagcatcccacataacctgcaatggcttcagaaaaagttgtggggtggttttccaggtcccacaactccttgtttatccaacagattggttagcctcaccacgaaaatatggtcaaacttattggttactgcactgatggtaaaaacaggcttctactttatgagttatgcagaaaggaagtttggaaaatcatttattcagaagtaa

SEQ ID NO: 61206 - DNA, 300 bp, Glycine max
  Peptide Sequence Number=SeqID_152891
atgggtgaactagagaaggtgcaagagcagatgaaggccgacatggaggccatgaaagagcaaatggccacaatgatggaggccataataagcatgaaaaagataagggaagtcgatatggttgcagttgctgctaccaacgccgttgctaagtacggacgaccccatgatgtgaaaattcaaaacgagcacgccttcccatcatatggcttgcctcccaactatacaccacccaatgtggcatacactctcaatgaaaatctcaataactccactccgatactcattgagaatcaataa

SEQ ID NO: 61207 - DNA, 438 bp, Glycine max
  Peptide Sequence Number=SeqID_152892
atggcttctccacttgcctcgcctcctcatcctcctcctcctttagacgcatcagcttcgtcgtctgccctgaagcggacatgcaaagcctcacatctacgatccttgtctaccagaccacctggtgctgatagaccagtggtccacattgatcctactactggcaaggctgacggtcctcacaggaagaaattaagaacatatttagggattgtagcgcgtgataaggtggatgtcacgtacgagaactggaaggaggtccctactgctcagaaggacttgatttgggaggatattcaatttaaatcagacctcacgagaaaatgggcccttgaaaccgatcaggacggtgtggacgacactgtctgtgataaatacgacataagcaaggaaaaatgggcccagttttgccagattcacagagacccttcttgggag

SEQ ID NO: 61208 - DNA, 219 bp, Glycine max
  Peptide Sequence Number=SeqID_152893
atgcaaccaaaggtggtctgggggagcaaaaaccgtgagtcccgggttgctcgcccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61209 - DNA, 1044 bp, Glycine max
  Peptide Sequence Number=SeqID_152894
acatccagaagaagcaaggttgctatcccctccaagaagaggaaagaaatttcctcatccgattctgatgaggatgtcgaactagatgtctcgacatctaagaaggccaagacttcagggaagaaggtgcctggaaatgttcctgatgcaccattggacaacatttcattccactccattggcaatgctgaaaggtggaaattcgtgtatcaacgaagactggccttggaaagagaactgggaagagctgccttggattgcaaggagatcatggacctcatcaaggctgctggactgctgaagactgtcagcaagttgggagattgctatgaaggcttagtcagggaattcattgtcaacattccctctgacatatcaaacagaaaaagtgatgattatcaaagagtgtttgtcagaggaaagtgtgttagattctcccctgctgtgattaacaaatatctgggcagacctactgatggagtgatagatattgatgtttctgagcatcaaattgccaaggaaatcactgccaaacgagtccagcattggccaaggaaagggaagctttcagcagggaagctaagtgtgaagtatgcaattctgcacaggattggagctgcaaactgggttcccaccaatcatacttccactgttgccacagagagatctcctctatccctgcattacaaactgtttgaagggacacatgtcccagacattgtctcgacatcagggaaagctgcttcaggtgctgtgtccaaggatgccttgattgctgaactcaaggacacatgcaaggtgctggaagcaaccatcaaagccaccacagagaagaagatggagctagaacggctgatcgaaagactcacagacagtggcattgatgatggtgaagcagctgaggaagaagaagatccagctgagcaagaagaggcagctgaggaagacaaagaagcagctgaagaagaagaagaagctgctgaggaagaggaagatgcagcagaagagacagaatcagatgatgattctgaagccaccccatga

SEQ ID NO: 61210 - DNA, 366 bp, Glycine max
  Peptide Sequence Number=SeqID_152895
atggggatcgcacccacaagacacccagtggacccggaaaagtccaatagggccctggggtttccagctctggttacgggcctctatcagtcctacagggtgcacgtacaccccctagcaaggtcatgccatcccgacatagggatcgcgcccgcaagacatccagtggacccgaagaagtccaacagggtcctagggtttccagctctaattacgggcctatgtcatttctacggagtgcctgtcaaccctagcaagttcatcaggcccctattaatcaggctttcatcaagaagtactacgcccccaggcagacgcagggcgagacaccacagtagcattaggatggccggtagcgggcaatag

SEQ ID NO: 61211 - DNA, 258 bp, Glycine max
  Peptide Sequence Number=SeqID_152896
atgctcaatggaatgccccggggctcctccgtgacaagcacacgttgcgtttcgagtcgtattcttggagaaatggaggttgatgaaccttggctagggttatggctaccattgaattatcaagtagatacgggatcaagtttagcatatgacaacggaatttggggtgaaccctacaggctttttgctgcaaaattccttttttttggtggtcttcgtcattggaagtgcggtagacaggctttgtggttgatttag

SEQ ID NO: 61212 - DNA, 207 bp, Glycine max
  Peptide Sequence Number=SeqID_152897
atgccttgccaaagacaacccgataaggagacattcctatgggtgctttgtaggcagtcctatgcgcccaaagggcatcatccagcctggtgtggaaattctgtacacgaccccatactttttgagcaaggcatacatggatctgttacaaaaatgggtgccttgatcactaacgatggctctaaggactccaatcctgcaaaatag

SEQ ID NO: 61213 - DNA, 336 bp, Glycine max
  Peptide Sequence Number=SeqID_152898
atgtctgcacgagatatctccctggaagtcaagatacttgtcttccctgagctggacacgcctctccctgtggaaagaccatcccttgatggcctcgaagcgctgttggtgctcgacacaccgaaaacgctgcatcttctaagatattgtctccacggtggtggtattgttcttcgtcgtcgtgatggggttctctgcggtggtagtgttgttctttgcctctatgatggggatttccgtggtggtggtgctgttcttcgttgccgtgatggggctctcctcagtggtttttgtgttagtgtagcagagtgcagacagcaaagccagatcgaataa

SEQ ID NO: 61214 - DNA, 552 bp, Glycine max
  Peptide Sequence Number=SeqID_152899
atggaagccattacaccaaagtcaatactcatgaatgctagaacatccatcaagaatcataacaaagcattggatgcatcagttatatggggtatgattggaccaaagaggctatttggacctgatgggctatataggaaccttgtgtggttattcctgattggagcagtgctgccagttcccatttgggtgttgagcaaaatcttccatgagaagaaatggataccactgatcaacataccatttataacctacggctttgctggaatgccaccagcaactccaaccaataatgcaagctggctagtgactggaatgatcttcaattactttgtgttccgctacagcaaacgctggtggcagaagtacaattatgtactatcagcagcactggatgcaggcacagcttttatgggtgttttaatattctttgccctgcaaaatgttgaccataatctcaaatggtggggaagtgaattggaccattgcccattggccacttgcccaactgcaccaggaattgaggttgagggttgtccagtattcaaatag

SEQ ID NO: 61215 - DNA, 193 bp, Glycine max
  Peptide Sequence Number=SeqID_152900
atggaggttgatgaaccttggttagggttatggctaccattgaattatcaagtagatatgggagcaaggatggcctttgtggataactgggcggtggttaaggagaagacccacatcaatcctttcactggcaaagaccaaatccgcaaagctttgaaggtgccacttgagctgccaggttctccacctttgg

SEQ ID NO: 61216 - DNA, 387 bp, Glycine max
  Peptide Sequence Number=SeqID_152901
gacgaattgtccaatactaagatggagaattttccaaatgcttcggcatatcatcaatgtctcaagtcccctgctgatcagttgaaaaatgttggagcaccgatgtcgaagagccacctcgtcattcaacttgttttgggtctcacaagtgcatatcaaggtgtagggacgttaattcggcagagtgatcctctaccttcgttttatcaggctcggtcgatgctcacacttgaggaagccgaattggcaaaggaggctgccatgggtttggagttggcaatgaaaaaaaaatccggtggcggtggtcttgggtccaacggtggaaaatccggctgttgtttgatgattttagggacagtctgtcgtcctcctgcttcgactgcgggg

SEQ ID NO: 61217 - DNA, 283 bp, Glycine max
  Peptide Sequence Number=SeqID_152902
atggacatagactatgctataaggaaaaacgaatcacctgcaatcactaatgaaagtagcttagttgttgttgcgctatatgagcagtgggagcgatccaaccaactcaatgtgatgtttattaagactaaaatctcggttgggatacatgattttgtcaaccagcatgaaaaggtccaaaacttgcttaaggctattgatgaccaatccatcacttcagataaggctttagcaagcaccctgatcatgaagttttcctctcttcggctcaccagtgtgaaag

SEQ ID NO: 61218 - DNA, 430 bp, Glycine max
  Peptide Sequence Number=SeqID_152903
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggggagcagatagctgatgtcacaggagatgtcttgacatcctggagaagactagtagctgttagaagatgttgcagtaagcatggagacagggggagcagaagcagaaagctgatgattcacgatgtcggatacaatgtccaggacatcctgctcgaaaatactggaattgctaaaagcattgaagctgcaggatccacgatgtcggatacaatgtccaggacatcctgcccgaaaatactggagttgctaaaagcattgaagttgcaggatccacgat

SEQ ID NO: 61219 - DNA, 336 bp, Glycine max
  Peptide Sequence Number=SeqID_152904
atgatcactatgatagtggacacgttaccagtgttctactgcaaaaagttggtgggatacatgcccagtagcttcgtagatttagtatttgcgggcaaaaggatcgaagtaggcatgaaaagagggaagttcgattatctcgcctctgccggcacgagcaataggagattcggggcaagtagggcaataaagaaggaaggagaagcccacgccgtggcttcagctcctacttggccgaagccccaacaaacccctcacaacacttaccaatatgcccaacatcaaccaagcttttcagcccgcgtcggaaacccctccagtctagtgcccgtttag

SEQ ID NO: 61220 - DNA, 462 bp, Glycine max
  Peptide Sequence Number=SeqID_152905
atgaaactcgccaaatacaggctaaaggcccaagtggagaaggacgaaggcctaagtggagaaggacaaagcccccgagtggagaaggatgaaggcccaaacttatcttccttcattggaagtggcgtctacccagacttatcttcctttaccggaagtggcgtctaccccgacttatcttccttcaccggaagtggcgtctaccctgacttatcttccttcaccggaagtggcgtctacccagacttatcttccttcattggaagtggcgtctacccagacttatcttccttcactggaagtggcgtctaccctgacttatcttccttcaccggaagtggcgtcatccaaatcttcgtagcctgtatcaaacgatccgctcctactcaggctaaaggcccaagtggagaaggacgaaggcctaagtggagaaggacaaagcccccgagtggagaaggatga

SEQ ID NO: 61221 - DNA, 414 bp, Glycine max
  Peptide Sequence Number=SeqID_152906
atgtcaacaaagttttcaaccattagggttctcatcatatatgcctcaatactcatttcaagttcattctacctcaaatattttttatggaccctgtcataccctaatttcgtccggggactattgcttgatggcatacaacctttaattgaccgcttcaaagtacttggcaccctttgctgcacaatatgtgaagtcccgagacgtgccggaaatcaaaaggaagtattgttacgcaatccgcccacttgggccttccagattcttcctccagaaggtggttgcttctggaggaagcaacctgccctcacctgggcgagctgggtggcaaactcctcccctattttgctatacatagggggaggagtgaagaagaaaaaggttcagccttcttggcacttcgtattcacttga

SEQ ID NO: 61222 - DNA, 373 bp, Glycine max
  Peptide Sequence Number=SeqID_152907
tgatcatgctattctgagggacagaacccatcaacccacaaagaagagcttattggagctaacatcacacgatgctttgttggcacagaacaagtcacaggttgtaccatgtgtggtgaagctcatgacacaggccaatgcatccccactgaagaaagcactcaagaaattcatttcatggggaatcagcagaggcaagggtatacccaaggaggattttcaggcttttagcaaggtccttataatcagcaaggacaatggaggacacaccctggcaaccagttcaataaagaccagggtggatcctcaaacaggccaattcaacaagggcctaacatcttttaaaggacgactaagttggaagagaccttga

SEQ ID NO: 61223 - DNA, 153 bp, Glycine max
  Peptide Sequence Number=SeqID_152908
atgtctggaccctgcaccggaggcacgacccggccagttaaggacaggagcgcatcgccggcagaagggacgagccgaccggtgcacaccggaggcggaccgatcgacccaacccaaggtccaactacgagctttttaactgcaacaacttaa

SEQ ID NO: 61224 - DNA, 526 bp, Glycine max
  Peptide Sequence Number=SeqID_152909
atcttcaaaccttgcacaggtttctaaagaagatcttattgttatgtgggcttttcataaaggccgacaaattgattgggcatacttagtccgatatcacatgcatacggcattgcgattaaatgctccattgccatatccacaactagtcaccctcttccttcagcactttaacattcctcttgattctaaaccttatgttccaatcaagagatcatttcttataggcgcttcagtcattgcatcttttggttatcaaaaagagcatgatggctcttgggtgaaaaagggtgctcgacatgttgatgaagaaggacatggtggagaagattcatctcttcttcaaaagattttggataagttcgatggtcttcaaacctttgttggtgaaaggtttgatactttggagttacaagtggacatgtgcttcaatgagatggagtcaagaatcaccaaggtcgaagaagatgtttcttatattcgttcaagctttgatctaccacccccgcagccaccatcatcttag

SEQ ID NO: 61225 - DNA, 348 bp, Glycine max
  Peptide Sequence Number=SeqID_152910
atggcttccatgatggaggccatgttgggaatgaggcagctcatggagaaaaacgtggccatcgctgttgctgtcagttcggctgccgaagcagacccaactctcctagctaccgcacaccatcctcccccaaacgcagtaggacgagagaagagcacacaggggcacaacaacaacccccatttaggatacaatcgggtggcttacccttatggattgccgcctaattacacgccgccagtcatgcacgatgacgcgggccatgtctcttcccccttccttgaaaggaagcctcctcaacagccccacgaggcctatgaagatcatcaagagcatgcccaaggggat

SEQ ID NO: 61226 - DNA, 381 bp, Glycine max
  Peptide Sequence Number=SeqID_152911
atgcatgagaaagaatggcataggagcgtgtttgctctttgcccctatttgggaacctataggacaatatctaagggtatcatcactcaagataataatattgtggcgcgtgcccttcacgggcgagcgagggcgaggctcacgtgtgcgctttccaaaggaggaaaggtgcacggagtcgccaccaacgtttatttgtggaaaacgtcggaaaaaccgaaggaaccggtcaaaatgaaaattctaagttcgggagttgtatttacgcttgaggaaggtattagcacctcttacgtcgacaaaagcggggctcttgctcctacgtaccctcctttggagaggaaatcagacctacgtagttcttctttatacatggatcaa

SEQ ID NO: 61227 - DNA, 237 bp, Glycine max
  Peptide Sequence Number=SeqID_152912
atgaagaatttccacagaattgcttacggaagcgttacggaagcacctcggcttggattttcttcacgaaaacacattttttcacccaaaacagccaaaatgcatagcaaagggtttcttctcgaaacatctcggaactttacggattccacaatgatgggtggtaaacattttgaggtggtcaaacgaaggtcgcatgctgacaaacaatggtccccagacgaaagtagggtatga

SEQ ID NO: 61228 - DNA, 408 bp, Glycine max
  Peptide Sequence Number=SeqID_152913
atggcaaagtcattagttgaacatccatatgtgggtcgactgactaaagatgagaaaattattgttgttgatatgacgaagtccatggtgaagccaagaaatattctcttaacgttgaaggagcataatgccaaacaaatttacaatgccaaacttgcttaccgttcttccataagagggagtaataccgaaatgcaacaactcatgatggtgcttgatcgagatcgtacctacaaaacaaataggtacaaattgcctttgcttgatattgttggtgttacaccaacaggaatgacattctccgctgctttggcttacttggaaggagaacatcttaataatgttgtttgggctctacagcggtttcagagtcttttcatgagagttgatgcacttcccaggattatt

SEQ ID NO: 61229 - DNA, 699 bp, Glycine max
  Peptide Sequence Number=SeqID_152914
atgcacgcactcggcttcagacgactacacgtcctcgtctttagagggctgcttgccctcgccttcaaaggactacacatcctcgccatcagagggctacacgccctcaccttaagaggactacacgtcgtcgccatcagagggtcgcgtaccctcaccttcagaggacttcacatcctccccatcagagggtcgcgtaccctcacctttagaagcctacacgttctcgcctttagaggactacatgtcctcgccttcagaggactacacgtcctcgccttcaaagggccacatagggctacacgtcctcgccatcagagggctacacgccctcaccttgagaggactacatgtcctcaccttcagaagaatacacgtcctcaccttcagaggactatacgtactcgcctcagaggacttcacgtcctcatcttcagaggactacacgtcctcgacttcagagggctacacgtcctcgccttcagaggactacatgtcctcaccttcagaggagtacatgtactcgccttcagagggccacacgtcgtcgccttcagaggactacacgtcctgaccttcagaggactacacaccttgccatcagaggactacacgtcctcaccttcagagggctacatgtcctctccttcagagagctacacggcctcgccttcagaggactacacgtcctcaccttaa

SEQ ID NO: 61230 - DNA, 129 bp, Glycine max
  Peptide Sequence Number=SeqID_152915
atggaatacttacttgttggtgatgaacaaaagcgcgaaacggaatcaaaaaatgcgaaaaatgatgaccctaggactgcaaactcaggtggctcgcccaggcgagctcagctcgcccaggcgagctaa

SEQ ID NO: 61231 - DNA, 1290 bp, Glycine max
  Peptide Sequence Number=SeqID_152916
atgaaagccctctacagtcagctccctgccatcgacagcctgctgcgcgatccggcgctgcagccgctgctggcacaatccggtaccgcctttatcacgcgccagctgcgcggcatgcagcaggaggcgcgcgaccacattcagcaacatcaatcgttaccacactggcacgccagctggccggatgaagcgctgcgccgcgcacagcagcagcagcaaagcgcgctgcgcccggtgtttaacctgaccggcaccgtgctgcacaccaatctggggcgcgcgcagctcagcgatcgcgcaatcgcggcggtcagcgcctgtttgcgccagccggtaacgctggagtatgcgctggacgacgcggcgcgcggccatcgcgatcgcgcagtcagcgcactgctgtgcgagctaaccggcgccgaagctgcctgtatcgtcaataacaacgccgctgcggtactgctgatgctggccagcctggcagcgggccgcgacgtgattatgtcgcgcggcgaactggtggagatcggcggcgcattccgtatccctgacgtgatgcgccaggcgggctgccgattggtggaggtcggcaccaccaatcgcacccatctgaaggattatcgcggcgccatcggcggggatagcggcctgctgatgaaggtacataccagtaattaccagattcagggctttacccatgccgtgcctgaagccgagctggtgcagttaggcgacgcgcacggcctgccggtgatcagcgatctcggcagcggttcgctggtggatatgacggcgtacggattgccgcctgaaccgatgccgcagcagctgattgcggccggcgtgagcctggtgagtttctccggtgacaaactactgggtggcccgcaggccgggattatcgtcggcaaaaaagcgctgattgaccagctgcaacagcatccgctgaagcgcgcactgcgcgtcgataaaatgacgctggcggcgctggaagcgacactgcagctctaccgtcagccggaaaccctgcacgaggcgctgccaacactgcgcctgctgacgcgcagcgcgcacgatattctgcaacaggctgaacgtctgatgccggcgctggagcacgccttcagcgccgatttttcgctggcgatcgccgcctgttcctcgcaaattggcagcggttcgctgccggtcgaacgtctgcccagctttgctatcaccttcacgccacgcgacggtcacggcagccagctcaacgccctggcgcagcgctggcgccagctggcacgcccg

SEQ ID NO: 61232 - DNA, 2634 bp, Glycine max
  Peptide Sequence Number=SeqID_152917
atggtgcgaatgttctgcgccccgaccgagtgctgtgtccagcccagtgcatacaggaacgaggtggaaatccgcttttggcgtgccgcagatgcgctcgaccatttccggcgtataacggctgacgtgctgcttcagcagattccagacgcagcgcggatggttcaggctgtcatcgcgtttggcaaagccgtcgtcgcccagctcgtagttccagctggttttgtcatatttgcgattggcttcgtcgtagccgctgaacaggccatcgtcgaaatggtaatcctcccgcacgatcaggctggcattggtgtacgcctgcacatattcatgctggattttgtcattctgcagcagccacagcagcacacccgacaggaaggcaatgtcggtgccggggcggataggcgtgtaaaagtctgccaccgatgccgtgcgcgtgaagcgcggatcgataacaatcagtttggctttgttgtgaattttggcttccatcgcccagcggaaaccgaccggatgcgcctcagcagcgtttccgcccatcaccacaaccagattggcattacggatgtcgacccagtggttggtcatcgcaccgcgaccaaatgttggagcaagacttgctaccgttggtccgtgtcagacgcgtgcctggttgtcgaccgccagcataccgagcgatcgggccgaagcgcacagcatgccggtggagagccagcggtttaccgtcacgccggcggcgttctgcgcgataaagttggcgtcgcgatcggctttcatcagctgcgcgatgcgcgtaaaggcgtcatcccagctgatgcgctgccatttgtcggagcctggcgcacggtattccggatatttcagacggctgtcgctgtggacaaaatcaagcaggcccgcgcctttcggacagagcgcgccgcggctcaccggatggtccggatccccttcgatgtggaaaatggtctctttggcgtttttcgcgccatcgccgaggctcgcggcttccggcgtaaagccgagcagtgctgccgtggttcctgccataccgccagcgcagatcttgaagaattttcttcggctgacgttcatggccggggttcagaatggctccacgcaggattgcgtcaaaagcgacctgatattaccactactttaatgtggttgttatgcgagacgagagaagtgaaagcgaaacagcaaaaaagtaaccagaatgtgaatgagatcgcaggactgagccagaccaccgtatggcagcgccacgcgattaccgaaacggaaagcgactggctggcgcaggaagtgccggtggcgctggtctacaacggcatttcacacgtggtgatgatggcgacgccggataatctgcaggcttttgcgctcggtttttcgctttccgaaggcattattgagcaacccggcgagatctatggcatggatgtggtgccgggctgcaatgggttcgaagtgcagatcgaactctccagccggcgttttatggcgctaaaggcgcagcgtcgcgccatggcgggccgcaccggttgcggcgtgtgcggggtggagcagctggatcaaatcggcaagccggtgcagccgctgccgtttacgcagaccttcgatctggcctgcctcgataacgggctggcacagctgcgcgatttccagcccatcggcaatctgaccggctgtacgcacgccgccgcgtggatgtcgccgcagggcgaactgcagggcggctgcgaagacgtgggtcgccacgtggcgctggataagctgctgggtcagcgcagccagcagcactggcagcagggcgcggtgctggtttccagccgcgccagctatgagatggtgcaaaaatctgccatgtgcggcgtagagatcctgtttgccgtctcggccgctacccagctggcggttgaggtggccgagcgctgtaacctgacgctggtcggtttttctaaaccgggacgcgccacggtgtacagccatccgcagcgtctgatcaacgcaaggaaatggaaaaagacttcaagccaaaaaccgaatagacaggatatcaaatccattctgctggttcgcaatgaaggtaaaatcggcgatgccatcgtttctacgtgttttctcagagcgctgtttgaagccgggtatcgtgtagatattctggcgcgcgataaatatgacaccgccatcgggagtgaggtcgttaccctcctgagagacaatgcttacgatttattgatcgatacggctatctggcaaaccgcgctgtatatgcccaaaatgattgccgatatcaatcctaaaatgacgctgggtttcaacaagcctggctggcttaaaccctacgatatcaacattcagttcgatcaccttaataaccacgttaaaaatatctatcgtgcggttcttgactatcttcaggttgagacggttgatggactgaattatgaaatattttaccctgagcgaattgatgccgaaattcaccagtccggcatgttttccgctgatgagcacaatattttaatcaatatttatgccagtcatgccgatcgtgacctctctgagcagcagctgaatgagctaatcggggcgattgtcaggcacaatgcggccaccaatatcgtg

SEQ ID NO: 61233 - DNA, 147 bp, Glycine max
  Peptide Sequence Number=SeqID_152918
atggtcaaatactgcgtcaaatccaagacagagatgaatcgaggtgctcggggacgggtacgaatggacgctaggctcgtggtcaacatatcgatgtcccgcgtccggctccggacgatcgagaagtgctactgggaggcagcctag

SEQ ID NO: 61234 - DNA, 166 bp, Glycine max
  Peptide Sequence Number=SeqID_152919
gggcattgcacaggccgaaaggcatcctcctataagcaaaagtgccaaggggcaggcgttcaagcatctggtcaatgaatggcaagggaaaatggtcctttttggtaacctggttcagcctcctatagtcaatgcagactctcctaactgttctgcacccgagtag

SEQ ID NO: 61235 - DNA, 282 bp, Glycine max
  Peptide Sequence Number=SeqID_152920
atgtcgatttggaaatgttcgatcgacgtaaccagtcgcggcttcacgacgaccgatgccggctattgtattttctattcaatcaatgatgaggacatgaccaagagcaagggcaaggatccacttgaaggacttggaggacctatgacaagggctagagcaaggaaagccaagaaagctcttcaacaagtgttgtccatactatttgaatacaagcccaagtttcaaggagaaaagtccaaggttgtgagttgtatcatggcccaaatggaggaggactaa

SEQ ID NO: 61236 - DNA, 445 bp, Glycine max
  Peptide Sequence Number=SeqID_152921
atggaaacgtgtttgggagtagaggaattgttacagcggatgatagatcaaggtcgactggaagttggcagtgaaggaagagaagagcagcacatatgcatgcagtccacggatgggagcagtgttgcgaagcccaaacccttggtgatatacttcactaagggcacagcttcgcaaaagcccggacaccccttagcagctaaacctgttcctttcccgtaccaaaatagccacgcagtcccatggagatatacacctccgagggggaaggaagaagaagccaccgacgttagctcgttgtcggctaaggtaacaaatatcacgggactgagtggtgtgacccgtagcggtcgtgtgtttgcgcctccggacctaccagtccaacccgcgaatgtcaagggaaaaggaaaagtggtagaggaacaagatgaccaagcaccccacg

SEQ ID NO: 61237 - DNA, 666 bp, Glycine max
  misc_feature (355)..(355): n is a, c, g, or t
  Peptide Sequence Number=SeqID_152922
atgagaacatggggttgtattaattataatcccgtcctcgccataagacagcttggctaccccatgagaggagcgccattagacgaaagcatcacgcctttcattacacggggtttcagtgaccccaatgcaaagccttggaacgagaaaccaagaaggcccgaaaggaagaacacgtgccagcaaagttttgaggggctttataaggcagcagtagtaagctcaagctcccgaagaggtgaaaaggaatcatcaagggtcaaaggcatgatcttgaaggacgagctaaaggcttaccttaggtcgaaaagaaatttgtcccaacagttaagcgagactgaagggaatatgtggnccgtcatcgatgagtgcaaagagaagctgaatctagcggcgactcacgagcaaaggctagaggatgagtacgccaagatatcagcagaaagggaagcaagggaaagggtaattgattcgttgcaccaagaggcaacaatgaggatggaccgatttgctcttactttgaacaggagtcaagaacttccccgattgctagccaaggccaaagcaatggcggacacctactccgcccccaagaagatccacagacttctcagctattgtcaacatatgatagacttaatgggccatatgattagaaaccgctag

SEQ ID NO: 61238 - DNA, 267 bp, Glycine max
  misc_feature (258)..(258): n is a, c, g, or t
  Peptide Sequence Number=SeqID_152923
atgggggagaagcttgccacccagctcgcccaagcgagcaaggttgcttcctccagaagcaacagccttctggaggaaggatctggaaggcccaactttcgaagaagttacggaaactcacggattgcgcaaaaacacctcttttcgacttccgccacattacggaatttcacggatcgcgcaagcctgcttccttttgatttccgagacgtctcgggacttcattcattgcgcaacaaaggacgccaagtatctcanagcagctaa

SEQ ID NO: 61239 - DNA, 363 bp, Glycine max
  Peptide Sequence Number=SeqID_152924
gaagaaccacggattggtgctgattgtttgagtgtaacctctaataaatttgagatttataacgaggaagcacggaatgcagcacagaagcataaaccaaagagggtgaagagtgtcaatgctgatgtagaaacctttggtgatcactggaaagttcagattggcgattcaactgtgctgaagataggagattcggctaaagttgtgataaaacaagacatgaagggaggagagcataaatatgggtttaacaacaataaacgtgagaagccagagaaggtaaggttggtggatgatgaaactggtgacaaacatgagctgtatgaagtcctaaggatgccatctagtacaaaaaaccaatga

SEQ ID NO: 61240 - DNA, 171 bp, Glycine max
  Peptide Sequence Number=SeqID_152925
aggaataggtcactggtaatcgattaccaggtcctgaggctgtgtaattcaagtttagcctctggtaatcgattaccaaggctgtgtaatcgattaccagagatgaaaagccttaagttactccttttaattgcatgtagtggttatgaaacgtattgtgcggcggcatag

SEQ ID NO: 61241 - DNA, 183 bp, Glycine max
  Peptide Sequence Number=SeqID_152926
atggagaattggcgaacagcgctacgcaataacttcgcggggctccagactccgctacgcaataacttcgcggggctccagactcgtaggtggaggatgcatgaacagcgccaggcaatgccattcatggggctccgtaaaaaactggagaatggagaattggcgaacagcgctaagcaataa

SEQ ID NO: 61242 - DNA, 528 bp, Glycine max
  Peptide Sequence Number=SeqID_152927
atgaagaaatgggcccttacagccgatcaggacggtgtggacgacaatgatgtgtggaaaaaggcacaggccatccagaaacagaacactgtcccccatgttttatctcgtgggggttatgaatatttggagcaaaagctcctggctgagaagaccaagaagaagttggaggaagctgcccagccaggaagtgttgatggcatcatcgaccctccatcccccgttagacaccacgtgaagtggaagatggcccgcaccaagaaaataggggagatgacgactgaggctgcaaaggaaatcactgagaagatcgattcctttaaggagcaggcgacacaggaatccttcgtcccccgtggacgtcaggatgttctcaccgtttctattgaacgtccagagcaccctagacatgtctgtgctgctggagccggtgtcaccattaatcaatacttcggatcggctccatggacgtcccacaactcttcctctctgcctcttgaagaattgcaacagctgacccagacttga

SEQ ID NO: 61243 - DNA, 159 bp, Glycine max
  Peptide Sequence Number=SeqID_152928
atgggggagattgtagaagcaaagcttcatgatgaatcaagagtgattcaaagatgttttgaagataacaatgacgataacaaaggtgatgacaaaaagctcaaaggtcaatcaaagaatgagttcaagatgttcaagaaggaatcaagaacaatttaa

SEQ ID NO: 61244 - DNA, 321 bp, Glycine max
  Peptide Sequence Number=SeqID_152929
atggacagaagcatgacactaactaatgctcctagatctagcatggcattctcaaatttattgttcccaataatgcaaggtatacagaaagtacctgggtccttacatttctcaggaatctcctttagaaacttggcatatcttggaatctacttgatggcatctaggagaggtatgttcacctctactttcctaaaggtctccaagatctccttttctacttcttccatttttttccttggcattgctctaggtgggaatggaagagggataagaggttgtggtaagtcaaaattactagaagaagctccacctgcatga

SEQ ID NO: 61245 - DNA, 210 bp, Glycine max
  Peptide Sequence Number=SeqID_152930
atgggtgatcaagaggagacacaggaacagatgaaagccgacatgtcggctttgaaagaacaaatggcttctatgatggaggccatgctaggaatgaggcaactcatggagaagaacatggccaccgctgccgctgtcagttcggctgccgatgcagacccgactctcctagccaccgcgcatcatactcccccaaatacggtaggatga

SEQ ID NO: 61246 - DNA, 309 bp, Glycine max
  Peptide Sequence Number=SeqID_152931
atggcaagcagagaccaagtttggtcattctgcacacatgatacgcggagataccttacggttatccgcacccctttgctatttagacacagttgtgtccgatggcaagcagagaccaagtttggtcattctgcacacatgatacgcggggataccttacggttatccgcacccctttgctatttagacacagttcgtgtccgatggcaagcagagaccaagtttggtcattctgcacacatgatacgcggagatacattatggttattcgcacccattcttttgctatctgtaagacagaacgcttga

SEQ ID NO: 61247 - DNA, 252 bp, Glycine max
  Peptide Sequence Number=SeqID_152932
atgaacggaagcactggggttaagcctaaagtagaagtcgaaagagatgctaaggttggggtgcttatcctctttagttttagtgatgtgcaggcccactcgatgaaacgaaaaagcttgacaagctggatattgggtcacggacataggaatacggaattcaaaaaccttaggcatttaggaaaacaacaagccttggtgcgacctgactcggaactggaattggcaaagaaggaagccccaggtgcttga

SEQ ID NO: 61248 - DNA, 204 bp, Glycine max
  Peptide Sequence Number=SeqID_152933
atggaatgccccaaggctcctccacgatatgcacatgttgcattcgagtcatatcctcagaaaaatggaggtttgagggaacctagcaggggttatggctaccattgcattatcaagaattggcagtcacaacatgggtttctccctcatcctcacccttttcatttaccccagttttctcattcgtctaagcaggatgattaa

SEQ ID NO: 61249 - DNA, 138 bp, Glycine max
  Peptide Sequence Number=SeqID_152934
atgtgggaagaagagaagaaggaatggaagggtccgtgggaggaagaagaggaagaaaaagaagaagatacaagggataggggtgcacgcagcaacattgctggtgcacccagcaatattaaaaaatccccattttga

SEQ ID NO: 61250 - DNA, 182 bp, Glycine max
  Peptide Sequence Number=SeqID_152935
atgatgaacaaaaagctcaagtgaatcaaagaacatctcaagagaatcaagaacaagtcaagagttcaagaatcaagaagaattcaagattcaagaagaaagcctacaaacaagaatcaagattcaagattcaagatctcaagaatcaagatcaagattcaagactcaagattcaagaatga

SEQ ID NO: 61251 - DNA, 663 bp, Glycine max
  Peptide Sequence Number=SeqID_152936
atggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtatctgtcgcaagggtttgtggtttgtgctcctctactgaccaccatacagacctttgcccttccatgcagcaacctggagcaattgagcagcctgaagcttatgctgcaaatatttacaatagacctcctcaacctcagcagcaaaatcaaccacagcagaacaattatgacctctccagcaacagatacaaccctggatggaggaatcaccctaatctcagatggtccagccctcagcaacaacaacagcagcctgctccttccttccaaaatgttgttggcccaagcagaccatacattcctccaccaatccaacaacaacaacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaatag

SEQ ID NO: 61252 - DNA, 366 bp, Glycine max
  misc_feature (5)..(5): n is a, c, g, or t
  Peptide Sequence Number=SeqID_152937
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgctggtatagtagaaagcttggatgtcttggttaaggagtttgtagctgccagcgatgaagagaagaaatccatgtttacccgaatggaagaggaagttgagaagctgaagggttctgcctcaaggtaa

SEQ ID NO: 61253 - DNA, 975 bp, Glycine max
  Peptide Sequence Number=SeqID_152938
atggcaattccattcaagacaaaagatgtcaacgaggaagtaacctctaaatacattaagagcctaatggaacaggcaaattataccaataaatatttacaagctttaggagaaaccataaaaactaaggtagttcctaaacaaaaatcaattgaggaagcttcgccaagtatccccattgaaaaacctttattcaaacctttcaaagttagtgagaaggctaaacgaaaaattaaggaacttagaaaaactaaatccttaattgaaggcataggtgataatcatagtgaattactaaacaagattggtagtttacttaaggtcattccagatactccccaaacctcggaaaatacttccaaaatggtaacaagaaatagtgaccaaaactcagataacacaactgagataggatcagtgtcagaaaagaatataaatccaattaattccaaacactggaaaacaccctccaaattatattatcaacgtccaactgcccctgaccttctattagaagaaagaggtgaaaatttttttaagagttttagtgcaaataacatctatgaatggaacatagatgcacaaacggagtataatatcatgaatacactccaacatatgaccatggtagctacggcttaccaaaactcccacgagttttcagaagaaaccattatagatatcttagtggcaggattttctggacaactaaaaggatggtgggataattatctcactaataaggagaaatcaaaaatatacagcgcagttaagacggatctcaatggaaaagtcattactaatgacgatgatcaagagattcctgacgctgttaatacattaatttttacaatagcccaacatttcattggagacccatctttgtggaacgataggtctgcagaattattatcaaatcttaagtgtagaaccttagcggattttaggtggtatagagatactttcctaactagg

SEQ ID NO: 61254 - DNA, 408 bp, Glycine max
  Peptide Sequence Number=SeqID_152939
atgcatggctccaaactcgtgggtggaggatgcatgaacgaaaacgcaattcatggggctccgaaaaaaaggcgaggatggagaattgcactaagcaatcactacgcatggctccaaactcctgggtggaggatgcatgaacgaaaacgcaattcatggggctccgaaaaaaggcgaggatggagaattgcactaagcaatcactacgcatggctccaaactcgtgggtggaagatgcttgaacgaaaacacaattcatggggctccgaaaaaaggcgaggatggagaattgcactaagcaatcactacgcatggctccaaactcgtgggtggaggatgcatgaacgaaaacgcaattcatggggctccgaaaaaaaggcgaggatggagaattgcactaagcaatga

SEQ ID NO: 61255 - DNA, 308 bp, Glycine max
  Peptide Sequence Number=SeqID_152940
ggcgtctggcttcgaggttatgcagctagaattggagttgctacaaacttgactgctgaactctgggcttgggctgtccgtactggtctccggattgccttggctcgaagcttcgaaaagggatatcgaaaaaaaaagatagggcagactaagactaaggttgctttgcttccttcacgtgaaatgaaaaaatggacaagcaaatcgaaaacgaagaacgaggaggcattgccttctcttctgccatctagcctctccctccttcaagctacggataaaaaagtcagggagagcgggctagacagcga

SEQ ID NO: 61256 - DNA, 103 bp, Glycine max
  Peptide Sequence Number=SeqID_152941
ccgaggcgcttccgaaacgttttccgtgaggaatttcgtgaaggttttcgaccgttcttcgacgttcttcattcgttcttcatcgttcttcgatcttcaacgg

SEQ ID NO: 61257 - DNA, 963 bp, Glycine max
  Peptide Sequence Number=SeqID_152942
atgaccacaaggaaaacaaaaatcgttgctatgcaagccgacctctatgacacctttgaccgaagatgtgagaagaacagtacgaggattgtctgctgtactcccgttctttatgtatggttggtttcacacctttttcgccaagaggtgaggcatgcttgcccgctagaaagccaccgttcatgcacagagaaaggaggggcaaattgggaccaactcttagcaagcaaagaaggggcatctgtcaactggttccctcgatggaaggaaggaagaaccggagttcttatttcatgcggaggatttccaaatgttcccttgatggggacgaggaaggtccgcaaggcatgggaggtgttgcaaaagaaagacaaggaactcagaggcagtaacaatgggcccatcggtggctaccgtgagtggttgaaggcccacgtgcaaggtttggattggctcccaagtttgagaaccactaaaagggaggaagatgaggcaccggaggaagacgaagaggtgcaggcccttaggacagaactcaagcaagctcaaacaaccaaagaaaggttcaaatctgcagctcttaaaatccgaaaggagaatgacgaactgagagatgtaaatatggctaccaccaaggctttggaacaagagaccaaaagggcccgtagggaagaacatggccggaacaagttccgaggggctctgtggggcagtaacagcaaacttaaactccaaagagaagaaagggaccaattgcgagtagacggtttgatcttgaaagatgaattgaaggcttgcttgaggtccaagagaagtttgtctcagcggttgtgcgagacagagaccaacatgttagctatcatcaccaagtatcaagaagaactaagcctagccacagcccacgagcatagggtggcagatgagtatgcccaagtgtacgcagagaaagaggctagaggaagg

SEQ ID NO: 61258 - DNA, 195 bp, Glycine max
  Peptide Sequence Number=SeqID_152943
atggcatcatcaggcatgggtgctggggatggctctgggatctggctcctaggctacgaaggtcccaccccctctagaaggagaaggctgggctcctggccagaccacccgtgcatcaaagtcatccatgctcatgatggatggcaagcccaagccctgaaggctctgcatgataatggactgccccctgtgtaa

SEQ ID NO: 61259 - DNA, 168 bp, Glycine max
  Peptide Sequence Number=SeqID_152944
atgggcttaaaggagcactcaaaccgggtgacccccaaggcctacacttcgaagagtccatcagggcctctccctcctgattcaggtccaacccctaaaaatcattttttgcaagcagacactgctcatgaattatacaataatcacgacctcacgctcgtgttttaa

SEQ ID NO: 61260 - DNA, 438 bp, Glycine max
  misc_feature (79)..(79): n is a, c, g, or t
  Peptide Sequence Number=SeqID_152945
atgaaagataagagggatgaggaagaaaaactagaaaaacaaaagaaaaagaaggatagtaaggccttgtcttcaaagnccaaggggaaggaaaaggattcctccaagaagattgttaagaaggaaaatcattttgcaacaaaaggtgatattaaaagagcactcattcttaaacaatctttctaccttctcctatcaagggaaacatccattagcactgccatacctcttaaacttgaggttattcctcaagtaaaggagtttttggatgagggtttggttcacaagagctttaatccttgtgctttgttggtgcctaaaatagaaaaaggtgttgaggaaagaatccatgagtttcaagaacctctggatttgaggtccaatccttttcaagggggagggaatgatacaatcctaccccccaagggcattggatag

SEQ ID NO: 61261 - DNA, 579 bp, Glycine max
  Peptide Sequence Number=SeqID_152946
atggagaagttcaagttggccgctacacacatccggaaggagtgtgccggattacgggaagagaatgcgactaccgcgagagcccttgaacaagagaccaagagggctcgcaaggaagagtatggccgtaacaaatttcgcggagctctgtgggagagggaccagtcgcgagcccatagcatggtcttgaaagaggagttagttgcctgttcaaggtccaaaaggagcttgtctcagcgtttatgcgagacggagaccaacatgctagctatcatcgccaagtaccaagaagagttaggtctagccacggctcacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcggacacctactccgcccccgaagagattcatgggcttctcggctattgtcagcatatgatagacttaatggcccacataattagaaatcgctag

SEQ ID NO: 61262 - DNA, 251 bp, Glycine max
  Peptide Sequence Number=SeqID_152947
gcccacttgggccctccggaatattcctccagaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 61263 - DNA, 510 bp, Glycine max
  Peptide Sequence Number=SeqID_152948
atggctccaaagaaactctccacgaagaggtctagaagagacgccacaggagaaggatccagtgctgccttagagtttgctagtcatcgtttccggagtgccgagcaccagcagcgctgcgaggccatcaggggatggtcattccacaaggagaggcgtgtccagctcagggaagatgagtacacagacttccaggaggagatagctcgtaggcgttggacacctctagtgactcccatggccaagttcgaccctgagatagtcctagagttctacgctaatgcctggcccacaaaagagggagttcgggacatgtgctcatgggtgaggggtatggagcctactaggcaccctctggacccagagaagtcctacaaggccctagggtttccagctctgatcacaggcctttgccagtcctacgaagttcctgtcacccccagcaaggtaatccaaccgtcgatcacccgagccttcatcgagaagtactgcacgcctaggcaggcgtag

SEQ ID NO: 61264 - DNA, 413 bp, Glycine max
  Peptide Sequence Number=SeqID_152949
gactgacagaggcccgtaaccaaagctggaaaccccagggcccttttggacttcttcgggtcactggatcaattgatccatctgcagggggaaacaggcaccctgtaggactacagaggcccataaccagagctggaaaccccaaggccccgttggacttcttcggggggagattggcattgtggtcgttgggcaaaatgttgctaaatagcaacgtcatccacgtaagggtggtcatgttggtgcgcatggtccgcactcgtctttttgcagcggcacgggggaaatcttgccccggtatgcatagtagatgcgtgatagcctccctctgtggatgtgctcgcacagttggtcgccctccaatatcagggggtggcccagggactgataaaaggaaactactggccccttaa

SEQ ID NO: 61265 - DNA, 235 bp, Glycine max
  Peptide Sequence Number=SeqID_152950
atgttggtgcgcatgatccacactcgtcactttgcagcggcacgggtgaaatcttgccccggtatgcaaagtagttgggctttagcttccctctctggttgtgctcacacggttggtcgccttccaatatcagggggtggcaagggtgtgcagccctcagatggcgagagcgtgcagccctctgaagttcaggacgtgtcgccctttgaaggcgagggtgtgcagccctctgaag

SEQ ID NO: 61266 - DNA, 444 bp, Glycine max
  Peptide Sequence Number=SeqID_152951
atggcacctccagactctattccttcagtagagcagtttaatgagatggtagcttggcccgggacccaaccttctcttcatagggaagacgaaggtcccatagcccaggtacctcagcatgtggaggatgagtcatctgaggacaccatcccagagccatttgatataggagaagaggcaaatgagacacaggtgagacaggtagctactgccactcctaagcgatcccttgaggctacttcagagccttttgcgccaatggtaaacctaccctcacctcagcctgcagcagacccctccactcctcttctacaaatgccagaggacccaactacaccaatcctagctatggacacttctcctccaactactccagtgcttcaactgacagatgaggagaatggtcagacacaggacacccaggaccagtcacaggaattttga

SEQ ID NO: 61267 - DNA, 204 bp, Glycine max
  Peptide Sequence Number=SeqID_152952
atggagaattggcgaacagcgctacgcaataacttcgcgggactccagactcgttggtggaggatgcatgaacagcgcttggcaataaattcatggggctccaaaaaaagtggagaatggagagttggcgaacagcgctacgcaataacttcgcgggactccacacgcgttggtggaggatgcatgaacagcgctaggcaataa

SEQ ID NO: 61268 - DNA, 145 bp, Glycine max
  Peptide Sequence Number=SeqID_152953
atgacaagcgaagttggttctatagtgcctgaattgtctccttgtgatcctcattctcctccaaccaatcctcaaaccatggatccttcttcttccacttcatcccatcattctgattcagattggcccattgccatcaggaaag

SEQ ID NO: 61269 - DNA, 273 bp, Glycine max
  Peptide Sequence Number=SeqID_152954
atggtcaacattgatcctgctaccaacaaggccgacgaggcttctgacagtaggaggaaaaagaagttacttaagactgtcggcgagagatggaggcagtttaaatcagacctcacgaggaaatgggcccttgcagccgatcaggacggtgtggacgacactgtctgtgagaaatacgacataagcaaggaaaaatgggcccagttttgccagactcacagagacccttcttgggaggacgtgcggaaaaaggcacaggccatccaaaaatag

SEQ ID NO: 61270 - DNA, 333 bp, Glycine max
  Peptide Sequence Number=SeqID_152955
atgccgcttagccccgtgatattggttactttggccgacagcgagctgatgtcggaggctccttccttcctttcgcttggagacacacacctccacgacactgcgtggctgtttttgtatggaaatggaatagataaaccttttgggagtcgtcacgtccttcaaaggtttggacctgcgcggcctacccgactcgacggcattaaccactccctctccatgattggtaaacgggtttgtctttacgttgggccggtcctcttgaaacgtcagccatccggcttctgtcaaactttggaccttgtgtttgaaggccatgcactattcgattga

SEQ ID NO: 61271 - DNA, 345 bp, Glycine max
  Peptide Sequence Number=SeqID_152956
atgaacgaggaagaggaagaggatgtcctttcaccagagttggaaaggttgattgctcaggaagaacgcgaaatgaagccttaccaagaagaaaccgaactggtgaacttagggaccggagaaggaaagaaagaagtaaaagtaggaagcagtattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaaggcgcgatctacgaacttttaagtgaaaggttcgggagttgtatttacgcacggggaaggtattag

SEQ ID NO: 61272 - DNA, 249 bp, Glycine max
  Peptide Sequence Number=SeqID_152957
ggtcagtatgacagagattgtggggcggccaacaaaagcaaggctcttgctcctacgtatcctccaatgaggaactcagacctacgtgcggataaccgtaaggcgtcactgcgggctactagctcttgggtcatggtaacaaaaagcggtgtggtcgacaaaagcgaggctcttgctcctacgtatcctccaatgaggaactcagacctacgtagttctggagaacttgtgagacttgaaaaagtctcg

SEQ ID NO: 61273 - DNA, 279 bp, Glycine max
  Peptide Sequence Number=SeqID_152958
atgacagtgactgggtttggctccatcttaggaaggatagattccctactaaaaggaaatccaagcttagccctagaggggatgaaccttttcaggttttggagaggatcaataacaatgcctataggttggacctcccagaatagtggagctgatattgaggatgaggaaataacaaatttgaggtcaaatcctcttcaaggggaaggggatgatgcaatccttcctaggaagggaccagtcactagagccatgagcaagaggctccaagaggattga

SEQ ID NO: 61274 - DNA, 579 bp, Glycine max
  Peptide Sequence Number=SeqID_152959
atggtcattctagaggatccccgtcatccagaggcggcgggcccgatgacatgcggagacaaattatggtcattccgcacaccacttttgccattcagacacatttgtgtccgatggcaacgcagagacaaattatggtcatttctgcacccttttgtcatcctagaggcggcgggcccgatgacatgcggagacaaattatggtcattccgcacacctccttttgccattcagacacagttgttcgatggcacgcagagacaaattatggtcattctgcagcccttttatcatccagaggtcggcgggccgatgacatgcggagacaaattatggtcattccgcacaccccttttgccattcagacacagtcgtgtccgatggcacgcagagacaaattatggtcattctgcgcccttttgtcatccagaggtggcgggcccgatgacatgcggagaaaaattatggtcattccgcacaccccttttgccattcagacacagtcgtgtccgatggcacgcagagacaaattatggtcattctgcaccctttgtcatccagaggcggcgggcccgatga

SEQ ID NO: 61275 - DNA, 264 bp, Glycine max
  Peptide Sequence Number=SeqID_152960
atgagcttggttcaaccccgtaatccaaggaatggcaattctgatttccaatacttcaacaatatcatagagatgaaagactcaggaatacgcatgctatgcatggaaaataaatgggtttatgatcccaacatggttggctcatggtacctcacacatgcaactaagaatgtgacgaaaatgcaaggatcatgcatgagcaaacatgaaaacaaaaggtatgcggtttgtagaacaaaaagtatgttaaacgcatatgcatga

SEQ ID NO: 61276 - DNA, 677 bp, Glycine max
  Peptide Sequence Number=SeqID_152961
gccgactggaagtcggtgatgaggggagggaagagcagcatatatgtatgcagtccgcggatgagagaagttttggaaggcctaaaccttcggtgatatatttcaccaaggacgcagcttcacaaaagccccaataccccccggcaactaaaactgttcctttcccataccaaaacagccacgcagtcccgtggaggtatacacctccgagtgaaagggaagaagaaaccacagacgtcaactcattgtcagccaaggtaaccaatatcatggggttgagcggtgtgacctgcagcggtcacgtgtttgcaccttccgacctgccaacacaacctgcaaacattaagggaaaggccaagatggtaaaggaacaaaatgacaagacgacccccactccgaacgaggatattccgataaagggtcttccggagaaaagggatggttgcggcaagaaggaagtgtcgctagaggaagcaagcgactctgagcctcatcgggctttgctagtaaaggtcttgaacgaagctcatgtggctcaagatatctctgtagagggctttggagcttgtatgccaaggatcttcttcatcaatggattcctttgcttcttggaagataaatggcagcggaatggagaaggaggagagggaggagacaccacttcaaggagaagatga

SEQ ID NO: 61277 - DNA, 847 bp, Glycine max
  Peptide Sequence Number=SeqID_152962
atgtaccctggccctaacggcccaaccaagaaagaaatgggccaaatccgcgcatttgacctgaccactggtaaggctaaatggaccaagtgggagaaattcgcagcttggggcggtactttgtacaccaaaggtggcctggtctggtacgcaacactggacggttacctgaaagccctggataacaaagacggtaaagagctgtggaacttcaagatgccatccggtggtatcggatctcctatgacttactccttcaagggtaaacagtatatcggcagcatgtacggtgttggcggctggcctggtgttggtttggtctttgacctgacagacccaagtgctggtttgggtgcggttgggtggccatcaatcgcaagacgggcggtcaccctgttctcagcccctagagtgaagagagcaaatatgtttcctgatgtaaaaagagtccgtgctggctggataagtgcctgcctcacgttggcattcagcctgctgccattccctgccttggctgccaatgcactcaatgtctgtgctggtaaagccgagttgcctttttcaaatgacaagcaagaaggctttgaaaacaagattgcaaacgtgattggcaaagcgttgaatatgccaatcaactacttctggtggaccaatccgctcaccctgcaaaaagacatggaagcaggcaaatgtgacgtgttgattggcactgatcctaatgatccacgcgtcctggcgaccaagccttattaccggtcagcctatgtgtttatcacacgcaaagaccgcgaaattgatgtgacttcctgggatcacccctacctgaaagagaagaatttccgtattg

SEQ ID NO: 61278 - DNA, 615 bp, Glycine max
  Peptide Sequence Number=SeqID_152963
atgacacaacctccaccccgtgagaggactctaagggaaatggttgcacctgatttcacctatgaaagcttgtgcatccaataccctgatgaggatgtcccatatgttctcaaaactggactgatccatttgcttccaaagtttcatggccttgcaggagtgcatgaagtagccacgaattcgtcttcatcagcagagactaagaagcttgaaggtaaactagatgccttggttaacctggtaacccaactggccatgaatcaaaaatctgcacctgttgccagactctatggtttatgctcctctgccgaccaccacacagacctttgcccttctgtgcaacaatctaaagcaattgaacagcctaaagcttatgctgcaaacatctacaatagacctcctcaacctcagcagcaaaatcagctaaaacaaaacaattatgacctctccaacaactggtacaatcccaggtggaggaatcatcccaaccttagatggtcgagtccttcacaacagaagcaacaacaacagccttattttcataatgttgctggcctaagcagaccatatgttcctccaccaatccagcagcaacagcaacaactacaaccctag

SEQ ID NO: 61279 - DNA, 498 bp, Glycine max
  Peptide Sequence Number=SeqID_152964
atggccacaatggtggaggccatgatgagcataaagaagataatgaaagccaatacggttgcaattgccgctaccagcgctgttgctaaggtgaacccgatgcccccatctgatctcaaccaaatgaatcatccaacctcagctagggcaggcaaagatttgggaagtacaggcggcccctattatgcgcaaattaaaaacaagcatgccttcccaccatatggcttgcctcccaactatacaccacccaatgtggcatacactcccaatgaggatacacatgaaattccccaccacaatctagccgacttcgagccttgccttggatatgccactgaagggcaagcagttggtggtatacccttgcaaaacactttagagggccctcaattttgcccccaaccacaacctttgcatttcacagcaggtaaaatccctcctattatggaaggaaagggaaaagttggatcatctggaggaaaggctcagggccattga

SEQ ID NO: 61280 - DNA, 459 bp, Glycine max
  Peptide Sequence Number=SeqID_152965
atgtttgcacattcgattaaaggctgccgtcccttgggacggacgtatggggtgctaataccttccccgtgcgtaaatacaactcccgaaccttttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggggtgcggaatgaccaaattttgtctccgcatgtcatcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctga

SEQ ID NO: 61281 - DNA, 375 bp, Glycine max
  Peptide Sequence Number=SeqID_152966
atgggtgatcaagaggagacacaggaacagatgaaagccgacatgtcggctttgaaagagcaaatgacttccatgatggaggccatgttaggaatgagacaactcatggagaataacgtggccactgctgccgctgttagttcggctgtcgaagcaaacccaactctcccagctaccgcgcaccatcctctcccaaacacggtaggacaagaaaggagcacactggggcacatcagcaacccccatttgggatacaaccgggtggcttacccttatggattaccacctaattacacgccaccaatcatgcgtgatgacgcgggtcatgtcccttcccccatccttgaaggggagcctcctcgacagcccgacgag

SEQ ID NO: 61282 - DNA, 50 bp, Glycine max
  Peptide Sequence Number=SeqID_152967
atggcaaagttggatcatctagaggaaaggctcagggccattgaagtgaa

SEQ ID NO: 61283 - DNA, 202 bp, Glycine max
  Peptide Sequence Number=SeqID_152968
atggttaatctatgtctaatgggcaaagattatgaaagtgacgaagaggtatctttgaagaagaaatgttacataaatagcagatgttcaaagcatatgacgggagattcatcaaaattcacacatatttctcccaagaaaagtgggcatgttacttatggtgataacaacaaaggtagaattcttggagttagaaaaatag

SEQ ID NO: 61284 - DNA, 574 bp, Glycine max
  Peptide Sequence Number=SeqID_152969
aggactacacatcctcgccatcagagggctgcacaccctcacctttagaggactacacgtcctcgcaatcagaggactgcatgtcctcatcgttagggggctccacgccctcacctcaagagggctgctcgccctcgcctttagaggactacatgtcctcgccttcagaggactgcacctcctcactttcagaggactgcacctcctcgccatcagagagctgcatggcctcaccttcagaggactgcacgccctcaccttcagaggactgcacgtcctcaccttcagaggactgcacatcctcaccttcagaggactgcacgtcctcaccttcagaggactgctcgtcctcaccttcaaaggactacacctcctcgccattaaagggctgcacgccctcaccttcagaggacttcacgtcctctccttcagaggaatgcacgtccaaacctttagaggacagcacatcctcaccttcagaggagtgcacatcctcactttcagaggactacacaccctcaccttcagaggactacacgtcctcgccattagaggcttcatgtcctcgccttaa

SEQ ID NO: 61285 - DNA, 557 bp, Glycine max
  Peptide Sequence Number=SeqID_152970
tctgagatacttggaccttagcttaagtgggttcatgggattaatccctcatcaactaggaaacctctcaaacctgcagcaccttaatcttggatacaattatgctcttcagatagataaccttaattggatatcaaggctatcttccttggagtaccttgatttgagtggttcagaccttcataaacaaggtaactggcttcaagtactgagtgcacttccatctctttcagaactacacttggagagctgtcaaattgataacttaggaccaccaaaaggaaaaaccaacttcacacatctccaagtccttgctctttcaaataacaatctcaatcagcaaatcccttcatggctatttaatctcagcaaaactcttgtccaacttgatttacacagtaaccttttacaggacttgttcctcagtgtcaactctggatgggctcctccttttcagcttgaatatgttttactgagctcctttggaataggtcctaagtttccagaatggctaaaaaggcaaagttctgtgaaggttttgacaatgtctaaggcag

SEQ ID NO: 61286 - DNA, 257 bp, Glycine max
  Peptide Sequence Number=SeqID_152971
ataatatccataagttgttgatctcagtgtttctagcatatttagggtgtcttgacttgctgggttttctgttgagccttgacttccttgctcccactccaactcagcttcacactagtttgttggttgaattgttgttgttctatgagtgcatacttgactgccagggaattaatatcaccgctttcatgtcgtgtacttggagatcaatgcgaaatgctaccgaaatttcgtcaaatttaacagaacagaattaa

SEQ ID NO: 61287 - DNA, 252 bp, Glycine max
  Peptide Sequence Number=SeqID_152972
gcccacttgggccctctggaatattcctccagaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgtttttcgtgaggaatctcgcaaaggtttcgatcgttcttcgaccgttcttcattcgttcttcatcgttcttcgatcttcaacgg

SEQ ID NO: 61288 - DNA, 280 bp, Glycine max
  Peptide Sequence Number=SeqID_152973
ggatccacaacagttcacaacatccctttgttgcatggccaagtgaaggttgtgttgaggaggttaaagatgcagaggctctcgttcctgtacccactgacgaggaagctgtgtctccagcaaaacctccagaaagcccgaatgaagaggttatgtgggatgctaccatattcggggtgtttaatcaaaatttctcgttgtatataaagcacgaagatctctctgaaattgcacacggtggtcaatgtctcagcatatctgttatacagttgtggattct

SEQ ID NO: 61289 - DNA, 714 bp, Glycine max
  Peptide Sequence Number=SeqID_152974
atggatttgaaggaagatttttcagatatcattgctggccaattacagtttgacctattagtagacatcattggtgttgttgacgaggttgtctttcatcagatttcacctagaagtaagagagttgtttttaagcttatgaatttgagtaacgaattggtgttgtgcactctatgggacgattattgtgtccaatttatggaatgtttggatcagcatgagaatgaagggcctcttattatgttgttgaccaatgccagaattaaagagggccagggatcctatccatgctcgattagcaattctttgaaggcttctaaactgactattaatgagccactgacaccaattgaagaattcaatcagaagctttcagaattgggcattgagatccggtcagttttgacacgtcattcccagtggagttcacagccttcaggttctgttcagttatcatcaagggagacattcatttccaagtcagaggcaaagagcatttatgagataaacaacctttgtgaatgctataagaaaatagatgtctatccagaaccatttgtgtgcccatgtggcaaacacaatgatcgggctgtgcttagagttgaagtcatggtcaattataaagatgaaaacacaaaatttctcctgtgggatcgtgaatgcactgaattgattgggcagtcagttgatgaagtcaacaccctcaaaatagaa

SEQ ID NO: 61290 - DNA, 372 bp, Glycine max
  Peptide Sequence Number=SeqID_152975
atggttgagtttagtccaacaataggaatctgcggacgatgcttgatcaggattaggctagactatcatgaggaatcgggatctcccataggcaatttagttcctctggacttagaaattgaagctacattgagaaggaacagggccgagaggggaaggaaacttctgcaatacagaacaattgcatccattcttgagaaagaaactcacttttctgattcattatcacttgattcaccatcatcaagggaatccgctactcaattgcctgaagccgctatcatggcagacgagcaacaccagaggatcacccttgaggattattcaagtagctcagtaccgctattctttactagcattgcatgtcctaaa

SEQ ID NO: 61291 - DNA, 700 bp, Glycine max
  Peptide Sequence Number=SeqID_152976
atggctccgaagaggctctccgcgaagagatctagaaaggatgccaccggagaaggctccagtgccgccttggagtttgatagtcactggttccagagtgccgagcaccagcagcgcttcgaggccatcaagggatggttgttccacagggagaggcgtgcccagctcaaggaggacgagtactctgacttccaggatgctctcagccaattcttgggtgacccgctgattatggaggagaaccagcagtgtaaattcagacagaggaagaaccaggtggacaatttcgatgaggaagccatcgcccagctgttgtgcataccggggcaggatttcgctcggaccactgcgggaaggcggttgcggatcatgcgcaccagcatgactaccctgacccagatatggatgacactgctgctcagcaatgtcttgcctagcgaccacaactccgacctccctcttcctaagtgtagaatggcgcctactaggcaccctttggacccggagaagtccaacagagccctggggtttccggctttgatcacaagcctctgccagttctacggagtgcatgtcacccccagcaaggtaattcgaccgccgatcacccgagctttcatcgagaagtacttcacgcctaggcaggcgcaaagtgatgaacatcaggccgcgggtgcacagccaccaactcgacaggccg

SEQ ID NO: 61292 - DNA, 108 bp, Glycine max
  Peptide Sequence Number=SeqID_152977
atggctaccattgcagtatcaagtagatatgggggcaagtcagcatgggacaccggaattggggtggtgttcgtcattggaagtgtggtagacatgctttgtggttga

SEQ ID NO: 61293 - DNA, 531 bp, Glycine max
  Peptide Sequence Number=SeqID_152978
cgggtgctatccgagaacaattggccgatctggatttgagaattcttatggattcttcgttgatagaatggaaagaattaggggaagagggatccccggacaatgaaaacgaatgggaagatcgaaaagagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccgg

SEQ ID NO: 61294 - DNA, 246 bp, Glycine max
  Peptide Sequence Number=SeqID_152979
atgcatgtatgcaaattcagccaaggagatgcgtgtgatgaatggccccgaggaagcttgcctcaaagaggtccaggaaggacaaggcggccgaaggaactagttccgccccggagtacgacagtcaccgctttaggagcattgtgcaccagcagcgcttcgaagccatcaaaggatggtcgtttctccgggagcgacgcgtccagctcagggacgacgagtatactgatttccaggaggaaatag

SEQ ID NO: 61295 - DNA, 1059 bp, Glycine max
  Peptide Sequence Number=SeqID_152980
atgaggtcgaaccaagcgccctcttttgaaaaaaggttctatcatgtcaaagttaagagcctagaactagccggcttgcgagagttagggcagcggatggatcaagttcaatgtcaagccttccgcatggcatatgggaaaatctgggatttggccatgatagaagttactattgaagccatcgcatccctcgctcaatattatgaccagtcgctaaggtgcttcacatttggggactttcagttggtaccaaccatagaaaagtttgaagggatcttaggatgctcgctaggaggaaggaagccgtatttattttctgaattctacccctccatggaaagagtagcaaaagtggtcaagatcttggcacaagagttagaccgagtgaagcaaaacaggaatggggtggtagggataccaaggcagtgcttagaggaaagggccaaagctttggcggatcaaggaaagtggacttcattcgttgatattctagcactattggtgttcaagatcgtactctttccaaatgtggacgggctagtagatttagcagcaatcgacgcttttcttgcttatcactatagcaaggaaagcccagacattgctattttggccgatgcctatgacatattcaacctgagatgcgaaaagagcaatgcgagaattgtctgttgtacacccgctctttatgtatggttggtctcccacgttttttgtcatcagggtagacatgtctgtcccttacaaggttatcacatgtgtgtcgagaaagaaaaatcaaattgggagagactcttggcaagtatggtaggagcgtccgttagttggttcccccgatggaaagagggaggggctggagttttgtgctcatatgaaggattcccaaacatccctttgatgggaacaaggggttatattaattataatcccgtactggccataagacaactaggctaccctatgagaggggcatcgtcagaggagatcatcgtgccttttgtcgcacagggtttcagtgaaggcaatgcaaaaatgcttcagagaatccaaaaagcatga

SEQ ID NO: 61296 - DNA, 345 bp, Glycine max
  Peptide Sequence Number=SeqID_152981
atgaccggaaggcttcttgccggttcattggcttttgagagccgcatccttcattatctcattgttcgtatcttgcttccaagatcttcaaaccttgcacagggtgctcgacctgttgatgaagaaggacatttacatggtggagaagattcctctcttattcaaaagattttggataggttcgatggtcttcaaacctttgttggtgaaaggtttgataccttggagttacaagtggacatgcgcttcaatgagatggagtcaagaatcaccaaggtcaaagaagatgtttcttacatttgtacaagttttgatctaccaccgtcgccgccaccatcatcttaa

SEQ ID NO: 61297 - DNA, 177 bp, Glycine max
  Peptide Sequence Number=SeqID_152982
atggcattcatggggctccgtaaaaaagtggagaatggagaattgcgccaggcaatgacattcatggggctccgtaaaaaagtggagaatggagattggcgaacagtgcgctacgcaataacttcgcggggctccagactcgttggtggaggatgcatgaacagcgccaggcaatga

SEQ ID NO: 61298 - DNA, 234 bp, Glycine max
  Peptide Sequence Number=SeqID_152983
atggaggctagcaatctcttacgtggaaggccttggcagtatgataaggatgttctccataatggtgtcacaaacaaattttcattgggacataaagggaaaaaggttgcccttacacctatgtctccaaaagcgtttgagaagcttgatttcaaagaagggagtggaagcactactagaaatataagtttctatgacacctatcctatgatggttctaagtggaccgccttag

SEQ ID NO: 61299 - DNA, 345 bp, Glycine max
  Peptide Sequence Number=SeqID_152984
atgttttccaagaaggagggaatgatgagaatcatgaaactggccaaatacaggctaaaggcccaagtggagaaggacaaagcccccgagtggagaaggatgaaggcccaaacttatcaaggtaatccttgtggcgtctaccctgacttatcttccttcaccggaagtggcgtctacccagacttatcttccttcaccggaagtggcgtctacccagacttatcttccttcactggaagtggcgtctaccaagacttatcttccttcactggaagtggcgtcatccaaatcttcgtaacctgtatcaagcgatccgctgctactcaggttcacatcaagttatga

SEQ ID NO: 61300 - DNA, 171 bp, Glycine max
  Peptide Sequence Number=SeqID_152985
atgactaaagcacgtcaacagggggtacggaaagggggaagagggtggtggttgccgcccagctcgcccaggcaagctgggatgcttccaccagaaggcaccgccttctgttggaagatcctagaaggcccaagtgggcctgattgctatttgtacccccctgtttactaa

SEQ ID NO: 61301 - DNA, 305 bp, Glycine max
  Peptide Sequence Number=SeqID_152986
ggaaaactgccaggaaaccactttacaagcgaaacctcaaagagagttgggcttcgtcctcaaaaggaaacaacaccagaaaatctagccttccatggattcaaacagaaaatgttagtgtggacaagtggatggatataacggagatgggatatgtgattgcatcacggtataacgtaatccttgtatcgttgtctcaacaacaaagcatgacattttttcctcttagaagtcaacctccacctgattcttctgggcaccgcatgatatgtgtcggtcacgtgtttagaaatcattttgtttag

SEQ ID NO: 61302 - DNA, 468 bp, Glycine max
  Peptide Sequence Number=SeqID_152987
atggttaaggaggagtgtaaggaggtaagtgtctcctccaagaggacacttgttagcactgccacacctcttgggcttaaggttattcctcaagtaaatgagttgtttgatgtgggtttggttcataagagcttaaatccttgttctttgttggtgcccaaaataggtattattaggcaccaaatccctaagataggtggtatgaggaatgtgttgagtggtgcaaccctcttttgtaaaatcacccatgcacccaacatcttcatgattcacatacatagggactctttaggtagtgatcaaggggttcccacagaccctaagagaataaaggtcattcttgagtggcccactccaccaagtgttgaaggaagaagtccaaagtttcaagaacctttggatttaaggtcaaatccttttcaagggggaggggatgatgcaatcctaccccccaagggcattggatag

SEQ ID NO: 61303 - DNA, 144 bp, Glycine max
  Peptide Sequence Number=SeqID_152988
atggagaagaagatgaagaacaatgaattaaaatcaatggcagaagaatggagaaggaagaaagatgattgcagacaccacttcaaggagaagatgagtcgagaacaagctcaccaccataggaagccatggataagagcttga

SEQ ID NO: 61304 - DNA, 851 bp, Glycine max
  Peptide Sequence Number=SeqID_152989
tgaagattgatgctgatagtcttaacacattcctagagacacttgtggtattggcagaggattacagagagattgaggttgccttatgcatactaggccgagggttcatcttgaacaccgagggccatcctggaaagattctcaagaaggatttgaatactctagctcaggtgtggagtgttctctcatactccaacctggcccccacatcacatacctctaacctgaaagtggacagagctaggctgatctttggcctaatctctcgcttggacatgaacataggagctcttatttcttgggttgtctctgaaagccttacttttgagcgcctaagcccggtcattaacttgacctacatcaggaagaactgttggaatctagaggatctaatagtttccatccgaggggctcgcagggcacgggcaaggccagctgagcttccttccacttctgcagcttctactccagcagctccttgtgtcccagctcagacagattctcagtggtggcctccaggatctattccttcagttgagcagttcagggagatggtagcctggcccgggacccaaccttctcttcatagggaagatgaaggtcccacagctcaggcagaggagacacaggtagctgctgccactcctgaccgatcccttgaggctacttcagagccttttgcaccagtggtgagcctaccctcacctcagcctgcagcaaacccctccactcctcttctagagatgccagaggacccgactacaccagtcctggctatggacccttctcctctagctactccagtattccatctgacagatgatgaggatgttcagacacatgacacctag

SEQ ID NO: 61305 - DNA, 306 bp, Glycine max
  Peptide Sequence Number=SeqID_152990
atggctcaacctccacctcatgagaggactctaagggaaatggctgcacctgatttcacttacgaaagcatgtgcattcaataccttgatgaggatgtcctttatgttcttaaaactgaactgatacacttgttgcccaagtttcatgggcttgcaggactcagtaacatggagagaagtatgattgatgctgccaatggtggagcccttggagacatgacccctgctgaagccaggaatttaattgagaagatgacttccaactcccaacaatttagtgccagaaatgatgctattgtcatttga

SEQ ID NO: 61306 - DNA, 141 bp, Glycine max
  Peptide Sequence Number=SeqID_152991
atgaagaacgaacgaagaacgatgaagaacagagaaaagagggaggtggttgctgcccagctcgcccaggcgagcagggttacttccaccaaaaggcaccgccttctgttggaaccctctggaaggcccaagtgggtctga

SEQ ID NO: 61307 - DNA, 414 bp, Glycine max
  Peptide Sequence Number=SeqID_152992
atggatcaactcgaaaaaggttatcgtgcttaccatccaccatcaaagaaattttatatctctatggatgtgacatttaatgagcataaattttttatgtggattctacacttcagggaggaaatgaaagtgaagtgcataatcattatgttagttcggcttgactcttcagatgtaccttctgatcttatctccgataatactaatgtagatgaaattgatcatgaaattgtttctcttgatcctacccttgataatactaattcagatgaaaccgatcatgaaattgatccttgtctgtgtgagaccactagcacaccaaacactgagtctactactatccaatataatcttccaccccactctaatcgtggtcaacctccagctaaaaatgaaccagacctccaagccaaa

SEQ ID NO: 61308 - DNA, 279 bp, Glycine max
  Peptide Sequence Number=SeqID_152993
atgaagataaagaacctgaccctaacgctctgcactacgctcctgcttgccagttttgccggtcatgccaaagaggtcaaaattggcatggcgattgacgacctgcgcctggagcgctggcaaaaagatcgcgatatctttgtaaaaaaagcggaatccctcggagcaaacgtgtttgttcagtcggctaacggcaacgaagaaacgcaaatgtcgcagatcgagaatatgattaaccgcggcgtcgatgtgctggtcattatcccctataacggccag

SEQ ID NO: 61309 - DNA, 339 bp, Glycine max
  Peptide Sequence Number=SeqID_152994
gtgtgcgatatatatccacgcattgaattggctaacggccaaaccaaatacgccaaatacagtgattcaaaaagcattcaaatgcccaagctgcgccgtattacaagtctcaagatagagaatgaagcttcattgtatgaactgtggaaagcacctgtagcagatgacgagagtgatgagcaaaatgacagcgacagcgacgaagtctatttcgttgaagcctttgggaagaaacggcactgtgtggcgccatttgcagaggagattccgattgtggtgcctaggtacgccatcatgcctctagcgacagtggcattggaaagcatggaccaaaggtga

SEQ ID NO: 61310 - DNA, 442 bp, Glycine max
  Peptide Sequence Number=SeqID_152995
atggctccgaaaaagctttccatgaagaggtctagaaagaaggctgcgggggaaggctccagtacagccttggaatttgatagtcaccggtttcggagcgtcgagcaccagcagcgcttcgaggccatcaaaggatggtcgttccatagagagaggcgcgtccagctcagggaggatgagtatacggactttcaggaagagatagctcgtagatgttggacgccgctggtgactcccatggctaagtttgaccctgagatagtcctggagttctatgccaatgcttggcctacagaggagggagtgcgagatatgcgttcatgggtgaggggtatgccacccaccaggcaccctctagacccggataagtctaacagggccctggggtttccggcgttgatcacgggactctgccagtcattcggggttcccgtcaccccca

SEQ ID NO: 61311 - DNA, 240 bp, Glycine max
  Peptide Sequence Number=SeqID_152996
atgtcatcttcagtggaaattgaggacaaagcatactgggcagtgaagacttgcaacttctctatggatcaagctggtgaggaaagaaagttgcaactgattgagatcaaaagcgactccacaaacaagagcttcaaggtcaacggacatcgacttaagtcattcctcacaaacccttctttagtggacatagtggtggaagagacttccttactccaccctactcttcctccaccataa

SEQ ID NO: 61312 - DNA, 363 bp, Glycine max
  Peptide Sequence Number=SeqID_152997
aatgtggtgttgagtggaaaaagagtgaggctttgagagttgaaaggctaaatctggattctgtggtaaatggagagtttttctgcctttgccctgttttgcttggctgtgatagcttgtgctgtttaaatgttgttttgcttggatgttgtggaagcttgggaggattgatggggacccggggatggtgggtttatgcgcgcattgtggatgtggaaaacttgttgtgcaccatcgcccgaccgccacctaagtggtacctggagatatgtcgcgggggtcaggagaccttggggacgtcaggtggggtgctattgcccaaaagcaagcttgaccaatcccgacccaacccgagcatagtcg

SEQ ID NO: 61313 - DNA, 513 bp, Glycine max
  Peptide Sequence Number=SeqID_152998
atgtcccaggctaggtatgatagatcaagatttgtatcccatgatgcttgggaccgccgctacatagacaatgtccttggccgaaagatccttctagaaaggaatgtgaagctgtacattacagaatttgatgaatttagaacagaagttgagacgaggaactggcataaggagcttactaacttctcagagggaagcattgatgttgctattgttaaagaattttatgataacctctatgaccctgaagacaaatcacctaagcaggtgaaggtgcgagggcacctaattaaatttgatgctgatgccctcaacaccttcttgaagacaccagtggtcatagaggaaggggagagattgcctgcctactccagggctcgtcatgaagatggatatgaacttggggtccctcatcttaggtcagatctctcttacagcacagcacaactcctcgaggctaggttttccagccttgattacagccttgtgaaaggctcgaggagtcacatttga

SEQ ID NO: 61314 - DNA, 162 bp, Glycine max
  Peptide Sequence Number=SeqID_152999
caggctagggcacggctttccaaacttttcagatttcagatgacagtgcttttttcaaatggcagtgctttagacggtgtcaatggatatagcaagtgggtgttggcgagatcatgcaatatggatatagccattggtgctggcgagatcatgcaactttaa

SEQ ID NO: 61315 - DNA, 237 bp, Glycine max
  Peptide Sequence Number=SeqID_153000
atgtcaggatttacacgcaattctcctcaaatttcagccagcccgtatcaattagacttcacactttatgcttcggggtcatacaatgctcaatggaatgccgtagggctcctccacgataagcacacgttgcgttcgagtcgtatcctcagaaaagtggaggttgatgaaccttggctaggggttatggctaccattgaattattgagtggatatgggatcaagtttagcatatga

SEQ ID NO: 61316 - DNA, 357 bp, Glycine max
  Peptide Sequence Number=SeqID_153001
atggcatccaagaagaggaaaagcactgcttccagacctcaagctcagtatgataccaagcgattccattctttggacgcttggaatagacacaacgataacattctcggtcggaatatccttccggagagaaatatgcagatttatcatactgagtttcacgagtttaaagtggaattggagaggcataatctacacaaacgcctcaccaatctccaagatggaagcatagatgtagctatggtgaaggagttttattctaatttatacaccacagaggagcaagcacccaagcaagccattgtacgaggacacctgatcaaaatagatgcagatagcctgaatgagttcctttag

SEQ ID NO: 61317 - DNA, 411 bp, Glycine max
  Peptide Sequence Number=SeqID_153002
atgaatcttgagttggagtcagcggcattcagggtcacaggaagccccaattcctccttccattcactctggatcattattctcatcagaggaacagtgtatacgatggtcattgaccaatccctattttatgatttaacaaaattgcctagtgaaggtgtaccttttgagggtgcactgattgatgaatggaaatttgatttctctgtgcatgatgcccgccggttggtttgcaccaaccaagcggatatgaccggaaggcttcttgccggttcattggcttttgagagccgcatcctccattaccttattgttcgcatcttactccctagatcttcaaaccttgctcaggtttacaaattgattgggcacaccttgttagatatcgcatgcataaggcattgcgattga

SEQ ID NO: 61318 - DNA, 396 bp, Glycine max
  Peptide Sequence Number=SeqID_153003
atgtaccctcccttgttctctttgaacctagtggatgtaccctccacaagagatgcaccctctcttgttctcagtcaaacccaagtagatgtaccctctacttgtaccacaaaggatgtaccctccaatgtgttgagacaaagatctcaggctgttaaacctttgatactttgtgaatggggatacaaaagaattctcaggcgggagaagggagacacaaaagaattcaggcggttagtcattcgttcttttggaaaagggagaagagagacacaaaaagaattcaggcggttagtccttggcgaattctttttggcaaagggggaagagaatgacaagatgaataacacaagttttcaaggtttggaaaaccagaaaacttcagaaagcttttga

SEQ ID NO: 61319 - DNA, 376 bp, Glycine max
  Peptide Sequence Number=SeqID_153004
ggacagtaagtcgagaggtgggcagagacaaattatggtcattccccacaccttttctccatccagaggcgaccgtgtccggtggcacgtagagacaaattatggtcattcggcgccttgtgtcacccgaggggaacgaattcgacagtatcaggatgatgtgtcggtactgtcataccctaatttcgtccggggaccatctgttgttgggatgcgaccctcttttgaccacttcgagcaaccaggcccacttgggccttccaggatgttcctccaaaaggcggttgcttctggaggaagcaacctagctcaccagattttcaaccgttcttcgtcgttcgttgttccttcttcgtcgttcttcggtcttcaaccg

SEQ ID NO: 61320 - DNA, 141 bp, Glycine max
  Peptide Sequence Number=SeqID_153005
atgaagggaaaccaacaaaggggtccccagtggagtcgccaactgtcgcaacctacccttcggcgggagggcgacgcgagactcgcggatgcgtgttccacgaaaggaatacgcgcggagtcgccaccaacgtttatttga

SEQ ID NO: 61321 - DNA, 276 bp, Glycine max
  Peptide Sequence Number=SeqID_153006
atgacagaaatcaacgaaggatcatcaaccaaaactgtagaagcaaagcttcatgatgaattaagattgattcaaagatgttttgatgataacaaaggtgaagacaaaaatctcaaaggtcaatcaaagaatgagttcaagatagaatcaagaacacttcaagattcaagaggaaagttaattccaagaatcaagaatcaagattcaaggatcaagcttccaagaatcaagatcaagattcaagactcaagattcaagaatcaagagaatacttaa

SEQ ID NO: 61322 - DNA, 500 bp, Glycine max
  Peptide Sequence Number=SeqID_153007
ggctgcacgccctcgccttcagagggctgcacgtcctcgctgttagaggactatacgtcctcaccttcagaggactgcatgtcctcgccctcagagggctacacgtcctcacctttagagggctacacgccctcgccatcagaggactgcacgtcctccccttcgtagggctacacgccctcaccatcagaggactacatgtccttgcctccagaggactacgcgtcctcgccttcagaggactacacatcctctccttcagaggactacacgtcctcgccttcagaggactgcacgccctcgcctttgtagggctacacgccctccccatcagaaggctacacgtccttgccttcagaggactatacgtcctcaccttgagagcgctgcatgccctcgccttcaaagggctgcccgtctttgccgtcagaggactgcacgtcctcgccttcagaggactgcacgtcctcactttaagagggctacatactctgatgtga

SEQ ID NO: 61323 - DNA, 318 bp, Glycine max
  Peptide Sequence Number=SeqID_153008
atgaccataatttgtctccgcatgttatcgggctcaccgcctctggatgaaaaaaggcgcagaatgaccataatttgtctctacgtgccatcgaacacgattgtgtctgaatggcgaaaagtgagcggaatgaccataatttgtcttcgcatatcatcgggcccgccgcctctggatgataaaaggcgcataatgaccataatttgtctctacgtgccatcggacacgattgtgtctgaatggcgaaaaggtcagtatgacagagattgtggggcggccgacaaaagcgaggctcttgctcctatgtatcctcaatga

SEQ ID NO: 61324 - DNA, 2093 bp, Glycine max
  Peptide Sequence Number=SeqID_153009
tcgtgacccgcgacgatatcgatcgctggcaggctaaaagcctgacggacgtcatgcgtcgcctgcctggcgtggacatcgcgcaaaacggtggcctcggccagctgagttcgctgtttgtgcgcggtactaactccagccacgtacttatactcattgacggtatccggctaaaccaggcgggtgtgtccggatcgtctgatttaagccagattccgctttctctggtccagcgcatcgaatatgtgcgcggtgcacgctcggcggtgtatggctccgatgcaattggcggcgtggtgaacatcatcaccggtcgtgataagccgggcacgacgctgagcgcgggcgtgggctcgaaaggctatcaaaactatgaaggttctacccagcagcagctgggttctgccacgaaactcactatggcgggcaactacacttatacgcgtggctatgatgtggtggcaaacctgccggatgtgtatggcgatccggcgcagaaagatcgcgatggcttcatgaataagacgctgtatggcgcgctggagcaccagttcagtgacgggctgagcggctttgtccgcggctacggttttgacaaccgcacggcctacgacggcacctacagctacgataacagttttaacatcaacggattaaacgatacccgccagctctacagccagacctgggacagcggcctgcgttacagcaacgacatttattcgacgcagctgatcgccagctacagccgcagcaaagattataactatgatccgcgtacaggccgctacggcccgtcgaccacgctggatgacagcaagcagtacaatgtgcagtggggcaatacgttgcaggtggcgcagggcagcgtaagcgcgggcgtggactggcagaaacagaccacagaacccggcaccgcttacgtggctgacagtactgagctgcgtaacaccggcatttatgccaccacccagcagcagctgggcagcgtaacgctggaaggcgcggtacgcggtgacgacaacagccagtttggctggcacggcacctggcagggcggggcgtcgtgggcgtttgttgatggctatagcgtgtttgccaattacgcgacggcgtataaagcgcctcgtctcggccagttgtatgtgggaagcgggcttctctggcctgaccgggccggtaactggcgcgtatccggttatcgtaacgatatcgataatctgattgatagcgatcccaccacctatatctattacaacatcgataaagcgcgcattaagggcgtagaagccacggcgtcgttcgataccggtccgcttagccatcagatttcttacgactatgttgatgcgcgcgatgctgaaaccgatcaaccgctggtgcgccgtgcgaagcagcaggtgaaataccagctcgactggacgatttatgagtttgactggtcactgacctatcattatctcggcgatcgctatgatacggattacaaccacgcctttaccccgcagcgcgtcaaactgggcggtgtaagtttatgggatctggcagtttcgtatccggtcacatcacagctcaccgttcgtgcgccagctacagcttctgatctgcgccccaccgtgctggtgtttgactccggcgtcggtgggctctccgtctatgatgaggtccggcaactgctgccgggcctgcactatctctatgccttcgataatgccggcttcccttacggtgaaaaaagcgaagagtacattgttgagcgggtcgtggcggtggtggaggctatcgtgcagcgcgtgccgctggcgttagtggtcatcgcctgtaactccgccagtactgtatccctgccagcgttgcgtcagcgctttgaattcccggtcgttggcgtcgtgcctgcgattaaaccggcggcccgtctgacgcgtaacggcgtggtcggcctgctggccacgcgcggcacggtgaaacgaccttacacccatgagctggtggcgcagtttgcgcgcgaatgtaaaatcgaaatgctgggctcggcggaactggtcgaactggcggaagccaaactgcacggagaaacggtgtcgctggacgat

SEQ ID NO: 61325 - DNA, 213 bp, Glycine max
  Peptide Sequence Number=SeqID_153010
atgccaagtatctcaaagcggccgatcaaaggttggatatcatcaagtaataatccccggacgaaattagggatcatggcttctccacctgcctcccctcctcctcctcctcctcctcctcctcctcctcttcctcctcctcctgctccttccaacgcatcggcttcgccgtctgccgtgaagcagacacgcaaagccttaggaaggaattaa

SEQ ID NO: 61326 - DNA, 618 bp, Glycine max
  Peptide Sequence Number=SeqID_153011
atggcattcttgggagagacaagcagtcagacagttgtgaactccacattaggttttattttccaaatggatccattgttcacaacgacagtggtgtttcctttcaagcttccactccagttcccattcgagtacctatcggatgtgattttcaaacgtaatcaatttcggtttcaatgtatgcaactgaaagatgatgctgatgttaacacaatgttaatctgtaatcatgaattttcgtttgttggtctgattgagttattatgtagcattgctagaaccccaaatggtattttaaacttacttgaagctactatgacccctactcatgatgccctgctatattacaatgggaggtggaacatgtcatgccaaaatgagtttgttggttacttgttcacaggaaaaaatcccagaaactttgatattcccaccggatgtaccatggatgaactgaaggatttgatcaagcaagttgcgcctcgtgggattcccctttatggtattgatgaaacacaaattgtaaggcgattgttttttcggaaaccaactcaccatgagtattcagaaaaagttataaaattcgaaatatttgaactgaaaaccacgatgacgtga

SEQ ID NO: 61327 - DNA, 273 bp, Glycine max
  Peptide Sequence Number=SeqID_153012
atgtgccctaacccacatcgcagttatcgtcgttttattcatcgtccttcttcgtcagcagctaaggcatcacatccatctattaatatcgaaagagcaaaagaaatcaagagaaaaattggggaagcgaaaaagagagaaaatgaaagaaggaatagttcatggtggccaggtcaaatacttggccttgatcacctttctacttctcatcttacttctcctcattcaggaactcccgttaagtttaatagaaaggaagtttccaacaagtaa

SEQ ID NO: 61328 - DNA, 534 bp, Glycine max
  Peptide Sequence Number=SeqID_153013
atgttcttcatgattagaacacaaggtttaggtcatgcgttaggagctggtagaggtagaggcattagtgaggatgcgcatgaggctgatgttcctctgcgtcgtagacctactgcttcaacacataggcaacgggttcgtctgtgtgaggacgtcacagagagacctgaggatgtgcctcagctgcatgaggatgttcctcatacagagggagtggctactgatgggagcttggggtcacctgctgcagatgagggtttccccggtggaccacgtgacccatcgattttgaccgattttgctgagcatgtcgcacacagcatctggagtaaacaggaacgacccgatctgaagttggtctcccacggtagaaaagtatataaaattgggagaccaacgcctgagatcaaagggttgattgttggcaccggattgagtccactgatcaggtattctgttatcaccactgatcctagactcatatccgccttcgtcaagaggtggcatcgcgagactagcacgttccacctgcca

SEQ ID NO: 61329 - DNA, 264 bp, Glycine max
  Peptide Sequence Number=SeqID_153014
atggaggagttgattaacaaaacacaaccctccctaaataatcccaacatcatcacgttggctcgacggatccacaaaagaatcccacttctcatactctactgttgtcattctgctcccacgaacaaaggttcacgatcatcacaggcaactcctcccccccacggtgatcatcctaagtctcaagggagttccaaaccaagtgacatgcccccaagtacaagtattcctcctcatgagaaactacaagtacttactgaaaag

SEQ ID NO: 61330 - DNA, 318 bp, Glycine max
  Peptide Sequence Number=SeqID_153015
atggcagcggagagagccagctgcagtcacccttccgaggtattggggtttcgctatctgccatgccgaacactctgcgacctcccttatgccaccaccaacctctgctcttccatttgcattgtcaatggagaacagcagtcatcccgctattccactttagggttggccactccgctccactattccaggattgacaactatgcttactacaattttgctgctcagactgggtcatgtatgggaaggaatgaaccaagaaatgagagtgaagatcatggaagtacattaaacggggtcattcatgagaaggaatga

SEQ ID NO: 61331 - DNA, 288 bp, Glycine max
  Peptide Sequence Number=SeqID_153016
atgtaccctaaggttcatgagaaccctaaggtcttctcttgcatctctggtccattcttcttggagctttctatccaatgtccttgcggggtaggattgcatcattccttcccccttgaaaaggatttgacctcaaatcctgaggttcttgaaattctgggttttttttcctcaacacctgtaaaaagaataaaaacatatgtattagtgatgtttggaacatggttcctcaccaactcaatgagtggtgctacaagtatagaaaaatatgggacaaatattttgtaa

SEQ ID NO: 61332 - DNA, 508 bp, Glycine max
  Peptide Sequence Number=SeqID_153017
atggcattagaagaagggaagttgtatcaacccttaccaggggttaagccagacgacataaaacaagaagaatggaacttactagatcgacaagctcttggcgtgattagattgacattagccaagaacgtcgcgaacatcgtaaacaagaagactactgcaagcttaatgaaggcgttatcagatatgtacgagaagccgtcgatagccaacaaagtatactttatgcttcagttgttcaacctcaagatgggagaagttagtagttctataagggataacaaattaaaccttaatgacatccgtgacttgatcttaagcaaagatgttcacaagaaagattcaagagaatcttctagtcatgtttccaattcagcattgaatactgaagacataggaagaaggactacccataagtgtcagaatggtcaaggcagatcaaagtcaagagggaaaggtcagacaaaatttcgaagtgacattatctgctggaattgtgacaagagag

SEQ ID NO: 61333 - DNA, 153 bp, Glycine max
  Peptide Sequence Number=SeqID_153018
atgactgaagcacgtcaaaagggggtacggaaagggaggagcttgccacccagctcgtccaggcgagctcagctcgcccaggggagcaatgttgcttcctctagaagcaacagccttctggaggaagaatctggaaggcccaagtgggcctga

SEQ ID NO: 61334 - DNA, 237 bp, Glycine max
  Peptide Sequence Number=SeqID_153019
atgtcagtctctgcatgctatcaagcgttctatcttacagatagcaaaaataatgtttatacggataaccactcgggtatttccgcccgtcagcgtgactcaaatgtcagtatgacagatcctgtgagcgcggaagatgacgtaaatctccgcgtgtcaacgggcttgtcggccgcgattgacgaagggcgcagaagcgatgttagtctctgcctgctatcaggcttttcgtcttag

SEQ ID NO: 61335 - DNA, 273 bp, Glycine max
  Peptide Sequence Number=SeqID_153020
atgaatgtcgaagaacagttgaaaatcttcgcgggaggagcttgccacccagatcgcccaggcgagcaaggttgcttcctccaaaagcagcagccttctacaggaagaatctggaaggcccaagtgggcctgattgctatttgtacctccctttttactaaatgcaccccctttacctttttagctttcgaagaagttacgaaaactcacggattgcgaaaaacacctcctttcgatttccgtcacattacggaactttcacggatcgcgtaa

SEQ ID NO: 61336 - DNA, 189 bp, Glycine max
  Peptide Sequence Number=SeqID_153021
atggaagacgcacccgtgagccctcgcgtcgccctcccaccgaagggctcatacttagttcatgggcccaaaatccaccctaagactcatgagaaccctatggccttctcctacatctctggctcaatcttctggagtcttctatccaatacccttgggggtaggattgcatcatcccctcccccttga

SEQ ID NO: 61337 - DNA, 255 bp, Glycine max
  Peptide Sequence Number=SeqID_153022
atggccatcatgttaggagttgtggatttaaggctgtggtgcccaaaactaggtagttttggtgtagtggttcttgagattgtaagtggacttcaggctgtggattttaggcaacttgaggtgctagtggtaaagaaagttcatgaatttgaggtgaaaaaaggagagaacatggagagcaaggaagattggagagaaagaaatacttgttctttgtcactggttaagacaattcaaggtctaggaatacaatga

SEQ ID NO: 61338 - DNA, 117 bp, Glycine max
  Peptide Sequence Number=SeqID_153023
atgactgaagcacgtcaaaagggggtacgaaaacaaaataggggaggagcttgccacccagctcgcccaggcgagctcagctcacccaggcgagctcagcttggccaggcgagcaag

SEQ ID NO: 61339 - DNA, 670 bp, Glycine max
  Peptide Sequence Number=SeqID_153024
gtcgactctagaggatcccctgaacgccgtcaaagaggatgggccatcgcgggcaaagaggttaggagaggtggctacttctagacgcttcatctatcaatcactgcaagcggtgtgcatggtctcccgtggtggagacgaaagggatgaatgtttgtttcacctcgaggagtcgcatgacatggaaacctgccccgcggtggaagaattgcttcatcggctcatggattgcgggcagcttgaagtgtccataggagggagggaagaaccacaaatttgcatgcagtcggaagagaagaaggttcctctaacccccaaggccctagtgatatgttttactaggaaagggaccggctccacacctatatacccccggacggcgcccaagccaacaccatttgcatatcaaagtaataaggtcgttccgtggaagtatacccctcccgcgtccagcgaaagagttgcaaccgaagttgactccctgtcagctaaggtaaccaacatcactggcctcagtggcgtaacccgcagtgacgtagccaccccctcgaaagaagtagatcctccagcggtaagaggggctgaaaagaaagaaggtcttcaaggaaaaatagtgacattggaagaggctcatgagttcctccgcctcatccaacaaagcgagtttaag

SEQ ID NO: 61340 - DNA, 249 bp, Glycine max
  Peptide Sequence Number=SeqID_153025
atgaatgaaaacgcaattcatggtgctccgaaaaacggttgcgaatggagaattgcactaagcaatcactacgcatggctccaaactcgtgggtggaggatgcatgaacgaaaattcaattcatggtgctccgaaaaagggttgagaatggagaattgcactaagcaatcactatgcatggctccaaactcgtgggtggagaatgacatgaacgaaaacgcaattcatggggctccgaaaaaaggttga

SEQ ID NO: 61341 - DNA, 201 bp, Glycine max
  Peptide Sequence Number=SeqID_153026
atgactcaaaagctggtaacccgcggagacaccttacggttatccgcgcctcgtcattcagtgaccccaagtgtgattgatgagcagaggccaatatggtcatctgcgccctttacggagatgtctgagttcctcattggaggatacgtaggagcaagagccttgcttttgtcggccgccccacaagatctgtcatactga

SEQ ID NO: 61342 - DNA, 334 bp, Glycine max
  Peptide Sequence Number=SeqID_153027
atgtctttattgtccggcgattttcatctccggcagcagcaccgatccgcattgtatattgctgcgcgtttcaatgtcgttaccgaccgttaccatattgagccacatatctttgaggttgcccgcaattgtgatctcgctcacagggtattgaatttcaccgttttcaacccagaagcccgccgcaccgcgcgagtagtcgccggtcatggcgctgacgctggaacccatcatctcggtaacgatcaaaccgcgtcccatctgcttcaccagatcgtcaaagctgtggccctgaccggcgatgcgccagttatgaatgccgcccgcgtggccg

SEQ ID NO: 61343 - DNA, 847 bp, Glycine max
  Peptide Sequence Number=SeqID_153028
gagggctacacgccctcgcctttatagggctacatgtcgtccattcagaggactacacgccctcgcctttggagggctacacgccctcgccttcagagcactacacgccctcgccttcatagggctacacgtcctcgcctacagaggacgggacgccctcgtcttcagagggctacacgtcctcgccttcatgggactacacgccctcgcctttagagggctacacgccctcgccttcagaggactacacaccctcgccttgagagggcttcatgtcttcgccatcataggagggtacgtccttgccttcaaaggactacacatcctcatcttcagagggctacacgttgtcaccttcagagggctacatgccctcgccttcagaggactacatgacctcgccttcagaggacgactcgtccttgcctttagaggactgcacgccctcgcctttagaggactacacgtccttgccttcagaggactacacgtcctcatcttcagagggctacacgtcctcaccttcagatggctacaccccctcgcctttacagggttacatgacttccttgtcttcagagggctacacacccttgctttcagaggactacacgctctcgccttcaggggactacacgccctcgccttcgaaggactacacgccctcgccttcagagggctacacaccctcaccttcagaggactacacgccctcgccttcagaggactacatgccctcgccttcaaatggcatcacgtccttaacttcatagggttgcacgccctcgcctttagagggctacgcgtcctcactttcagtgggctctacatccgcaccttaagataa

SEQ ID NO: 61344 - DNA, 524 bp, Glycine max
  Peptide Sequence Number=SeqID_153029
tcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccaggtcttcactcaaaatggttttctggcatggataaagaacgtcgaggtgctcaagagaattcattacacgaccaaaatggtttgatgtggaaccctccaagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61345 - DNA, 438 bp, Glycine max
  Peptide Sequence Number=SeqID_153030
atgctagatgtgtgggacttgccagatggagaattcatacttgttgaagtagatcattggggcaatcctatgggttgggaaggaaaaactttgaatgtaattaggagcttggtaaggagacaccaatgtgctcctatcaattttcttagctggaaagacatgcctaaggactatattactgacatggttgaattaattcaggtctgcaaaactaaggaggaaatggttgctcacatcccagatccaagggttgatccttatcattatcgtgatttagtacattattggtgttctgagaaaggacagaaaataagaaacatcaacaaaaggagtcactcaaaatatgaggacttgcattgcatgggaaccaataatcttccaagacggattcatgagatgactacaaaggctaagggagtgcaaccttctaggacataa

SEQ ID NO: 61346 - DNA, 426 bp, Glycine max
  Peptide Sequence Number=SeqID_153031
atgtcagatttatccattttatttagcattgtatatgtggtttataaacttgaaaatcctgatgagtcattagagacatctaacaacaactttcaaaattgccccatgtgtggtgtcgcttgtcaatgtcgggactcatacgcgattctcctcaaatttcagccagcccgcatcaattggactttgcaccttatgcttcagggtcatacagtgctcaatggaatgccccagggctcctccatgatatgcacatgttgcgttcaagtcgtatcctcggaaaatggaggtggaggaaacctagcagagacaggctttgtggttgatttagggatggcctttatggataattgggtggtggggaaggagaaggaatggcagtcacagcatgggtttctccctcattctcaccctcttcatttgccctag

SEQ ID NO: 61347 - DNA, 348 bp, Glycine max
  Peptide Sequence Number=SeqID_153032
atggccattattgtcagtgcggaagcttgtggttacgtgagcatgaactactaccaatatatagatgttgtttacaccaatgaacacatcttaaaagcatactccgcacagtggtggcctcttgggaatgaagcggcaattcctccttctgatgaggcatggacactaatccctgacccaactacaattcgtgcgaaaggtcgaccaaaatcaacaaggataaggaatgagatggattgggtcgaaccatctgaccaccgacaaaaatgtagtagatgtggagctgaagggcacaataggcgtcgatgtccaatgcaatctgaccgtgggagtaattcatttaattga

SEQ ID NO: 61348 - DNA, 348 bp, Glycine max
  Peptide Sequence Number=SeqID_153033
atggcaatcaattcatggggctccggacttgatggtggaggacgcatgaatgacaatcaattcatgggactccggataagattcgttggtggaggatgcacgaacagtgctaggcaatcaattcgtggggctccggacacgttggcaatcagttcgtggggctccggactcgatggtggaggatgcatgaatgacgatcaattcacggggctctggataagatttgttggtggaggatgcacgaacagcgctaggcaattgtcataccctaatttcgtccggggacctttgcttggtggcatgcaacttgtgtttggtcattttgaggtgcttggcacccatcattag

SEQ ID NO: 61349 - DNA, 435 bp, Glycine max
  Peptide Sequence Number=SeqID_153034
atggaggcaaacgtaacaaaggtgttgagaagcacggcgatcgactgtcgcttccgcatgttggaggcgtttctgacacagacacgacatgaacgcggcagcgtcgcggtgtccgacacggcccactttttgagtgcggcaatttggacacggcctagcggacacgcctcttcttttctttttcttttttttttttcatttgaaatttcatttaacaacaaaaattgcaacacacgtttcgacttttcagttttcactgtgcttctgccttcttgtttacgaaaccacgatccactggtgtcctttgaactccaaccagcttccgtctaccgtccttcaccggcgtcgtcaaaccaccatgccatcatcgatgttgtccaccgttcttgcaggcatatcacaactcgcgccgtagtcgcactactcacaacgtag

SEQ ID NO: 61350 - DNA, 153 bp, Glycine max
  Peptide Sequence Number=SeqID_153035
atggacctcaacatcggggaaagccgtactcgaaccctcctaagcaatatggtaaccgccccaacaatcagaggactgctacaacgaggattcctttacttgtactattcgattctggtgcaacccactcttttatatcccatttgtgtgtaa

SEQ ID NO: 61351 - DNA, 1023 bp, Glycine max
  Peptide Sequence Number=SeqID_153036
atggaagatttgaacacgattggcgctgattgtgtggtcatatcatgctgctgccagtgcttgatgcttcaaattcttgtatttgtgttgctgaagcttcccgggaagttgataaggaaaacaagagaatatgctaaaaagcttcgtcataggaaggcaaataatgatagaaggatggggagagaaatgggttcttataaagatgttcttctgagaattcatgaacaatcttttagaattcaagtagagatggcactaacagatggtgcagatcacaattgtggtggttgtatggatgaagttgaaaaggtgatggaggagttttatcaaaagggagagtttgcatttgggagcttttgggggaggaaggggccatgtggggctcctacaatagtcaacgatcataatgatgggtgcaaagagaaggaaagtccaagagggcaatttcaaagccatcttacctcaaggattatgtctgaggatgagtttctaagttgcagactcgtatcatttggtgctcacattatctttgtcatgccagactccactaagccttcaggatcttccgataagctgcatgatgccttcattcgtctcacaaatcagcaactatccctgggagagtctatgaatttcatgacccacaaaattgatgagctctttcatcgtgtttcccctttgttgaccacttcaccaccaattccttcatccctatcccatagctcccctgcacctgcattaaaccacagaatgaaattagatgtcccacgtttcgacggtacagacccacttggttggatcttcaagatcaaccagttctttgaataccacagcacccgcgaacacgactgcttaacgattgcttcgttttacatggagggccctgcaaactcgattcgcaccgtggcagtacaaggatcctatcgggaccttattcaagttgacacagaagggaaaagtggtgcattaattgtcggagttttgattataatcagcttgggccacaagggagttccctaccag

SEQ ID NO: 61352 - DNA, 399 bp, Glycine max
  Peptide Sequence Number=SeqID_153037
atggttagagttttagatcttaggtgcaagtttcgtataattggcgtttgcttccctttactgtacaagactgaagaaatttctaaggagaatgtggagaaggtacgaagtgctcttcaacaattatatgatgagtatgcggctttaagcaatgaagagtcatcctcaaatgaaatgagtgttggtggcataaactcctcaactatccatgtgcctaatacatctgttatgactgggttttatcaattaatgagccttgtgcatgaaaaggaagcagtcccaccaatgaaatcagaactagatgtttatcttaaggagaaaaatacttatattcctaataatggaaactcctcttttagtgccttggagtggtggaggaataacaacttcaaatattag

SEQ ID NO: 61353 - DNA, 228 bp, Glycine max
  Peptide Sequence Number=SeqID_153038
atgttttccaagaaggagagaatgatgagaatcctgaaactggccaaatacaggctaaaggcccaagtggagaaggacaaagcccctgagtggagaaggatgaaggcccagagatttatcaaggtaattcttgtggcgtctaccctgacttatcttccttcaccggaagtggcgtctaccatgacttatcttccttcactggaggtggcgtcatccaaatctccgtag

SEQ ID NO: 61354 - DNA, 759 bp, Glycine max
  Peptide Sequence Number=SeqID_153039
atgtcctttcctcatgtaaactcgcctccaccttccttggttgccttgtgtactaaaggctcagggctggttggtaaggtggactttactattaggcatctctcttcatccacaacttcatttcctagcacatggacattcagtagtggtcaaccttgtattggaagtgatgcccatcagatatttggtggtgttggtattgcctgtcttccattaggacttatattttcatttattcggcgtccaaaggctgttataactcgctcgcagtatatcaaggaagccactgaactgggtaaaaaagcaagagaactaaaaaaagcagctgaggcactacatcaggaagaaagaactggttcaaagggtagaaagtttcgtaaaaatgtgaagggagttgagaaggagttgtttcaattagaagaagatgtaaagcttcttgaagagatgtatccacaaggggaaaaggctgagacaacatgggctctaacagttcttggttacttggcaaaatatgttttgggaattttagggttgattgtttcagtggcgtgggtcactcatataattatctacctattaattgatcctccactttctcctttcttgaatgaagttttcatcaagctagatgatgtctggggtcttcttggcactgctgcatttgcatttttctgcttctaccttctccttgctgtgattgctggtgccatgatgcttggactgagactagttttcattactatacatcccatgaagtaa

SEQ ID NO: 61355 - DNA, 471 bp, Glycine max
  Peptide Sequence Number=SeqID_153040
atgacgctctcctacaacctaagacaaggaggaacaagctcatcatcctctgcatctggcacaggctcctctactggcacaggctcttgggttgcagaggcctcaccccctccaaaaagagaaggctggactcctggccaagccacttgtgcaaggaaatcatccacactcacagctagctgctggccagagctctgcaatctctttatgatgatgatctggcctctgtgcaggctctatagcatagcaaataatgtctcaaatgagaaggaggatggtcctgtaggaggagttggagctggtaagggagtgggagctaaagctcttccccttggccttcctgggccctctaaaagtcattgttggatcattaagattccaacggttcttcttcacatatgccacattaatggcagggctgagactctccaaggtcctggaatcagaagtgactcctctagctttgcataa

SEQ ID NO: 61356 - DNA, 1224 bp, Glycine max
  Peptide Sequence Number=SeqID_153041
atggaaagtcttgaagggaagtcttttggttgtatgatatccattcttcatagcatatatcttatagtcaggtctattgcttatgggactgataaggattcagaatccccaagttctcaaggtggacctgatgcagctgtatgggatgttaacatctcttctacattcttgaagaaattatttcctcgtttccccctcaacccggttgatcatctttctgaaaaggattgtgataggttgtttgacttgaacatgatcgttgccaaaatattttttgaattaaatgaatggacgagtcttcctcctaatttgttggagacatttctagaattttttgaaaatgctttgcttgggaagttctgcagggctacacagtctggtaaggctgtctgggaagagtgtttagttcagctcctttcatttattcctaaatttctttcacgtggggcaagctcttggacatcacgtcttcttcaggcttttacccagacatttagggaaagcaagccaggttccttgatgaaattggcatgtgtttctgctattgaagatatgctaactcctattgaaagcatgctttccatagagacaagcaatccagaaaatttagaacttcaagatgccttactcgcatggattagagagctccctctgttgcttatccagcttggagataaacacccaacctgctcccaggttctccattcagcctatagagatggacatataaaaattgcagattacttgagtgttttcatcaccttggtcttgcgtttcaaagtttcccctgctagaaaagctactgaattgaggaaagttgtgttcatccctggccaagaaaaagttaatttagttatctatgaaatcggttctgctggttttaagagtgatccactctgccaaactttgaagtcaatgacaactgttctttgctcatacatggcacagatgggtgacaattctcttgttctgcagatagtagagaaagtgccacaaatgccttctttggataatagttgctctctcctgagaatgcttgttacagtggattccaagcccacaagactttctgaacaaagcattatcattctaggccagcatctttctgaatatctgatggatgctgtgcagcaagatagtggtgaaggagatgttgaaaaacaagcagagtggaaccaagccttcactggaaatcagtgcgatgtgttggatttatgtctcaag

SEQ ID NO: 61357 - DNA, 228 bp, Glycine max
  Peptide Sequence Number=SeqID_153042
atggtttcgatcgaaggttcattgtcaggggagtcggtcgataatgagtctaaggttcatgggtacaataacgaagtttttgaggtgagtgagaatattgtagctccagtgctggtgcctgctgtcgagaaggggacttccatgaaagttgcaccttggcctaagaagcaccctatgttgaaggataagtgttcacctccccctattatgcttctcaagtacaattag

SEQ ID NO: 61358 - DNA, 1632 bp, Glycine max
  Peptide Sequence Number=SeqID_153043
atgacgccacttccggtgaaggaagataagtcaggaggccttgaagctagttatttcagaatgcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaaggtcctgttacaggaagggcagctgatgtcattgctgccgcaaatactgctgctgaggtggccttgaggcttgtcaggccaggaaagaaaggaggatctaagtcattctccttttccgttggtggtggctcaggtgattccaatccttttggatttggcttggatgatctttttggcagttttttcggtggtggaggtggtgggagtcagtttggtggttttggcagttcagccaagtctcaatctgggtccaagagttcttccaaaagtcttagagctgtaaattcacagatttacaagaaagaaatagagaatgcagggatgacttggcttttgttatcttatatgccctcttcgatggagatccaatactttgaatccactatagaggaggttgcaagttcgttgcatggagctttgaaggttggaagcataaactgtgaaaaggaagtctcattctgtaaggagcttagcatatatccacgcagagctccaaggcttattgttttttcttacaaggagaatgaaaaaggttatttggtcgagtataggggagacttggctgctaagaatttgaaggctttctgtcaagaatatttgccaaggttttcaaaacgaactgacttgaatcatcttgatcaattcagcactactggaaagttgcctatggtgctgcttctctccaccaagaaggacactcctgtaatttggcgtgtccttagtggcttgtatcacaaacgcattactttcattgatgcagaggttcatgatgtttctgatccaagagtgaaaacgctaggagttgatgcacttccagctattgtaggttggctaccaaatggagaaaagcgtgttctaaaaactgggatatctgtgaaagatttaaaatctgcagttcttgatcttagtaacatacttgatagttttgaaaaagtaagtaaaaaggaatcatcaggtcaggccaaggaggcacaaactgactcagacgagggacgcgtaccattactttctaaatcaaacattgaggctctatgtggtgagaaaactccagtctgcataattggtgccttcagatcttctaaagctagagaaaagcttgaatcaatcctctctttggtttctccaaaatctttgtcaagacgaccaaatcagggatccagcagctctagggactccatttcctatgctctcttagatgctgcaaagcaaaaatcatttctaaaggcatttgacaaaacaggaggtgttcttgtcgatgtcttcgatgtgtacaagtctgaaagagaaggggatacatgcaaaaggcactccaacgctcaagtaaggattcgattgagagctattgattatatctaa

SEQ ID NO: 61359 - DNA, 267 bp, Glycine max
  Peptide Sequence Number=SeqID_153044
atggcaaggatgagagtagaaatagtggagttattagtgtcatcataccagatattggatattttggctatttgtttagctattagcttgcatagccagatagtttcagtgtcctggttactcctatctattgactctctttctggttatgcttatgcatttgcagacatatacttgatgagtcttgagatggaattcgtaaagttttttggcataaacaatgatgttgactcacttactgatggtgttattaaagaggtagcgtaa

SEQ ID NO: 61360 - DNA, 405 bp, Glycine max
  Peptide Sequence Number=SeqID_153045
atgaatttatttataggtctggtacttataggtcagccagagttgttcattcacattattcctgacaagaccaacaacacattgtctatcattgacaaaggtattggaatgactaaggctgctaagattaaatatttgcgagtaaattttcacgacctcatcaacctcaaaaccacaatcctcagagaattggattggccattctttggtgatcaaggagtggctggaagattgatagaagatgtttgggagattggggtggtaatggaaggaaaggaagagggaaagaagattagagacaatgctcttaaggtgaagcagactatgcaagatgcaactaggcctgaaggacaagcagcacgggatttgaagactttgattgaaataatttctactacatcttaa

SEQ ID NO: 61361 - DNA, 363 bp, Glycine max
  Peptide Sequence Number=SeqID_153046
atggggctttattggccattggatattcttccatacgtaggacttgagtggggatttgttgagattgggtggtacgggattgtgattgaggtagaggaggaggttgagatggatcaagatgatgataatgatgctggaaataatttggtatttgaagatgatgatgctctaaattgggcaactgcaatggttgttggatcttcatcaaggaagcaaaaaacagtccaagaaaatgatgaagatctagattttgaggagaatattgatcttgaatctgaagaagaagaaatcatggtcaattttgaggcgtctgatggggaagagggagagggagatgttccattaccatatgataacaactaa

SEQ ID NO: 61362 - DNA, 144 bp, Glycine max
  Peptide Sequence Number=SeqID_153047
atggtgatcagttcggacaagtataatggagttggtagtggatccatggacatgggatccctagtatcaatagtctttcctggtgggttaacatcagttttcggcaaaaccgatgttaacacaaacacggtggcatacttgtaa

SEQ ID NO: 61363 - DNA, 396 bp, Glycine max
  Peptide Sequence Number=SeqID_153048
atgctgtggatgctgggtgatggacatggacttgggcaacatgatcaaattactcacatcgctcagtccaattcttcgaggttgggcttccctgccttgatgacgaccctctgcgatgccaaggggagtctccataaggttaataccttctcatacagagtctccatcagctctccctctagcagccagtcttgtcaccagaggttttctaggagcgggtcgcttggccaggggtccagccttcctttgcccggggaggggggtgacacctctagagctggagctgatgttgatgtcggtgatgatgatgttgcagatggtggtgatgacgaggactatgttgtagatgttacagctgcccaaggagtttgggacccttggcccactcaggattga

SEQ ID NO: 61364 - DNA, 576 bp, Glycine max
  Peptide Sequence Number=SeqID_153049
atgcatgactcagaggtagcagagccacattctgctctggaagaatgttcggaaggtgaacattgtcctagtagcagagccaggcgacctcaaagacaaagcaggtcagacagagaaggtataaggcttaatgcgagatgctcgctaagctcagtacaaattagaacagaagcagggggtgctaagtctagacaaaacagacaaagggcacaggggcatggcggcttagcacgaggttgtgcggttaggcccagacaaaaggcccaaggcttgtgctatggcacacgaaaggcattggggcttagtgcgctattggcgctaaacccatgcatagaatacaaaatggcaatggggcttagcgtaaggaggaatcaacaagaggaatggaagaggagagagagcatgggaaacaagaagaggtttatgaaactgcttatagttatggccttcgcgcttagcatgagcatcgcgcttggagtgcgacctggctgttacagttgcattaatggtcccacgcttggcgaacgtgacttgcttagcgcaccaaggacgacgttctttggtcttcgctcttaa

SEQ ID NO: 61365 - DNA, 192 bp, Glycine max
  Peptide Sequence Number=SeqID_153050
atggcggtcatgaaccctagtggcgacgatagtgaggaggagatggcggtgataggtcttgtggatattaatgatccaagcttaaggaggatacctaagctctctgctgaatggtactcaaatttactaaagaggaagcctatggccctaaagatcattaaggaaattgagaagaatgcagttgtactttaa

SEQ ID NO: 61366 - DNA, 135 bp, Glycine max
  Peptide Sequence Number=SeqID_153051
atgtggtgcattaaggaggcttccgtgaagagcaacgccgtcgtccaccatcgagggagcttcgtgaccgtccaccgtcgaggtaagcgccgtgaccctgtcctttttccaccattgttgccggcgatggcgtag

SEQ ID NO: 61367 - DNA, 546 bp, Glycine max
  Peptide Sequence Number=SeqID_153052
atgccgtcttctggtcctgttttttcattctctggaactcccaccattactactgccaaactcaactggaaaaactatatgtcttggtctgcttccgtggagttatggtttctcggccaaggatatcatgatcacttggaaaagggagttgatgctgttccgaatgacaagagagctgaatgggaaaagctggattttcagttgtgtgcagtgctatggcaatctgttgaaccggatgttttggagatccttagatcattcaaaacatgttgctctttttggaagaaagcacaagagatatttgccaacgacattcaaagtttgtttgatgcaacccagaaagttgctgctctcaaacaaaccagccatgatatgattgcgcatgtagggaaagctagagcagcagtggaagaactgaagagatttcttgcagcaaaatcgttggaggaagtgaataggaagctggacaagttctacatggtccttatcttgagaagtctacatgcagattttgatcatgtgcgtgatcaaattcttgccaggtga

SEQ ID NO: 61368 - DNA, 726 bp, Glycine max
  Peptide Sequence Number=SeqID_153053
atggtttctggatcttatattctggtgctgaaagagacaaagttcgagtattcggagccggttttgtacttggatgtggggatttggcaccctttggctcccatttctagccccagttgcccgttgccagttgccaggaacacaatctcaatttggtcgttaactgctaattttgacaagttaaatagtttgtcgcacccacttgaatgcttgcaagggaacccagttccggcattcctgtccaagactttcgaccccgtcgacgatccgtcgctggatccgatcatgtcctggtgctacagcggtgttagctacatggaaatcttcaaatctacagctgatgcttcattttctccaaatctgcaagccttcatcatggatttgcagcatattattcctttgttgagaaaatcttcaaagctgatgttgtacttcattttgggacacatggttcccttcaaagctgcacgtcttccatggtggctttgccgaatgaaactaccaaaaaatgcacaacaactgtcacttgcagacatggagaaatcaagtgaacaagaagaagcaaaggaagaagaagaagcaaacttgcgtgagagaagatttaaagaagcatacttcaattccacgttggacagtctacgtggcactgaattgccaccaatgcacctcactaacggcgtcacttgggaatttaacgacaaggactattttgaaaaacttatgtaa

SEQ ID NO: 61369 - DNA, 504 bp, Glycine max
  Peptide Sequence Number=SeqID_153054
atggttaggaccagaggattaggtcgtgccttaggtcaggttactggcataggtgtgggcagaggaaatcgtgatgattccgatgctgctcctcagcgtcgacggcctactccatccgcacggaggcagcgagttgctgtgactgtgacgcacgatgagccaatggtccctgcgccagatgttcaggatgacccgatggaggcaccagctgctgtagaggacattgtggcagacattcctgcggacacagttttccttcaaatgatgattttaacgaattttgcgttcctttatacttcaattcaggagcgtcctgaattgaagcgatcctctcatgggaggaaggtccatagtttaggcaggcttgtccctgccattgagggacttgttgctggtacaggactaagtcctctgattgcgtgttcggtagacaccggtgatcggggacttttgtccacatttgtggagcggtggcatcgggagacgtctagtttccatctctcg

SEQ ID NO: 61370 - DNA, 297 bp, Glycine max
  Peptide Sequence Number=SeqID_153055
atggcatgcggagacaaatcatggtcatctgcaacctttttgtcatccagagacaatcaagtccgatggcacgcagagacaaatatggtcatctaccctcttttgtcgaagactcaatgtcttttgatagagactattaaagtctcccctccgtcatccagagacaatcaggtccgatggaacgtggagaccatcatggttatccacaccctttttgctatccatagacaagcgagttcgatggcatgtggagaccattatggtcatccgttttcgttgttttcaagactattttag

SEQ ID NO: 61371 - DNA, 150 bp, Glycine max
  Peptide Sequence Number=SeqID_153056
atgatgcttgtaaaatatggcttatgtgatgcaatcctccctaggaagggaccagtcactggagccatgagcaagaggctccaagaggattgggctagagctgttgaagaaggccctagggttctcatgaacctcagggtagatttctga

SEQ ID NO: 61372 - DNA, 240 bp, Glycine max
  Peptide Sequence Number=SeqID_153057
atgcctaaattaccccttccttttcggctcctgcattcggtctcgtcgatgaacagtgtcgccatgaacagtgcgttgcaccaggccttttttaaacgacacaatgcttcctttgggttccgtgaaggggaaggtgaaggcggtggtggtcggtggcggcatatgaggtacacagtgatgggttcgtcatcttttgacctacgaaaaatcgggcttcttagtgatctacggattccgtag

SEQ ID NO: 61373 - DNA, 873 bp, Glycine max
  Peptide Sequence Number=SeqID_153058
atgtcatctgcaaaaagcatgcatctcggcactatctcttggatttgttccgtgaggacatccagaattaagggacaaacaacccatgcagacaatatcgactttgcagttgggtgtgtggacaaagactcgaaaaccattgatgccgaggtggtagaggagatcaaggtggaagagactgagaatttgcagcagaaaatgcaggaaaaagaaggggatttctcaattatcatcaaagaatctcattcttgggtagtaaatgtcatagatgttgagggtgataatgcagaactacaacttctcaaggagaaagatgggtcttctttgttgacaaagcaaggaattttggcatgggttgcaatgcaaaagttttcagcatcaacactacaaaagacaaagaggactgtagacgaggtgagagcaactgttgctgagctgcaaaatgttgtctgtgtatttagtcagttgtctgctgcttccaacctacatattcatgggtttgatgagaagaaaattgacactcatgttggatactgcaaccacttactttcggctgctaaagttcatcttgaagcagttgagcgtgaagagcagcaagtactacagagacaaaaacttgctcgtcaggttgcattgactgaggaagcccgacgaaaggctgaagagcaaaggaaatttcagatggaaaggagaaaactcgaggaagtgtgtcatttcagttttcaaattccagccttgaggacaaggaccctaaaatggatggatgtgatgcatgctcagaggaacagaggaattgcatgcacatcccagagcaaaagagttgctgctcaacagaggactggcacattattgcttgtcactgctgtcatttga

SEQ ID NO: 61374 - DNA, 423 bp, Glycine max
  Peptide Sequence Number=SeqID_153059
atggagagcagagtgagcgctttggacaaattggccagcaagcatggaaaggtgattacagatctaaaaacagacatggatctcataaatgaaagattgttggagatgaggcaaatcaaggaactacttcttgaattcaagaagggaaagacaccttcagatagtggggaaaacttggtcaacagagacaagaagctggaagaggagaacaatgacaataacagcatttcagagttgaagcatggacaactaaaaagtttagaaaacattcttgaggttaaaagggaggaaagcatggaggaggagccctctgaaatcaagatcaagaaaacaattgaggaaattaaagagactaaacaacaacaacaacaacgccttatcccactaggtggggtcggctacatggatcaacttccgtcataa

SEQ ID NO: 61375 - DNA, 1773 bp, Glycine max
  Peptide Sequence Number=SeqID_153060
atggagaaactgaaagtgtctgctaagaatgatcctgctgccagcagtgatcaggcagactcatttccaatattcaaaatgcgagacagtcagaatgttggactgcagaacagtagaagagtggaagatgatgcaaaagctgtaagattggatggaggttctgtaattgttccctctaattctgcaaacagtaaggaacctatcaacaagtggatggcatttgcaaagaagcctggtttcacagttgatggcaactcagcaacaaaggataaaagtacaagcgaagataattactcgaggaatcatctaaacgagaagtcgtcttctattgtaaccgaagcaaacatagctgagagaactgctgaatggggtcttgtggtgaactcgaggaatttcaaagcattagggggagagaatacaagtggctcttttgatggtgacagaagcagaaacttgtcagatagatttgttgaaccgacacggacgtcaggggagtcaaactacggatctgagtcatcatcaggggtgtttccaagggtgtcgcaagagttgaaggaagcattggcgacgctgcaacagacatttgttgtctcagatgcaaccaaaccagattgcccaatcatgtatgccagcagtggcttttttactatgacaggctattcttcaaaggagattattggaaggaactgtcgatttcttcaggggcctgagaccgacaagaatgaagtggccaaaattcgggatgcaactagaaatggaagaagttattgtggcagacttttaaactacaagaaagatggaactccattctggaatcttctcactatcacccccatcaaagatgaccatggcaatactatcaaattcattggggaatgtgctaaagatgtaaaatcattcttgggtgtttccaaaaccattgaagctttcaggagattcataagagcctctgggcaatggggtacgaagttttttatccggaaacagcctctttacatatgcaagggtaaggctgcgtacaacatccctccctcataccttcgcatagcgaagagcctcttggcaatgggaatgcaggttgaagtgagcaagtatacagaaggcgtgaatgaaaaggcattacgaccaaatggattacctaagtcattaattcgttatgatgctcgtcaaaaggagaaagctttgggttctatcactgaggttgtccaaaccgttaaagacccaaaatcaattattaatgataggaatggtgatactgctgccaagcctgaagaacaagagaagttcaattttgattttgttttgccaaagtctgctgatattgggaatacaaacacacctggtagacaagcttctccactttacatccaacgcatgagttctagtcaggataagagcaggacatcacaatcaggacggatttctttcaagggtttaaaagggagatctctgagttctgcagaggagaagtccatagttgaacctgaggttttgatgaccaaggaaatagagtggtctaacaatttggagcattcactaagagagagggacataaggcagggaattgatctagcaaccacattggagaggatagaaaagaactttgtgatttctgatcctagacttcctgataacccaattattatggatgcggaaagccacattaaagttgaagcagctagttctagcttttacaccaaaggctcatttgtcgtgttttttttggttggggaatgtagttccaaacatgcaccaagtttaactaaagtgtaa

SEQ ID NO: 61376 - DNA, 1427 bp, Glycine max
  Peptide Sequence Number=SeqID_153061
atggttagaactacaggtttgggtcaggctttaggcagggttataagaagaatcctaggaagagaagtcagtagttatgcggatgaagcccctcaacagcgaaggcccacagtatctgcgcataggaaatgggaagatgcaattgttgctgaggatgttcagcatatggaccatgcagatgacgagatccatgaacagcctgaagaagcaactgttgatgatgtagttattgataccaagggttttccaggcagaccccacgacacattagttttgatggactatgtttatcatgtgacaatgaaagaacgtcatgagctaaagttatcctcccatgaaagaaaggttgaaaaatttgacaggcctgctccaaagatcgaaggcttagtgactatcaccttggatgatgtgtcatcgttgttgcatctggctattacatgtgtgttccatagctttgagcctcttcatgtggatgatgtcatgtttctcttagttgaattgcttgaagtcagtgctgaagaggcaagagctgagacagtacagtacaatgccatggggcatatgtgcgattatcctggctgcgagacatatatcagagcaaatatgatgcaacacaatgctgttgcattggtgcatatgtatgagaatttgaatgatgtgtcaaagagtaggaccagacaacttgcaggatatatcacggttttacagtgttggatctacgagcacttttcttctgttagttttgctatcgttgctaagaattatgatgagaggaaaccatgtgcttgccgttggaagtttgggaaggcattaccagtatcgacgtatcgtaagcgtttggatatattgacgtctgatggcatatcagatgaggtccatctattgtcatacacagaccggagaggtccaacacaacatggggatcctcctagacatccacctgtgccgcaccatgacacatttgttgaatcagttgttgctcagcacccggtggtggcaacaactatggacgaagcacctgaaggtgcacatgttgatgtagaccagcctcgacatgcagtgtgttggatttacaagaactttccttttgttggttttgttattgctgctgaggattatgatgagaggaaaccatgtgcctgtcgttggaagtttgggaaggcattgttagtatcgacgtattgtaagcatttggatatattgtcatacaccgatgcattcagagagtttgaggttatctctttatttttcaggcatatcagatggggtccatctattgtcatacaccgaccggagaggatattttctgaatacattgcacctgtgggtcagatatgtgtagcgcttggacagtgttcaccagatgttgctcaacacccggtggtggcaacgactatggacgaagcacctgaagggcaaatgttgat

SEQ ID NO: 61377 - DNA, 270 bp, Glycine max
  Peptide Sequence Number=SeqID_153062
atggtagtgtatatagcaaaggggggggtgaacttatcagtatcttccgtaaaaattccaaaaaccttgaaaaatccaagtcgaggtgcttccgtaacgcttccgagacgtttccgtgagcaaatccgtgaaggtttttccgtcgttcttcaccgtttttcatccgttcttcgttcttcaacgggtctgatttcctcatcgcaattgaggatacgtaggagcaaaagtcccgcttttgtcgaccaccccaagagatcgttaatggtctaa

SEQ ID NO: 61378 - DNA, 228 bp, Glycine max
  Peptide Sequence Number=SeqID_153063
atggcaaccattgaattatcgagtagatataggagcaagctttttcgctacaaaattcatttcttggttggtgtttttggtttgcgcttggcattgaatgtgcggccagcaaactttgtggatgatttggggatagcctttgtggatgactggatggtgggtaatgagaagggccgatattggctgagcgatgacattgttgggctggtgggaagtttggccatgtag

SEQ ID NO: 61379 - DNA, 594 bp, Glycine max
  Peptide Sequence Number=SeqID_153064
atggctacaccaatgagtactgcttgctatttggataaagatgaaaccggtcaatcaatagatattaagaaatatagagaatcatcaaagaagcaaaagggatcttcctccaccaccaccgctgctggttgccgccgccaaggaacctctggagacccacccgcaccaattcctccatctctttcatctcatcgatcatccatattattttcctcagatgatcagcatcagaggtactattctcaattctataatagagtcattctagatcctaagtaccttgaccttgaattttttgatggagaaacatttgattgttaccaagtgtttcaaaattctactttggttgatttcatgtctatgaaacttccttactttcctgaattcgttaaagttgtctataataatttgaagattcaagatggtgttctttactctgaagtgcatagtattcccattgttgttgatcagtccttgttttatccaagatggtgttctttactctctagatgtttttggctttttgatgttgccaaaggaggagagaacaagggtagaatttatcatgaacttaggcataaattccaatcttaa

SEQ ID NO: 61380 - DNA, 87 bp, Glycine max
  Peptide Sequence Number=SeqID_153065
atgacgccacaaggaatcaaccttgataagtcagaatttggttcaacaggaaccctaagagaagctttctcacctaaaaaggcatag

SEQ ID NO: 61381 - DNA, 180 bp, Glycine max
  Peptide Sequence Number=SeqID_153066
atgaaggttcaccaccaagagagtgtcttggataagaatcttagagaggaagcttcaatggaggaagagaatgagaaagagagagagagagagagagagagagaaagtggcatacgaatattccaaggatatgtgaaaggcatcttagcatattccaagaatatgccaaaggcatcttaa

SEQ ID NO: 61382 - DNA, 246 bp, Glycine max
  Peptide Sequence Number=SeqID_153067
atgaggcttcactgtcatcaagtgagtcggagacccagcatgaccacagattcacctccactccttatggctcacacagacccgggcatagggcctaatatctcaattccccagtggagtcgccaattgtcgcaacctacccttcgccgggagggcgacgcggggctcacgggtgcgtcttccaagggaggaaggcacccgaagttgccaccaacgtttattcaaggaaaacgtcagaaaaactga

SEQ ID NO: 61383 - DNA, 183 bp, Glycine max
  Peptide Sequence Number=SeqID_153068
atgggtctaactgatgcaatcctccctaggaagggaccagtcactagagccacgagcaagaggctccaagaggattgggctagagctgctgaagaaggccctagggttctcatgaacctcagggtagggtaccctagaaatataggatttttcagcccttgtattttagggcacctagactag

SEQ ID NO: 61384 - DNA, 198 bp, Glycine max
  Peptide Sequence Number=SeqID_153069
atggcatcgttcagccagatgcagtcccagtttcggtcccagatgcaatctcagggacttgcactacctccggagcctctggttggtccctcaagtcctcgagtaagcacaaaggagagttatgttgatacctcaggaaacaatcctgagacggggacaagtaagggcgagattgtggattcaaatcccttctactag

SEQ ID NO: 61385 - DNA, 318 bp, Glycine max
  Peptide Sequence Number=SeqID_153070
atggcaattttgattgccaatacttcgacaacatttcataaagatgaaagactcgggaatacaaatgggtttatgatcccaacatggttggctcatgagaaaaacgcaaggatcaagcatgagcaaaacatgaaaacaaaaggtatgcattttgtagaacaaaaatgccccatgtgtgcagttaggagggtgttatggattttccagcttcccgtgacaaaagacgagaccaacatacaacgcgtgcgtgacgacatgatgcagacgcgcaaaagcacaacatggggatgtacacagtatggcaatatccacaaataa

SEQ ID NO: 61386 - DNA, 237 bp, Glycine max
  Peptide Sequence Number=SeqID_153071
atgcaatggcactcacatttttgggattttggacagattgagaagtcatttgcctcacaagttcttcaagggaaggttgcggaggggcctcaaatgtttgctatttctggggttattgttgttgttattgttgttgctgctggattggtggaggaacgtatggtctgcttgggacagcagcattctggaaataaggttgttgtttttgctgctgttgtgaaggattcgaccatctaa

SEQ ID NO: 61387 - DNA, 944 bp, Glycine max
  Peptide Sequence Number=SeqID_153072
ggcatgacagtcctgatataactgctgcgcggtcgcgccatgaaggattctggtgcgatataaattataaagagaggaagagaacagtgaataaatctcaactgattgacaaaattgctgcgggtgcggacatttctaaagctgcagctggacgtgcgttagatgctttgatcgcttctgttactgaatctctgcaagctggggatgatgttgcgctggtagggttcggtacttttgctgttaaagagcgtgctgcccgtactggtcgcaacccacaaacaggtaaagaaattaccattgctgccgctaaagtaccgggcttccgtgcagcggagcgttgttacaccatgatggacaacctacgcacggccgccaacagcgtcgtgctcaagattattttcggtatcattatcgtctcgttcattttgaccggggtgagtggttacctgattggcggcggcaacaactatgccgcaaaagtgaatggtcaggagattggccgcgcgcagtttgaaaatgccgttgccagcgagcgtaaccgcatgcagcagcagctaggcgatcagttctccgagctggcggccaacgaaaactacatgaagaccatgcgtcagcaggtgctgaaccgtctgatcgatgaatcgctgctggatcagtatgcccgtgaactgggcctgagcatcagcgacgaccaggtgaaacaggccatcttccagacccaggccttccagtcgaacggcaagtttgataacgagcgcttcagcggcatcgtgaatcaaatgggcatgaccaccgatcaatacgcgcaagcgctgcgtaaccaactgacgacgcaacagctgatcaatgcggtagccggtaccgatttcatgctgccgggcgagtccgaccaactggcggcgctggtatcccaacagcgcgtggttcgtgaagcgactatcgac

SEQ ID NO: 61388 - DNA, 630 bp, Glycine max
  Peptide Sequence Number=SeqID_153073
atggattcactcggtgggagtcgttccctctacgctccaccaaaaattgaaattcgtattggaagggcatttggttatcgtatcgggcgaggaagacatcttgccgcagaggagtcattagaaaccagcttccagtcttttgaggtggaaagcatatcctccgtggactccttctctgggcaagcttgcctatccaatgcagcagtaatgatggcccgaattatgttggggaacggttacgaacccggaatgggtttaggcaaagacaacggcggcataactagcttgataaatgccaaaggaaatcatgggaagtatggtttaggctataaacccactcaggcggatataaagagaagcatcgcgggaagaaagagcggtggtcaaagctcgcggttgagacaagaaaatgatgttccgagtacattggatttggtacgaccatgccctcctgatttccagctaggaaattggcgagtggaggaacgccccggcatttacgcaacgagcataatatccgatgacgagtcccccgaaggtactaatacctgggacccgcttatcaacttcgagcaagaaacgaatcaaatggaagatgaagggaacgaggatgtgggacttcccccataa

SEQ ID NO: 61389 - DNA, 123 bp, Glycine max
  Peptide Sequence Number=SeqID_153074
atggctccaaaaaagctttccgcgaagaaatctatgagggatgccgcggctgaagggactagtgttgtccccgagtttgatagccatcgtttcaagagcgccgagcagcagcagcgcttcgag

SEQ ID NO: 61390 - DNA, 112 bp, Glycine max
  Peptide Sequence Number=SeqID_153075
atggagacaacaaagggtttcctccttgcaagcattgtggcagaatgggtcatcctcctttcaaatgctggagaagacctgatgttaagtgtgaaaagtgcaacaagttggg

SEQ ID NO: 61391 - DNA, 283 bp, Glycine max
  Peptide Sequence Number=SeqID_153076
atggacatagactttgatataaggaaagacgaaccacctgcaatcattgatgaaagtaacccagctgatgttgcgctatatgagcaatgggagcgatccaaccggctcagcgtgatgttcattaagaccaaaagctcggctaggatacatgattctgttgacctgcatgaaaaggtccgagacttgcttaaggccattgatgaccaattcatcacttcagataagactttagcaagcaccctgatcatgaagttctcctctcttcggctcactagtgtgacag

SEQ ID NO: 61392 - DNA, 231 bp, Glycine max
  Peptide Sequence Number=SeqID_153077
atggaggatgcacgaacagcgctaggcaatcaattcgtggggatccggactcgatggatgcgcgaacaacgcttgacaatcaattcatggcgctccggactcgatggtggaggatacatgaacgacgatcaattcatggggttccgaataagatttgatgatggaggatgtacgaacagtgctaggcattcaattcgtgggactccaaactcgatggtggaggatggatga

SEQ ID NO: 61393 - DNA, 274 bp, Glycine max
  Peptide Sequence Number=SeqID_153078
atggacgaagatcaatgggcatattacagtaagatgtctgaagaagttgatatggattttcaagatgaacaggattgtggtgcgaatgaaggacatgttgattgttcagacgcttttaatacttctcaggtctttgcaacccgagaagatgttttgcagtgggctcgaatggttgcccatgaaaacggttttgttgcagtaattatgaggtctgatacatataatggtagcagagaaagaacttcatttgtgttaattgggtgtgaaaggagcg

SEQ ID NO: 61394 - DNA, 120 bp, Glycine max
  Peptide Sequence Number=SeqID_153079
atggtgaagttatgccttgtcaaatcacaggggaccaataaagtgctccttcaaggtgctgtgggtgccgatggtctctattcttttcataacatcaaactccaggatcacaaaccttag

SEQ ID NO: 61395 - DNA, 204 bp, Glycine max
  Peptide Sequence Number=SeqID_153080
atggctgatgaacatcagcaaagggttacccttgaagggaaattattccaaggattaccaaatgaggacccttatgcacattcggtgacattcattgaaatctgtaacactgtaaagattgtaggcatgccagatgaagccattagtcattttattttcattttccttagcagtagaagccatgaggtggctccactcatttaa

SEQ ID NO: 61396 - DNA, 711 bp, Glycine max
  Peptide Sequence Number=SeqID_153081
atgtccctcgatcccgccctgcgttcgcgcatcgaatccatcctcaacgccaaccgcgtcgtgctgttcatgaagggccagccgtcgatgccgcagtgtggtttctcggccaaggccgtgggcgccctgcaggacctcggtgtcgagttcgcccacgtcaacgtgctggccgaccaggaaatccgtgaaggcatcaaggcctacggcgactggccgaccatcccgcagctgtacatcgacggcgaactggtcggcggcagcgacatcgtgctgcagatggctgccagcggtgagctgagcagcgtgctggggctggccgcaccggaccgcaccccgccgagcatcaccgtcaccccggccgccgtggaaatgctcaagggcgcgctggccgacgctccgggcgctgccctgcagctgaccatcgacgccggcttccagccgaacttccagctggccccgcatgacgaaggcgcgatcgctgccgaatccaacggcctgcgcgtgcagttcgacctgtccagcgcccgtcgcgccaacggcatcaccatcgactgggtggacgacatccgcggcaagggcctggccatcgacaacccgaacgcgccgaagccggtacaggaaatcagcgtgcgtgatgccgatgacatggtgcgtgccggcaacatcaccctggtggacgtgcgcccggccgacgagcgtgagatcgccgcc

SEQ ID NO: 61397 - DNA, 318 bp, Glycine max
  Peptide Sequence Number=SeqID_153082
cttgggaggattgatggggactcggtgttgagagaaacgaggatatgggctacttgggagtacatgagctcagttggaggtgggcaacaggggatgagtggtacctggagatatgtcgcgggggtcaggagaccttggggacgtcaggtcgggcgagctcctggcagtcaacagataaaaggaacaaagaccacaaagcaaggaggcttgtgtggtggctggccagctgtgaatcttgtgcttgaaaacgaggtcaggaagctatgggggcttctggtaatcgattaccaagggggtgtaattgattaccaagcttag

SEQ ID NO: 61398 - DNA, 628 bp, Glycine max
  Peptide Sequence Number=SeqID_153083
aaaaggacacgctttacggtgcccttaccgaactcgtgctagagctagagtaatgggtgaagtagaggagatacaagagaagatgaaggccgacatggaggccattaaaaagaaaatggccacaatgatggaggccatgatgagcgtgaagaagataatggaagccaatgcggttgcaattgccgctaccagcgttgttgctaaggtgaacccgatgtccccatccggcctcaagcaaatgaatcatccaacctcaaatatggtagccaaagatttaggaagtacgggcggcccccatgatgtgcaaattcaaaacgagcacgccttcccgtcatatggcttgcctctcaactatacgccacccaatgtggcgtacactcccaataagaatacccatgaaattccccaccacaatctagctgacttcgagccttggctcggatatgccactgaagggcaagcagttggtggtatacccctacaaaaccctttggagggccctcagtatcacccacaactgcacctcttgcattccacaacggttaaaaaccctcatgactatggcaggaatgggatcgaattcctgcagcccgggggatccactagttctagagcggccgccaccgcg

SEQ ID NO: 61399 - DNA, 114 bp, Glycine max
  Peptide Sequence Number=SeqID_153084
atggattttgagccagtcatccctgacccagacgttcaggatgacccgatgggggcaccagctgttgtggaggacattcctgcggacgcaggctcagaggcggctgaggattag

SEQ ID NO: 61400 - DNA, 461 bp, Glycine max
  Peptide Sequence Number=SeqID_153085
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaaacgccagcaacgcgggggcctttttagacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 61401 - DNA, 942 bp, Glycine max
  Peptide Sequence Number=SeqID_153086
atgccgcctctctggttccaattcctcgcgtttctatgcacccgttggggcccgttttcgaaataccctcaccttcagagggctacacgtcctcaccttcagaggactacacatccttgccttcagaggactacacatcctcgcctcagaggactacacgccctcgccttcatagggctacacgccctggccttcagaggactacacgtcctccccttcagaggactgcatgtcctccccttcagaggactacacgtgctcactttcagaggactacatgtcctcaccttcagagggctacacgccatcgcctttagaggactacatgccgtccccttaagaggactacacgtccttagagggttgcatgccctcaccttcaggggactacacgtccttgccttcagaggactgcacatcctccccttaagagggctacacgtcctcgcctttagagggctacacgccctcgccttcaaagggctacacgtcctccccatcataggactacacgtcctcgccttcagagggctgcacgccctcaacttcagtgggctacacgcgctcgcattcagagaactacatgtcctccccttcagagggctacatgccctcaccttaagagggctacacgtcctcaccatcagaggactacacatcctcgcctttagaggactacacgtcctcaccttcagagggctgcacatcctcaccttcagcgggctacacgcgctcccattcaaagaactacatgtcctccccttcagagggctacacgcgctcaccttcagaggactacacatcctcaccttcagaggactacacgtcctcgccttcagagggctacatgccctcgcctcgccttcagaggactgcacgtcctcccttttggagggctacacgtcctcgcctttagagggctacacgacctcagcttcatag

SEQ ID NO: 61402 - DNA, 237 bp, Glycine max
  Peptide Sequence Number=SeqID_153087
atgaggggcaccgtgcatgagcctcaaggtggaccttgggtactagttaccctcaccgttgagaggactacacgtcctcgccttgaggggactacgcgtcctcaccatcagagggctgcacgccctcaccatcagaggactacgcgtcctcaccatcagagggctgcacgccctcaccatcagaggactacatgtcctcgccttgagagggctacacgccctcatcttgggtactag

SEQ ID NO: 61403 - DNA, 489 bp, Glycine max
  misc_feature (89)..(89): n is a, c, g, or t
  Peptide Sequence Number=SeqID_153088
ggacatttggtcatagtatcaggtgaggaagatgtcgtgcatcacctccgtagattccctctcaaggtagcctcgcctgtccgatgtgncggtgatggtagcccgggtgatgctggggcacggctacgagcccaaaatgggtttgggcaagaacaacggcggcaggaccagcctggccagggcccgcggttgggacaacaagccaaagaggccccgccctaccacatcagtagaagattcatgagtgcgggtataagacgcgaagatctttcttcatctgttcctgcgcctctacccattctcattcatttgcatgtttatttctttacgcttaaaaacactagatccgacgacgagtcctgcgaaggtactaatacccgggacccgaccatcaatttcgagcaagaagcaggtcagatggagaatgaagaggacgaggatgtggggcttcccccagagttggagaggataatcgctcaggaggactga

SEQ ID NO: 61404 - DNA, 447 bp, Glycine max
  Peptide Sequence Number=SeqID_153089
atgaccgactctctcgatgagtcgaactcttgctttctcataagggtgaacccttgggactacacgtcctcacctttagaggactacatgtcctcaccttcagagggctacacgccctcgccatcagaggactacacatcctcgccatcagaggactacacgttctcgccatcagaaggctacacgccctcgccttcagaggactacacgtcctcatctttctccttcagaggactacacgtcctcaccttcagaggactacatgtcctcgccttcagaggactacacgtcctcgcctttagagggctgcacggccacgccttcaaagggcgacacgtcctgaacttcagaaggctgcacgccctcgcctttaaagggctacgcgtcctcactttcagtggactccatatccacaccttaagagaatttaaggtcctctgcccttaa

SEQ ID NO: 61405 - DNA, 177 bp, Glycine max
  Peptide Sequence Number=SeqID_153090
atgagtctagaagaagctcatcaccataggaggccatggataagagcttggaggaagaaggagatgaatgaagggagagggagagaagagcacgaaattttgtgctctaaaagagctatgaaatatgaactcactaatccaagatcaattccaagattctccactaagtgtgcttag

SEQ ID NO: 61406 - DNA, 306 bp, Glycine max
  Peptide Sequence Number=SeqID_153091
atgacaattgaagaatcgattcatgtttcctttgatgagtctaatgctatatctccaagaaaggatattttagatgatattgtagaatctttagaacaaatgcatattcatggagaagattctaaaggaaaaggagaaggaagaaatgaagatcctccagtagaagtcaaagcaaataatgatcttccaagagagtggaaagcttcaagagatcatccccttgacaatattattggtgatatctcaagaagggtaacaactgttggatcgagtggcctcagaataattaagaggggggggggttga

SEQ ID NO: 61407 - DNA, 171 bp, Glycine max
  Peptide Sequence Number=SeqID_153092
atgaccaaatttcgagaagatccaacggttaacgaaggctgggaagcgtttttaccgaggcagcatcatgtagctttctctagaagcttcattaagaggctttctccaaaagcttcctccagaagcttcctcgtggcttctttgagaagctttctcaagaggcttctttga

SEQ ID NO: 61408 - DNA, 324 bp, Glycine max
  Peptide Sequence Number=SeqID_153093
atggcaaaacaagaaaacttcatctgccgtaaaaaaaaaacattatccgctagagagagtttttttaaaaaaattgctcaatgtcggctgaaaaatatcagtcggggctatttcacgaccgatgtcggtgatgaggacatgaccaagagcaagggcaaggatccacttgaagggcttggaggacctatgacaagggctagagcaaggaaagccaaggaagctcttcaacaagtgttttccatactatttgaatacaagcccaagtttcaaggagaaaagtccaaggttgtgagttgtatcatggcccaaatggaggaggactaa

SEQ ID NO: 61409 - DNA, 366 bp, Glycine max
  Peptide Sequence Number=SeqID_153094
atgaaaataaaagagaaaaaagggaggtggttgccgcccagtttgcccaggcgagctgggttgcttccactagaaggcactgccttctgttggaacctccgggaaggcccaaaactttatggattacgtaacgacacccattttctttctggaatattgcgaaactttacggattacgcaacaatgcccttttcacttccagaatgttgcggaactttacggattgcgcaacaatgcttcctttcgaaatccgaaatgttgcggaacttcacggattacctaacgatgggtgttaagtacctcaaggcaatcaagcgaaggttgcatgccaccaaacaatggtccccggacgaaattagggtatga

SEQ ID NO: 61410 - DNA, 317 bp, Glycine max
  Peptide Sequence Number=SeqID_153095
gatcatatctgctgtcagttagtaattctttcaaggcgtctaaactcatgatcaacgagcttgtgctggaaattcaagactttagagagagaaaatctaatgtcagtttcttcaaacaggaaattgtttgtgttactgtcgccaagattacaactatagtgatggacaactattcatggtgttatccagcgtgcggtcaatgttacaaaaaaaatgacatagaaatagtgtcgttcacatgtccgtgtggcaaagagaacgatcaacctgtactaaggtatagagttgaagtgatggttaatcacaagggtgaatag

SEQ ID NO: 61411 - DNA, 1302 bp, Glycine max
  Peptide Sequence Number=SeqID_153096
atggcatctaggaagagaaaggcccatgcctcaacatcccaggcccgctatgatagatccagattcacatctcaggaggcctgggatcgttattctagtgttgtcattggcaggaaaatattacctgaaagaaatgtcatgctctattacacagagtttgatgaattcactgaagagttagagagaagaaacaggcacaaggagttaacaaattttatggatggcaacattgatgttgccattatgaaggagttctatgctaacctctatgacccagaggataaatcacctaagcaggtgaggttcagaggtcatttagtgaaatttgatgcagatgctctgaacactttttttatgacccctgtgatcatagaggagggggaaaacctgcctgcttactctaggtttagtcagctgaggccaaatccacaagaactggcagcccgattatgcatcccagggaagggatttgagcttaatgttgatggtaatgctgatgggctgcccctgaagattctgaggaagaatctgaccactcttgctcagacctggagtgttctctcattctccaacctggtccctacttctcacacatcagacattacactggacaaggccaggttgatttacggcattatccagaagatggacacgaacttgggacatatcatctcatgtgagatttccttgattgcacaacataactcctctaggctaggtttccctacacttatcactgatttgtgcaaggctagaggagtcacttctgactcattgacttttgagagcctcagtccagccattaatgtggcatatgtgaagaaaaattgctggaacctcgatgatcttgctgttactttcaaaggaccatgcaaagccaaggggaagatgtctgaggctccttcatcttctgatattcctcttattctagctctttccacctctacatctccattagttccagctcctcctacaggaccatcctctatcacatcaaagacattatttgctatgctgcaaagccttcataaaggccaggcctccgcaacccaagagccagagccagtagaggatgatgttcctcctgagtcgtttatcatcgagactgatccagtacctcgggaggaagtagcagctcaggagccttcttctccaattcctgtctctccagctccagttattgatgattctcatccatctgcactagcattggagccagagcagcctattgttcaggatccaccagctgctccggtgttggatcttaatgagcatgcagaggatcacccacaggaggattga

SEQ ID NO: 61412 - DNA, 285 bp, Glycine max
  Peptide Sequence Number=SeqID_153097
atggaaggatattcagcttctgacagtaggacaaagaagaaagtatttcagactgtcagcgagcggtggagacaattaaaatatgatttgacgaggaaatgggatgtgcggaaaaaggcacaggccatccagaagcaaaacaccgccccccacgtattgtctagtgggggttatgaatatttagaacagaagctgatggttgagaagacaaagaaaaaactggaggaagctgctcaatccggaagcactgagggcgtgaatgacccttcatctcccatcagatga

SEQ ID NO: 61413 - DNA, 671 bp, Glycine max
  Peptide Sequence Number=SeqID_153098
gatctggcgatgatagaagtgtcagttgatgccattgcatctctcactcaatacgatgaccaatcgctcagatgcttcagttttggggactttcagttagcaccaaccatagaggagttcgaagggatcttaggatgcccgataggaggaaggaagccatacctcttttctgggtactatccttctatggcgagaatagtaggagtggagaaggcaaaaactctagcaagccaaggagagtgggtatcatttatcgacgtattagcactactagtgtttgggacagttctatttccaaatctagacgggctggtggatctagcagcgatcaacacttttcttgcttatcaccacagcaaggaaagctcggtcattgctgttttagcagaagcatatgatacattcgacttaagatgcgagaagagcaatgcgagaattgtctgttgtagatctgtctgtctccaacaaggtcatcacatgtgctcgggaaaggacaaagcaaattgggaagaactcttggcaggcatgataggagcgtccgttagttggttcccacggtggaaaggagggacagttaggataccctatgagaggtgcaccatcagaggaaccatcacgcctttcatcgcacaagggttcatgaagctaatacaaagatacttcagaggatc

SEQ ID NO: 61414 - DNA, 633 bp, Glycine max
  Peptide Sequence Number=SeqID_153099
atggataatgaagagggcgtgcaggaacagatgaaggccgatctatcagccctaaaagatcaaatggcttccatctcagaggtcatgttaaaactccagaaaactatagaggataaagccacggcaaccgcctccagtacagttagggaagcggagccggtgctgcaacccgccttaaatccgggccgagacagaaacacagcagtgtttggtcgaaggtatagcctgcaagcttatccttatggcttgcctctagacttcactccccgtgccaccccagaagatttaagccaagcccctactttcgaggggcagctccaaccttatgacgactatcccgggcaagacgatgaggaaggagatacccatctcggtcctctgctccacctcaaagatccgtccccccatgaactaccccaaccgaacatagtccgccatatcccagcttcacctacacccgtaaaagaatctgttcccgtcacggaagataggggaaagattgaggcgcttgaagagaggttaagagcagtcgagggccttgacaattacccattctcggatttggcggatttatgtctcgtgcccaacatcgtcatccctcccaagttcaaagtaccggactttgataagtaa

SEQ ID NO: 61415 - DNA, 537 bp, Glycine max
  Peptide Sequence Number=SeqID_153100
atgtccaaatcttgtggatttgggatgactggccctctcgatgagttgatctcttgctttctcataagggtggacccttggctacttgtacctatcacgtttagaggactacacgtcctcaccatcagagggctgcacgccctcacctccagaggactacatgtcctcgccttgagagggctacacgccctcaccttgggtactagttaccctcactgtcagagggctacacgtcctcgccttgagaggactacacgtcctcaccatcagagggctgcacgccctcaccatcagagggctgcacgccctcaccttgagaggactacatgtcctcgccttgagagggctacacgccctcaccttggagggctgcacgccctcacctccagaggactacatgtcctcgccttgagagggctacacgccctcaccttgggtactagttaccctcaccatcagagggctgcacgccctcactttcaaaggactacatgtcctcgccttgagagggctacacgccctcaccttgggtactag

SEQ ID NO: 61416 - DNA, 201 bp, Glycine max
  Peptide Sequence Number=SeqID_153101
atgatgggagatagggagaagcaaataagggctgctgaggaaagattactggaggatgatgtccctataactgctgatgagtttgaaaagatgattagaagctctcctaatagcagtttcacctggataaaatatatggatttcatggtttctatggctgctgttgagaaagcccgctcaattgccgaaaggtatatctaa

SEQ ID NO: 61417 - DNA, 687 bp, Glycine max
  Peptide Sequence Number=SeqID_153102
cattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcagagggagtggcaaaggactggctgtattaccttgctccaaggtccatcacgagctgggatgaccttaagagagtattcttagaaaaaaatttccctgcttccaagaccacaaccatcaggaaggatatctcaggactcaataatatggagagaagtatgatagatgctgccagtggtggagcccttggagacatgactcctgctgaagccagaaatttaattgagaagatggcctccaactcccagcagtttagtgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatttgtacttgtcgcaagg

SEQ ID NO: 61418 - DNA, 171 bp, Glycine max
  Peptide Sequence Number=SeqID_153103
atggcccatatggttggttcacacaaatcccacccaatctcacagaacaattcaaatatacctccaaaggaaatggaagtaatgagacttagcatattcaacggattctgtgcacgggagtatgaggatcatcctggagagaaaccttacagttttggttgtttcagataa

SEQ ID NO: 61419 - DNA, 677 bp, Glycine max
  Peptide Sequence Number=SeqID_153104
gtacgcagggctcgtttgtaccccatggtcggcaagacattctgaacactgcgattggccgacctgagcatgggggtcgcgttcgggcagcaggctcaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttgtcaaataaaggatccccagagctactccaaattcagtcggacatacaacaagtagctgcgcgtgtcagcacacagggaagtaatgttgttaccaatgtccaggcttcacaagaacatcatgctgatgccataccattgatgggactgtatgtgcagcttaaggatggtacaacaagctgtaattgttgggtttggtttgtgttttgttcatcgtttagtttctgttttatatgcattaatttttgctttgtttatggttcatttaaggtttttccagcagagatttccagaacctatgcagtgcaggccatagctgaatgggatatccttcagtaa

SEQ ID NO: 61420 - DNA, 432 bp, Glycine max
  Peptide Sequence Number=SeqID_153105
atgaatgtagctaccaccaaagacttggaacaagaaccaaagagggctcgtaaggaagagcacggccagaacaagtttcgagggcctctgtggggcagcaatagcgagcttaagctccgaagggaagagagagaccaatcacgagcacatagcatggtcttgaaagaggagttagctgtttgctcaaggtccaaaagaaacttgtctcagcatttaggcgagacagagaccaacatgttagccatcgtcagcaagtaccaagaagaactaaatctagccacggcccatgagcatagagtggcggacgagtatgcccaagtgtacgcggaaaaggaggctagaggaagggtgatcgactctttacatcaagaggaaacaatgtggatggaccgatttgctcttaccttgaacgggagtcaagaacttccctga

SEQ ID NO: 61421 - DNA, 217 bp, Glycine max
  Peptide Sequence Number=SeqID_153106
aaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatctcgcaaaggtcaaccgttcttcgacgttcttcattcgttcttcatcgttcttcgatcttcaacgg

SEQ ID NO: 61422 - DNA, 335 bp, Glycine max
  Peptide Sequence Number=SeqID_153107
atatcattagggaaaaatttgatgaaccagctccaagttggttgaaggtgtcagttgaccttcgcgataggtggtttggagagtttaagaaagagtataggtggcacccacaagaagagcaagccattagagctgtttttgagacaaaagatttcctaaacaagagctccactgccaaggcgaatcgatctgttgatagaggagcctcaacatactgtggtggttccatatctactgcagctcactttgaaaagctggtaattttacttcatatatatgtattcaaaggagttttaaagaccaccaactgcttgggagatgatggagaaaactaa

SEQ ID NO: 61423 - DNA, 336 bp, Glycine max
  Peptide Sequence Number=SeqID_153108
atgtggcttgaagagtttatgagggatccacgactgtccacaacattcctttgggcaatgatcaactcaaggttggtgttgaggaagtttgagatggtagctgagggaccagcgaaacctgtagatatgtcggatcctgacatcgatccgttgtacctaatgacattgatcatcccgcagcttttcctaaagtcgttgcaggtgtcgtgggacgctagcgtgtttggggtgtataatgataacttcccattgtacataaaacatgaagatctttctaaaatagttcacggtggtgaatgtctgagcatctctgttatacaattgtggattctgtaa

SEQ ID NO: 61424 - DNA, 585 bp, Glycine max
  Peptide Sequence Number=SeqID_153109
atggccacaatagtagaggccatgatgagcataaaggagatagtggaggttagtgcggcttaccaaacccgtgctagagctagagtaatgggtgaagtagagaaggtgcaagagcagatgaaggcagacatggaggccatgaaagagaaaatggccaaaatgatggaggccataataagcatgaaaaagataaaggaagtcgatatggttgcagttgccactaccaacgttgttgctaaggtgaacccgatgcccccatctggcctcaaccaaatgaatcatccaacctcaaatatggtagctgacttcgagccttggctcggatatgccactgaagggcaagtagttggtggtataccctttgaaaacactttggagagccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgccggactttga

SEQ ID NO: 61425 - DNA, 480 bp, Glycine max
  Peptide Sequence Number=SeqID_153110
atgggtgatcaagaggagacacaggaacagatgaaagccgacatgtcggctctgaaagaacaaatggcttccatgatggaggccatgttaggaatgaggcaactcatggagaaaaacatggtcaccgctgctgccgttagttcggttgccgaagcagacccaactctcctagctactgcgcaccatcctcccccaaatacggtaggacgaggaaggagcatactggggcacaacagtaacccccatttgggatacaaccgggtggcttacccttatggatttccacctaattacacgccgccagtcatgcaagatgatgcgggtcatgtctcttctcccatccttgaaggggagcctcctcgacagcctgacgaggtccacaaagatcatcaagagtatgcccaaggggatgtcgagttctaccccccgatccccgtcaaggggccgtcacccaacactttgcctctacccaacctcgca

SEQ ID NO: 61426 - DNA, 327 bp, Glycine max
  Peptide Sequence Number=SeqID_153111
cgttatgacccggcgcaatggaatatctacgccgcgcaagcgtcggacggcgacaactgggctgacgactcaccgctgtgccatgagctgttggcgaagaagatcctgccgatggtgcgttattacagctacatagaaatcactcgccgcgctcaccaaacgctgtggcgcgaatatgaggatctgcaggcaagattcgataacttcgccatgcagcatatccgcgaaccggacgatatctatccggttattcctaaacattcgcctctgtgcccacacggcttgataggaatattcccattcagttatcgttaccccgtcgcttaa

SEQ ID NO: 61427 - DNA, 993 bp, Glycine max
  Peptide Sequence Number=SeqID_153112
atcgagcaggcgcgtttccagtcgcgcctgcaggtgtcgctctccgttccggacgagctggcgtatcagcatctcccggcgtttaccctgcagccaatcgtggaaaacgccattaaacacggtacgtctcagcttttgggtacagggcagataaccattgccgccagccggttcaatcaccatctggtgctggacattgaagataatgccgggctatatcagccttccgcctccggcggtttagggatgagcctggtggataaacgcctgcgcgcccattttggcgatgactgcggcattaccgtcgcctgcgagcctgaccgatttacccgtattaccgagcagccggatatagagattgtgggagagtgtgctaacgccattgaggccatcggcgcggtacacaaactgcgcccggacgtgctgttcctcgatattcagatgccccgcatcagcgggctggagatggtcggcatgctcgacccggagcatcgtccctacatcgtgtttctgacggcgttcgatgaatatgccgtcaaagcctttgaggagcacgcgtttgattatctgctcaagccaattgaagagaagcgtctggaaaaaacgctcacccgtttacgccaggagcgcaccgcgcaggatgtcaccgtgctgccggaaaaccagcagccgctgaagtttatcccctgtaccggacacagccggatttatcttttgcagatggatgatgtggcgtttgtcagcagccgcctgagcggcgtatttgtcaccagcgcagaagggaacgaaggctttaccgaactgacgctgcgcacgttggagagccgcacgccgctgatccgctgccatcgtcagtatctggtcaatatggcgcacctgaaagagatccggctggaagataacggacaggccgagctggtcctgcgcgccgggcaaaccgttccggtcagccgccgctacctgaagagtttgaaagaggcgattgggctgtaa

SEQ ID NO: 61428 - DNA, 286 bp, Glycine max
  Peptide Sequence Number=SeqID_153113
gtcccttcgctcaaagcttagagtcttccttgtctatgctatagagcctgcatcagggccaactcttgatcatgcagagtttgcaggatgtggtccagcaacggccagttatgagcgtggaggagtttctacagaagagccttccactggagtgctggacatgtcttcttctcagcctgagtcatctgcaccaatgccagacctgccccttcctcaggattcaccatcaggcactcctgcactggacctgaatgagtatgccatggactctgcacaggatcattga

SEQ ID NO: 61429 - DNA, 264 bp, Glycine max
  Peptide Sequence Number=SeqID_153114
tggatgtaccctccacttgaactgatccacaagagatgtaccctctcttattctcagtataacaacccaagtagatgtaccctctacttgtaccacaaaggatgtaccctccaatgtgttaaggcaaaggattctcaggcggttagtcctttgaatctatgtaaagggaaacaaaagatatctcaggtgggagacacaaaagaactcaggcggttagtccttcgattcttttggcaaaaggaagaagtgaatgaagaagagtag

SEQ ID NO: 61430 - DNA, 437 bp, Glycine max
  misc_feature (76)..(76): n is a, c, g, or t
  Peptide Sequence Number=SeqID_153115
accaagtttggtcattcggcacccatgatactcggagataccttacggttatccgcacccttttgtcatccagagncggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccttgtatcatccagaggcggcgggcccgatgatacgcggaaatacccgagtggttatccgtataaacattctcttgctatctgtaagacagaacgcttga

SEQ ID NO: 61431 - DNA, 237 bp, Glycine max
  Peptide Sequence Number=SeqID_153116
atgtcagtgaaacacctcattgagcgcctaagagtacatgacaagacaaaccacatactagaagaccagccagggtcacgatgttttgcgagaatgctccaaccatgtggaatcggcacaagcttaaagaagtgctcaaaccaggtgtatttacccccaaggcctacactccgaagggtctgtcaaggcctctccctcctgattcaggtccaacccagaaaacattttagcacatag

SEQ ID NO: 61432 - DNA, 219 bp, Glycine max
  Peptide Sequence Number=SeqID_153117
atggaggctttggtggaagactatgaagatggaaatgggaaaaatgaatcaaggcaatttattgatggcctaaaaagaaaatatgacattgctcttgtgtttttggaaggagagaacgttaaggcattgggacctttgagcgatctcttggggtcgacaaaagtggggatttcactcctacgtatcctcaactgtgatgaggaaatcagacctacgtag

SEQ ID NO: 61433 - DNA, 189 bp, Glycine max
  Peptide Sequence Number=SeqID_153118
atggataagagcttgagggcaggagaagatgagtggagggagaaggaaagaaggagcacgaaattttgtgcctcaaaagagcctatggacccgaaatctaccctaaggctcatgagaaccctagggccttctcttgcatctctggcccaatcttcttggagtcttctatccaatgcccttgcggggtag

SEQ ID NO: 61434 - DNA, 371 bp, Glycine max
  Peptide Sequence Number=SeqID_153119
tgtagtttacaaaagcaaaggtgaaacaaaagatattgagctggtagaggatgctgattcttctagtgagacctctaataaatctgagaattataaggaggaagcacggaatgcaacacaaaagcataaaccaaagagggtagagagtgtcaatgctgatgtagaagcctttggtgatgactggaaaacaggagattcaattgtgttgaagataggagattcgactaaagttgtgataaaacaagacatgaagggaataaggcataaatatgggtttaacaacaataaatgtgagaaggcagagaaggtaagggtggtggatgatgaaactggcgacaaacatcagctggatgaagtcctaaggatgccat

SEQ ID NO: 61435 - DNA, 540 bp, Glycine max
  Peptide Sequence Number=SeqID_153120
atgaccaccttgacccagacgtggatgacattgctgctcaacaatgtcttgcctagcgatcataactacgatctccctctgccgaagtgccagttggtgtatgccatcctgacacggatgagcgtccacgtagcccaggtgattgctgatgccatctatttgtttgtaggtatgccacccaccaggcaccctctagacccagataagtctaacagggccttaggatttccggcattgatcacaggcctctgccagtcgttcggaattcttgtcacccctactaaggcatggagtgttatctatagcacttggttcgctagcaggcggccaaccatcgggggcaggtgcagatacatgagtgtctctaccggttcagcctcagtcagcatgggcagggtttcgctccttttgcatgcaatactccagagccgtttggggctgaggtctcatgggccggagattggcctgaggcccaggcaggggagtagcccgcaggatcccccggtgcggcagaggaagcctgtatggatgaagaaatga

SEQ ID NO: 61436 - DNA, 767 bp, Glycine max
  Peptide Sequence Number=SeqID_153121
gcgattcctacaccattggtgaagcggtcgcggtcgacggtcgctggccgcatcagctcggcgcgccgctgtacgacgcgcgtgctgcagcatctgcctgacgcagacgggcagccggtgctggacctcggctgcgggttgggcctgttcgcccatgtactgcgccagcgcggcggcacccaacgctacctgggcgtggatgtggatgcgggcaagatcgcccgcgcgcaacgtgctgccgtcgaactgcatgacgtgcgcttcgactgcgtggatgtgcaggcgccgctaccggcgcagtgccgggcacgtcctgctgctggacgtgctgcagtacctggacgcgggcccgcagcaggcactgctgcgcgcggccagtgcgcgggtggctcccggtggctgcctgctgctgcgcacgccgctggccaccggcgatggccgcgaccgcaccacgcgggtggcggaccggctggcctggctggtcggctggatgggcacgcggccgcgccactaccccgatccagaggtgctgcaacgacgcttgccaagcgggattgcagcgtgaccgccccccggccgctgcatgggcgtacgccgttcaacagctggactgctggtggcacgccggaacctgtagcgcccctgccctgtactcccctgacgtccccgcaggcgcgcttgatcgccgaagcgttccgcccggcgcaggcctggggcagccggcgcgactactactacacccgtagcaagctcggcagcgatccgct

SEQ ID NO: 61437 - DNA, 859 bp, Glycine max
  Peptide Sequence Number=SeqID_153122
gactaaacgtcctcgccttgagaggactacaggtcctcaccatcagaggcctgcacgccctcacctccagaggactacacgtcctcgccttgagaggactacatgtcctcaccatcagagggctgcacgccctcacctccagaggactacacgtcctcgccttgagagggctactcgcccttgccttggggctacacgccctcacctttagaggaccacacgtcctcaccttcagagggctacacgccctcgccatcagaggactgcatgtcctcaccttcgtagggctacacgccctcacctttagaggactacacgtcctcgccaacagagggctacacgccttcacctttagaggactacacgtcctcgccaacagagggctgcacgccctcaccttgagaggactacacgccctcacctccagaggactatacatcttcgccttgagagggttgcacgccctcacctttagagggctacgtgtcctcattttcagttttccttttaacggttcctgggccacccctgatattggaggacggccaactgtgcgagcacaaccagagagggaggctatcacacagctactatgcataccggggcaagatttcacccgtgccgctgcaaagagacgagtgcggatcatgcgcaccaacatgaccactcttacacagatggatcgcacccacaaagacaccccagtggacccgaaaaagtcaaaacagggccctagggtttccagctctggttacgggcctctatcagtcctacagggtgcccggatcgcacctgcaagacacccagtggacccgaagaagtccaacagggtcttggagttgtcaagctctaattacgg

SEQ ID NO: 61438 - DNA, 837 bp, Glycine max
  Peptide Sequence Number=SeqID_153123
atgctggcatattttgttgccatcagcttcgatttgaaccgaccgtcctgggcagtcgcaaccgtctatattgtcgctcatcccctctccggtgcgatatcgtcgaaatcggtatatcggcttctgggcacggtcatcggcggcggtgcgacgatcctcatggtcccgaacctggtgaacgaaccgatattgctttccggcgtgatcatcgtatgggtctccgggtgtacctttgtcagtcttcttgatcgcacaccacgcagttatgttttcctgttagccggctataccgttcttctcgcaggactgccgctcgtcaacgccccggcaaacaccttcgatattgtcgtttcccgcaccgaagagatcgggctcgcgatcatatgcgcgtcgattgtcagtcacgttgtttttccggttcacgtggggacagcgcttctcaaccggatcgatggatggatggccagggcgcagaagcttttcgaagtcacagcaaccggcaaaatggacgaaacccaaaatcggatggaacgccacgccctggcgggggaggcggccgatctgcggtcgttcgcggtgcatcttcagtatgacggatccagataccgaagcagagtggcgctggtgaagtcgctgcagcaccggatggtttctttcctgcccctactgagcgaacttgaggatttgcgacgatcgctggggaggttggaccctgccggccggtacaaggcattggcgatagtcgcggaggcggattcgcgtccgggaggctccttctccacgatcggtgcgctggccttccccggctcgctgccgacatgggaaaaactcctcctt

SEQ ID NO: 61439 - DNA, 270 bp, Glycine max
  Peptide Sequence Number=SeqID_153124
atgcaaagaagatctgctgcagttgatttgattcccattgatttggagattaatgccatctgtagaaagcgtaattcagagagaatcagaaattttttgcaagatttagaagcagcagcaacttcagaagaagaacctcgatcttctgaggcatcttctagttttcctgttgcaaggcattctcatatagaacctattgaagatacaatcatggctgaagagccaagaagagtaaccttggaggattactcaagttctaatgtgccataa

SEQ ID NO: 61440 - DNA, 696 bp, Glycine max
  Peptide Sequence Number=SeqID_153125
atgaattcattgcctagcgctgttcatgtgtcctccaccttcgagtctggagtcccgcgaattgatcgcctagcgctgttcgccaattctccattctccacttttattcggagccccatcaattcattgtctagcactgttcatgcatcctccaccatcgagtctggagtcccgcgaattgattgcctagcgctgttcgccaattctccattctccacttttattaggagccccatgaattcattgcctagcgctgttcatgtgtcctccaccttcgagtctagagccccgcgaatttattgcctagcactagtcgccaattctccattctccacttttattcggaggcccatcaattcattgtctagcgctgttcatgcatcctccaccatcgagtctggagtcccgcgaattgattgcctagcgctgttcgccaattctccattctccacttttattcgcagccccatgaattcattgcctagcgcttttcatgcgtactccaccaacgagtctggagccgcgcgaattgattgcctagcgctattcgcaaattctccattctccacttttatgcggagccccatgaattcattgcttcatgtgtcctccaccttcgagtctggagtcccgcgaattgattgcctagcgctgttcgccagttcttcattctccacttttattcggagcctctag

SEQ ID NO: 61441 - DNA, 262 bp, Glycine max
  Peptide Sequence Number=SeqID_153126
gcacaacagaaggaagtttcggaatgagaatgttagtaacttccgaaagaaggtcttctggaagttactaaggcctattccggaagaagtcattccagaaaacacttccggaagaccttcttccggaatgggccttagtaacttccggaagcacttcttccgaaagttactaaagtccattccggaagaaggtcttttggaagtgttttccggaatcacttcttccggaatggaccttagtaacttccgaaagaaggtgtag

SEQ ID NO: 61442 - DNA, 339 bp, Glycine max
  Peptide Sequence Number=SeqID_153127
atgtcaggatttacacacgattctcctcaaatttcagccagcccatatcaattagaccttgcaccttacgcttcagagcccaacaatgctcaatggaacgccccggggcttctccgtgacaagcacacgttgcgttcgagtcgtattctcggagaaatggaggttgatgaaccttggttggggttatggctaccattgaattatcaagtagacatgggagcaaactttgtggttgatttagggatggcctttgtggataactgggcggtgggtaaggagaaggtttgttattggctgagtaatgacattgttgggttggtgggaaacttggctgtatag

SEQ ID NO: 61443 - DNA, 237 bp, Glycine max
  Peptide Sequence Number=SeqID_153128
atggaaggagagggtacatttcttgtggatcagttcaagtggagggtacatccacttggtttatcaaagagaacaagggagggtacatcccttttggatctttgtcttgtaaaggattttacaaggttgaaaaaaatctcaagaactgcaggttgcttggggactggatgtaggcccggtttgtggctgaaccagtataaatcttgtggttgtcttcctcttccctacactctttaa

SEQ ID NO: 61444 - DNA, 387 bp, Glycine max
  Peptide Sequence Number=SeqID_153129
ataaggtctaacaaggccctggggtttccagcattgatcacgggtctctgccagtcattcggggttcccgtcacacctagtaaggtgattcgaccaccgatcacccgggccttcattgagaaatattgcacgcctagacaggcgcagggtgatgcaccgcaggccgcagacgcaccaccaccacctcatcaggctgatctagttgggtcatttggcattggagcggtatttacagcactcggtttgccagcaggcggccaaccacagggggcagatcagttcagggctgaggttgcatggcccggagattggcctgaggcccaggcaagggaggcgcccgcagggctcccggcgatgcagaggaggcccgcatggatgaggagatga

SEQ ID NO: 61445 - DNA, 162 bp, Glycine max
  Peptide Sequence Number=SeqID_153130
atgtttgctaaatttctcattttcttctgcaatgcttcaatttttagaatagttgtacgtcttccatggtggcaacgacgaatgattctaccagaaaatgtagaagaactgtcacttgcagacatggagaaatcaaagcccactaggaaaaagatgaagtga

SEQ ID NO: 61446 - DNA, 560 bp, Glycine max
  Peptide Sequence Number=SeqID_153131
atggctccgagaaagcttttcgccaagagatctaggaaggacgccgcggctgaagggacctgtgccgctcccgagtttgacagacatcgttttaggagcagtgagcaccagcagtgtttcgaggccatcaagggatggtcattccaccgagagagacgcgtccagctcagggacgatgagtacacagatttccaggaagagatagctcaccggcgttggacgtcgctggtcactcccatggcaaagtttgacccagatgtagtcctagagttttacgccaatgcttggcccacgaaggagggagtgcgggacatgcgatcatgggtaaggggccagtggaatccttttgatgcagacgccctcagccagtttttgggagacccgctagtgttagaggagggccagaagtgcgagtttagtcagagaaggaaccgggccgatggatttgacgaggaggccattgcccagctgttatgcattccgggtcaggattttgcccagaccgctgccgggagacgggtgcggatcatgcgcaccatcatagccagcgtgactcagat

SEQ ID NO: 61447 - DNA, 162 bp, Glycine max
  Peptide Sequence Number=SeqID_153132
atgaccagcgtggttggtgacacaaaagaagttgaggatgattttttagtggacaactctggtagagccagcctagatcctttatctgtacttcgacctcctctcagggaggctcctgatgccttaggaggcattaccgcttttctgattccaatgttttga

SEQ ID NO: 61448 - DNA, 768 bp, Glycine max
  Peptide Sequence Number=SeqID_153133
atgccctcacctttagaggactacacgtccctcgccttcagggaggactacataggtctacacgccctcaccttgagaggactacacgtcctcgccatcaggggactacgcgtcctcgccttcaaaagggctccaagccctcaccttcaaagggctaaatttccctcgcccttcagagggctacacgccctcgccttcaaaggacctacacatcctcacccttcagaggactacacgacctcgcctttcagaggactacacgtcctcgccttcagagggctacacgccctcaccttgagaggactacacgcccctcaacttcagagaactacaccctttagaggactacacatcctcgccttcagagggctacacgccctcacttttagaggacaacacgtcgtcgccttcaggggactacacgtcctcaccttcaggggactacacgtcctcccctccaggggactacaggtcctgaccttcagaggactacacgtcctcgcctttagagggctacacgccctcacctttaggggactacacgtcctcgcctttaggggactatacgtcctcaccttcaaaggactacacgtcctccccttccaggggactacacgtcctcacctttcagaggactacatgccctcacctttagaggactacatgtcctcgccttcagaggactacacgtcctcgccttcaggggactacacgtcctcaccttcagaggactacacgtcctcgccttcaaagggctacacaccctga

SEQ ID NO: 61449 - DNA, 324 bp, Glycine max
  Peptide Sequence Number=SeqID_153134
atgcacacacaaagtttcacaattccacaattccttaaaataggcctaactcacaaaaagttcccagtggagtcgccaactgtcgcaacatgcccttttgcgggcgtgcgaggcgaggctcacgggtgcgctttccaaaggaggaaagatgcatggagtcaccaccaacgtttatttgtggaaaacatcggaaaaaaccgaaggaaaccggtcaaaaagaaaattccaagttcgagagttgtatttacgcttgaggaaggtcgacaaaagcagggctcttgctcctacgtaccctccatcgaagaggaaatcagacctacgtag

SEQ ID NO: 61450 - DNA, 372 bp, Glycine max
  Peptide Sequence Number=SeqID_153135
atggtaggtcagggtggagaagtgttgagaagtatgggcggcccctgtatggtgcaaagtaagaattctttcccattgtacggcttgccacctaactatacaccacccaatgcgatgcatgtgcctagcaaaaatgccagtcacttcgttcccattctccttgaaggccagcaaccccaattagggcatgcaccctttgctcaacctatgggagaagcccgcgaaaagccccgagatcacgctctaggcaagttcgagtcgtaccctacatatgccgctaagggaccagcctttggtggcatgcctcagcccaatgccatgggagccccacaacactgctcgctacaacccctacatttctcagtgggatga

SEQ ID NO: 61451 - DNA, 1176 bp, Glycine max
  Peptide Sequence Number=SeqID_153136
atggatcgtcaacggacagcgcttaaagatttacaatggaggacaactagagaagttgatgaccatcatgcatttaaaggatccttgaaagaagccctatgtctagctaaagacattaaactaagcgctggttgggaggcaacccgacatacttatgtaagaaaaaggggcccaaacaggtgcaaacaacaaacagggggtatgaaaagcaaaggcccaacaggtgaaggtagcaacaggaggggtaccaatagcaaattgaagtgggcagcacgaagtcacgcgcttagcgtgcgacctcgcgctaagcgcccagaagagcgcgctaagccagcgagaataacagcagaagaacaaggcacacgcttagccagcacctccgcgctaagcgcgctcatgaacctcagtgagcgcgctaagcgcgtgccacagacgctaagcgcgtgcatccgccagcaggcaggggcgctaagcgcagggttgggccttaggatggcctcccgcaaacgccgagccgtgcccacacctggggaagcgtccaactgggactcttcccgtttcacttccgagattgcttggcacaggtaccaggataacattcagcttcggaacatccttctggagaggaatgttgagcttggaccagggatgttcgatgagttcctccaggaacttaggcggcgcagatgggaccaggtgcttacacgacttctgaagaagaggatcgatgtggctctggtcgttcgctttgatgatgacacgattaacgacttcctcgacaccccggtcatcttagaggacggagaggagtacccagcctacaccagatatctcagcactcatcccgatcctgatgccatcgccgccacattatgtactccaggggggggcacgcttgatctacggcttagtgagaaggatggatatggacgtgggcaactttatatctcagcagatcagttagattgcccagtccagtacctcgaggcttggggggtggtttctgataccctgatctttgagtcactcagccctgcaatcaaccttgcgtacgtgaagaagaactgctggaacctcgccgatccttccattacatttccaggggcccaccagactcgcaccagagcaccagcgtccatatctgaggcaccccctacttctcagccttcctcctag

SEQ ID NO: 61452 - DNA, 558 bp, Glycine max
  Peptide Sequence Number=SeqID_153137
atggcgcctcctctcacctcttctcctttgtcttccgctgcatctccatggtgcgagaagaacagtgcacggattgtctgctgcttacctactctctgtgtgtggttggtttcgcacctattccaacaagacataagacactcgtgtccgcttcaaagttatcgctcgtgcgttgaaaagagaagagtcgattggaaccaacacttggctgggataggaggcaacacaatcaattggtttcctcgatggaaggaaggaaaggagggagttcttttctcatgtggggactaccctaacgttccgttgatggggacgaggggttgtattaactataatcccgcacttgccataagacagctagggtaccccatgaggggagcgccaatggaagagagcctctcgcctttccttgtgagagattttggcgcgcaaagtctcaaggttgtacaaaaagtccacaaggcatggagaagtccgttgaggaaagataaagaacttaggggcattcgtaatggcgtcatcggtggttatcatgaatggctaagagttcatacgtga

SEQ ID NO: 61453 - DNA, 450 bp, Glycine max
  Peptide Sequence Number=SeqID_153138
atggcaccagccgatgtagaggacactggggcagacattcctacagacacaggcgcgcaggctgctgaggatgagcatgagggatttccgggtggtccgagtgacctatccatgctgactcagtatgcgaatcacgttgcttgcagcatatggacaggaaaggagcgtcctgagttgaagttatcctctcacgggaggaaggtccatagtttaggcaggtctgtccctgccattgagggactagttgttgggacaggactaagtcctctgatcgtgtgttcggtagacaccggcgattggggactgttgtcctcgtttgtcgagcggtggcaccgggagacgtctaatttccatctccctgtgggagagctcacgatcacactggtctctacagaggctgccagagctgagacagggcagtgtcgtgggccgtacgtacgcctgcaatga

SEQ ID NO: 61454 - DNA, 395 bp, Glycine max
  Peptide Sequence Number=SeqID_153139
atggaaaggagttcaaccttgtccctcacttccatattaagccccctaaggaatctagctatgcttgttctttcctcctccctaagtctagctcttaaaaggagtagttctatttttttgtctctattcttcaacactcatactcccttgtctaagcctttggagcttgtccataagctccctttcatagtaggagggaatgtgcctcttcctaagggcacttttaagatcattccaatactctactggaggatccccatgaatccttcattccctaacaagggaagtccaccaatagagggcatacccttgaaacctaagggtagccaatggaacttttctctctttgctaatatgatggcaaggaaagagttgttcaaccttcatttcccact

SEQ ID NO: 61455 - DNA, 603 bp, Glycine max
  Peptide Sequence Number=SeqID_153140
atggcatttttaggagaaactagcagtcagacgattgtcaactcaaggttggctttcatttttccaaatggatcgattattcacaatgatactggggtttacttccaaacttcaactccggtgcccattcgagtaccaaatagctgtgattttgcaagcctaaaaaccagaatacacaatacccttcagctatccaacaaacaatttttggatgaaattcactaccggaagccattcaccgatacagatggaataataaacttacttgaacgcactatggctcgtactcatgacgcgatcctgtattacaacgggaaatggaacatgtcaccgcagaacaaatttgttggatgcgcattcacaggaaaaaatcctaagaaatttcaaattccttcaacatgtaccatcgatgaactgaagaatttaatcaagcaagttgcacctaaagggattccccatcttggaattcatgaatcacaaacggtaagacgattgtttttctgccaaccagctcactttgagtattcagatacggttataaaatatgaaataaatgagctgatcaccaatgaagaactgctgaaaggtgttagtacaatctaa

SEQ ID NO: 61456 - DNA, 348 bp, Glycine max
  Peptide Sequence Number=SeqID_153141
atggcggcgcagctaatccgtgatcgagtagagatggagtgcctagagggagcttgggagaccctcgaaggcaacacgaggtgccgatttcggggcactattcgatttacggcgacttctttagtgcatccagatgagcccacacggacgcttcagcgcacggtggagtggatactacccacgcctacaccatatcgtctagtggagcccgtccaagtgatcgagggtgatgaggatccacttcttgaggtggattctcccgaggaagtcatgtcggcatctgaggcagattctatggaggatagtggcccaggggagatggcgatcagcggaggctcttcatcctag

SEQ ID NO: 61457 - DNA, 351 bp, Glycine max
  Peptide Sequence Number=SeqID_153142
atggcacgcagagacaaattatggtcattctgcgcccttttgtcactccaaggcggtgggcccgatgacatgcgagacaaattatggtcattccgcacacctttttgccattcagacacagttgtgtccgatggcacgcagcagacaaattatggtcattctgcgccctttgtcagtgcggtcgacaagcccgttgacacgcggagatttacgtcatcttccgcagctcacaagatctgtcatactgacattatgagtcacgctgacgggcggaaatacccaagtggttattcgtataaacattcttttgctatctgtaagacagaacgcttgatagcatgcagagactga

SEQ ID NO: 61458 - DNA, 616 bp, Glycine max
  Peptide Sequence Number=SeqID_153143
atgacgcgcgcagctgacgtgcgttatcgctttgtaagtaaaagcattgacgctggtggtctgccggaaaccaccgtcaaagaagcccgcgaacgcgtgcgcagcgccattatcaatagcggtttcacctttccggcgaagcgcgtcaccattaatctcgcgccagcagatttacctaaagagggtgggcgctacgacctgccgatcgctatcgccattctcgcggcctcagagcagctgccaggcgataagctggcccattatgagttcctgggtgagttggcgctaaacggcgcgctgtgtggcgttcaggccgcgattcctgctgccatggcggcactgcaggccgggcgtcagatggtcttagcggagcagaatcaacaggatgtcggcctgatacaacagggtgaaacgctggtgggcaagcatctggtggagatctgcgctttcctgcataaccagacggcgctgacggtcgcccactaccagcctgaaacggtgccgcacgagcagcaggacctgagcgatattattggccagcagcagggacggcgcgcgctggaaatcaccgccgccggtggccataacctgttgctgctgggcccgcccggcaccg

SEQ ID NO: 61459 - DNA, 81 bp, Glycine max
  Peptide Sequence Number=SeqID_153144
atggccactcctatgagcactgcttgttatctggataaagatgaaactgatatcaagcaaatcccaatgaatctcacctaa

SEQ ID NO: 61460 - DNA, 228 bp, Glycine max
  Peptide Sequence Number=SeqID_153145
atgtctcgaaagcgttacgaaggcgcctcggctcagattttcttcatggaaacaatttttctcactaattttaaggaaaagaaggagaagcttgccacccagcttgcccaggtgaactcagcttgcccaagcgagctaggttgcttcctccagaaggcaccgctttctaatgaacttcctggaaggcccaagtgggcctggttgctatttgcaccccctgtttactaa

SEQ ID NO: 61461 - DNA, 594 bp, Glycine max
  Peptide Sequence Number=SeqID_153146
atgatgagtttcattaatgttgaatttttgcaagatgtgcggaaaaaggcacatgccatccagaagcaaaacattgccccccacgtgttgtctcatgggggttatgaatatttagaaaagaagctgatggatgagaagacaaagaaaaaactggaggaagcttctcaatccggaagcactgacaccgtgattgatccttcatctcccatcagacaacacgtcaaatggaagatggcccgcatgaagaaaacttgccaaatgacgtctgaggcagcaaaggaaattgctgacaagattgatttgttggaggagcaggcgtcacagggttcctttgtcacccatggacgtcaagatgtattgactgttgccattggccggtgtgacgatcaagcaatactttggacccgctccaaggacctcccgcacgacttcctccatggctctcgaagacctagagcatatgactcaacaaatcagggaccagctggaggagccgatcacagaaaaagtgacttgatagctaatgttatccttcagccaaatgcagtcccagtttcagttacaaatgcaatcacagggggcactacctcttaa

SEQ ID NO: 61462 - DNA, 324 bp, Glycine max
  Peptide Sequence Number=SeqID_153147
atggcaaggtatttgcatggtctcaatagggagatccaagacattgtagagttgcaccactatgcctctttgaaggatctcattcatcaagctatcaaggtggaacaacaagtaaagaggaaacaaacatacaagaaggagagagtatcttcattgaaatctcatgaaaagggtcatattgtctcccaatgtcctaacaaaaggataatggctgtgttggttaatggggttattactagtgcatctttttctggctcttctagttcttctactgagagtgaaagtcaatgtgatgtacaacccttgaaaggttttcttttgatg

SEQ ID NO: 61463 - DNA, 510 bp, Glycine max
  Peptide Sequence Number=SeqID_153148
atggatgccggatggctgactttccaagaggatcggcccaatgtgagaaccaacccgctcgccaatcatggagggggagcagttaatgcagttgaatccgataggccgcacaggtctaaacctttaagggatgtggcaacccctaggaggtttatctttgaggccctacaaaagggagatcaaggtcgactggaagtcggcattgaaggaaaagaagagcagcatatatgcatgcaatctacggaggggagcggtgttgcgaagcccaaacccttggtgatatacttcactaaaagcgcagcttcgcaaaagcccggacaccccttaatggccaaacctgttcctttcccgtaccaaaatagtcacgcggtcccgtggagatatacacctccggggaagaaggaagaagaagtcactgacgtcagctcgctgtcagctaaagtaacaaatatcacgggactgagtggtgtgacccgtagtggtcgtgtgttcgcacctccggacctacca

SEQ ID NO: 61464 - DNA, 73 bp, Glycine max
  Peptide Sequence Number=SeqID_153149
gaatctcgcaaagctttcaatcgttcttcgacgttcttcattcgttcttcatcgttcttcgatcttcaacggg

SEQ ID NO: 61465 - DNA, 192 bp, Glycine max
  Peptide Sequence Number=SeqID_153150
atgaagcacttcactgacaccctcatcagtgccaacatatccatgatgattggatgtggaattacctggatgttgtggaagcttgggaggattgatggggacccgacgttgagaggaacggggataagggctacgtgggagtacgtgagctcagttggaggtgggcaacaggggatggtgggttatacgtga

SEQ ID NO: 61466 - DNA, 258 bp, Glycine max
  Peptide Sequence Number=SeqID_153151
atggatgagcgtccatgcggcctaggtatggcgcctactaggtaccctctggacccagataagtccaacagggccctggggtttccggcgccgatcacgggcctctgccagtcctacagagttcctgtcacccccagtaaggccgcaggcgcactgccaccacctcggcaggccgatccagttgggccactgggagtggagcgctatctacaacattgggttcgccagcaggctgtcaaccaccgtgggcaggtgtag

SEQ ID NO: 61467 - DNA, 375 bp, Glycine max
  Peptide Sequence Number=SeqID_153152
atgacgggagtcatggttttaaatagaggtcaacaacccaaattggggccacatcaatcgcatttttttgcagttgctcgcaatgtaaaggttttctggctgacagcaactgcaaccgcaattttaaaccatgacaggagtctttggtgcaatgttgttgaatcaaatttttgggctttggctgataagtatagcaggttactcacaaattcttgtagaggggccaatgtcgattgggaagctgtgttgtgtgcccgcaagggatccggccttagagcttgggcatggattaatgcgaaagggaaaggaagaaaattctcttattatgaatgggagatgaatcccagggcttgtttgaattgtttactgttatga

SEQ ID NO: 61468 - DNA, 300 bp, Glycine max
  Peptide Sequence Number=SeqID_153153
atgaaagaaatgattagacaggctctaagtgtgtttgatgaaaacaacatgctttgtgatgcaagctccattcgagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaatgagatgaatgaagggagagggagagaagagcacgaaattttgtgctctaaatga

SEQ ID NO: 61469 - DNA, 131 bp, Glycine max
  Peptide Sequence Number=SeqID_153154
gatgctgggggtggaatggtagatgaagcactagctattatggaaatccttgctagccaccatgaaggcagggtagcgatcggtcaggctgatcgaggccgtcacccgaatcaaataaacatgaaaatgca

SEQ ID NO: 61470 - DNA, 342 bp, Glycine max
  Peptide Sequence Number=SeqID_153155
atgtttggaagcaaagcaattgacgcttttctcgcctttcacgaccgtaaggaaatcccgctcatcgctatcttagccgatctgtatgacacattcgaccgaagatgtgagaagaacagtgcaaggattgtttgttgtacactgaccctctacgtatggttggtctcacacctttttcgccaagaggagagacacattttcccgctagaaggtcatcgctcgtgcgccgagaagaaggaggcaaactgggaccgactcttagcaagcaaagaaggagcgtccgtcaattggttccctcgatggaaggaaggaagaaccgacattctcgtctcatgtggatga

SEQ ID NO: 61471 - DNA, 378 bp, Glycine max
  Peptide Sequence Number=SeqID_153156
atgtttggcagtagaggaattgttgcagcgaatgatagatcaaggccgattggaagtcggtatacacctccgagtgaaagggaagaagaagccaccgatgtcagctcattgtcggccaaggtaaccaatatcacggggctgagcggtgtgaccccctgcggtcgcgtgtttgcaccttccgacctgccaacacaacctacaaacattaagggaaaggccaagatggtggaggagcaaaatgacaagacgaccctcactcagaacgaggattttccggtaaagggtcttccggagaaaagggatggctgcggcaagaaggaagtgtcgctagaggaagcaagcgagtttctccgcattattcagcagagcgagttcaag

SEQ ID NO: 61472 - DNA, 186 bp, Glycine max
  Peptide Sequence Number=SeqID_153157
atggcgtctcctctctctcttccttctccattctgctgtcattcatcttccaagaagcaaaggaatccattgatgaagaagatcctatgcctacaagctccaatggagcttacatcacatccccactcctttgagcttgcttgctatggaaggctaaaccctcagttggggattcttgctgagtaa

SEQ ID NO: 61473 - DNA, 402 bp, Glycine max
  misc_feature (301)..(301): n is a, c, g, or t
  Peptide Sequence Number=SeqID_153158
atggggagctgctgccctggtgcatattgttggatatacgagcactttccgtcagttgcggagtgcaatactgattcggaatacgacgacgcttcaccatgtgcatgtcggtggattgctacgaagaagacgatgaatagcatatccacagagacgtacaggcagtgcctggatcgattgaggattctcgatgtctgttggatgccatatggggagcaccgacaagggcccgttgctatcagatacagaccagagagggtcatgcgccaatttggatatgtccagagtattcctgctccgnctgtcgattcatgggtgtcatttgatgagatagacgacagatggatgcactactcagaccatcttgcgctagcaggtgagatgtgtgttatgccaggttag

SEQ ID NO: 61474 - DNA, 886 bp, Glycine max
  Peptide Sequence Number=SeqID_153159
atgatgcttactacatgcaaaggagctacttcatttgaggatattagaacaattgaaaatgttttataccctacatatagagaagcatgcttcgcaatgggttttttgcaagatgacagagaatttgtggaagcaatcaaagaagctaaggactggggcacaactaattatttgagaaaattatttgtcttaatgctattatcaggtgccattactaaacctgcagaactttggaatcagacatggaattggttagctgaagacattgcatatcattataaaaaaacaactctgaacatagaattagagattgatgatgagcaacttaaaaatttaacattactggaaattgaaaaacttctgcatccacaccaaacatcactcaaagactatcctacaatgccatatcctgagggtgcaaatcttgcattgtgtctagagaatagcttgatattatctgaacttaattacaacaatgatgaggctagatcagaattcgaaaatctttttctatctatgacagacgaacaaaaacaaatttatcacaaaattatggaagctgtcaacaacaatgaaggtcgcatgttttttctatatggatatggaggtacaggaaaaacatacatatggagaacattagcaaattcactgaaggcaaaaaatcaaattgtgattatggttgcttctagcggcatagcttctctgttattgccaggaggcaggactgctcattccaaatttaagatacctgtgccaatttttgaagactcaacatgcaacatacttcaaggaagtcaactagcagaattgttaaatcagacaaatctgataatttgggatgaagcacccatggcacacaaattttgcttccaagcacttgatcaat

SEQ ID NO: 61475 - DNA, 417 bp, Glycine max
  misc_feature (408)..(408): n is a, c, g, or t
  Peptide Sequence Number=SeqID_153160
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggatgcgtaaggagaatccgcatcaggcgccattcgccattcaggctgcgcaactgttgggaagggcgatcggtgcgggcctcttcgctattacgccagctggcgaaagggggatgtgctgcaanggcgattaa

SEQ ID NO: 61476 - DNA, 369 bp, Glycine max
  Peptide Sequence Number=SeqID_153161
atgaaggaccaagctccaagtgtgttaggagtaccaccttctaagcaaaaggatgataagggtaaaaacatagaggaaatcaatccaaaggctagttcacaagatagaactagtaatatcaagtgcttcaaatgcattgggaatggccgcattgcttctcaatgccccataaagaaaaccatgatcatgagggatcaagatatctatagtagccaagaggaggctacttcttctccttcctcaagtggaagtgagggtgaagccacgagtgatgagcatattgaagaggtttacccctatgaagaaggtgatcttataatgatgagaaggctcattgggagccaatcttgtgacctaacccaaacctaa

SEQ ID NO: 61477 - DNA, 531 bp, Glycine max
  Peptide Sequence Number=SeqID_153162
atggctccgaaaaagctttccacgaagaggtctaggagagacgccgcggcggaagggtctagtgccacccccgagtttgatagccaccgtttccggagcgccgagcaccagcagtgcttccaggccatcaaaggatggttgttccacagagagaggcgcatccagctcagggaggatgagtatacagattttcaggaggagatagctcgcaggcgttggacgtcgctggtgactcccatggctaagtttgaccctgaggtagtcctgaagttttatgctaatgcttggcccacagaggagggagtgcgagacatgcgttcatgggtgaggggaaggccagtagtgcgagttcagccagaggaggaacagggccgacgggttcgacgaggaggccattgcccagctgttatgcacaccggggcaggatttcgcccggaccgctgcagggaggcgggtgtgtatcatgcgcaccagcatgaccaccttgacccagacgtggataacattgctgctcagcaatgtcctgcctag

SEQ ID NO: 61478 - DNA, 585 bp, Glycine max
  Peptide Sequence Number=SeqID_153163
gcgtcacaaggatcgttcgtcccccatggacgtcaggatgtcctgactattgtcattgggcgaccagagcaccctggccgtgtccgtgctgttggagtcggtgtcaccataaagcaatacttcggatcagctccacgaacatcccgcagttcttcctccatgcctcctgaagacctacaacagctgacccaacaaatcagggaccagcttgaggagtcgatcacagaaaaaggacttgcactgcctccagagccagaggttggtccctcaggtcctcgtgtcagcacaaaggagagttgtgttgctccctcggggaacgatctagagacaggtgactcagacaaatgcgggctatacattgaagaaaatccttcccgcctggttgccataggaagactttatgagggatccacagcagttcacaacatccctttgttgcatggccaagtcaaggttggtgttgaggaggttaaagatgcaaaggctctcgttcttgtacccattgacgaggttaccttagtggggcagacacttaacattttccttgcttggctgacacatcttgtgaagcgtttatcaaaacag

SEQ ID NO: 61479 - DNA, 144 bp, Glycine max
  Peptide Sequence Number=SeqID_153164
atggcggaaccatcgaagaagcgaaagggcacttcgagtcagagtcaacggcattccgggtcacaggaaatgccaattccttcctccattccctctggatcattgttttcatcaaagaaacaacaatccatgaaggcaccctaa

SEQ ID NO: 61480 - DNA, 189 bp, Glycine max
  Peptide Sequence Number=SeqID_153165
atggggcgtgccacattgtccccatcctcttgcaatttatgtccaaacatgcgctcaccaagtgctcggtgtatggtagttagaatatgttggatgttcttgtatgttgacatgagtaataggatattttctacacatacacgaaatggccctgaggaaacttgcctcaaagagatccaggaaggataa

SEQ ID NO: 61481 - DNA, 327 bp, Glycine max
  Peptide Sequence Number=SeqID_153166
atgggggaaacacatgaagttctccaagaccatactctggcagggttcggggtttatccaggatataccactgaagagcaggcattttctggcatcactgtgttgaatgctcccggaatatctcaatgttgcccgttatcacaacccttgcattttgtaagaggagaggggcctttcacagtacttgagaaggaaaggactgagcatatgaaggagaggctacgcgccattgaaggaggagaaaattatgcctttcctgacatggcagagttatgcttggtactcgatgtggttattcctcccaaagttcaaggtgctagattttga

SEQ ID NO: 61482 - DNA, 349 bp, Glycine max
  Peptide Sequence Number=SeqID_153167
gagtgaagttcaagttccccttgatcagaggctttatgaagagtcaggaacgactttgaagaagattatagttgttctttttgaacacttgctactagttataagcttgcagctcaactcacgtaggcaacaaatcaagctcacgcgggcaggcaggaatgcgccttctggagctcttcctttgactctcaagtctgccttttgcgcttaccgtcggaaagaggatgctggacccttcgaggagagagaacccatgtctgtcaaccttgatgagaatgaaagtatgtcggaataccgcccatgggaatcgactatgagctacttgtccaactattccagcgcagtttga

SEQ ID NO: 61483 - DNA, 210 bp, Glycine max
  Peptide Sequence Number=SeqID_153168
atgcttacgaacccagacacttcctaccaagaacaagctcaagaggtttctcttgtgtgtataaagaacaagctcaagaggttggcattaacagatccacttaaactgttacaagaacacaataagggtaagggaaacttcactaaggagaagaagcacagagttgtcacgatgctcgagttaaatatgagataccctagccatgtttag

SEQ ID NO: 61484 - DNA, 307 bp, Glycine max
  Peptide Sequence Number=SeqID_153169
atggagaaatctgaaaagaaaaatcttagtgaaaagaaactgaagaaagcatacatcacatgggatgaaaatgatatggaatcttctgaagattcagaaaatgaagagataaatctctgccttatggctaaaagttacgaaagtgatgaagaggtgtctttgaggaagaagtggtacatagatagcggatgctcaaaacatatgactggagatgcatcaaattttacacatatctctccaaagaaaagcgggcatgtaacatatggtgaaaacaacaaaggtagaatccttggagttggtaaaatag

SEQ ID NO: 61485 - DNA, 497 bp, Glycine max
  Peptide Sequence Number=SeqID_153170
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 61486 - DNA, 420 bp, Glycine max
  Peptide Sequence Number=SeqID_153171
atgtcagctctcaaagatcaaatggcttccatgatggaggccatgctaggtatgaagagattaatagagagtaatgcagccacaactgccgccgccagcaccatcgctgaagcagacccgtgcttacccctacggtctacccccaactttatgccacctgccatgcacgagaacacgaaccatgctgtttcctttaccttcgaaaggcagcctccccaacctgtaaggggtgcccacggagagcctcgggagcgtgtctcaggggatgtcgactcatgcccccctttcaccactgagggaccggcacccaatgccttgcctcaacctaatatcacgagagtctctcaacctcgcccaatgcaaccactactcttctccgtaaggggaccacctccgacaatggaaggtgtcataccctaa

SEQ ID NO: 61487 - DNA, 234 bp, Glycine max
  Peptide Sequence Number=SeqID_153172
atgcctcaaactagtgataaagttgatcttcttcatcaatggattcctttgcttcttgaagatgaatggcagcagaatgaagaaagggagagagagaggagacgccacttcaaggagaagatgagtctagaagaagctcaccaccataggaggccatggataagagcttggaagaagaaggagatgaatgaagggagagggagagaagagcacgaaattttgtgctctaaatga

SEQ ID NO: 61488 - DNA, 543 bp, Glycine max
  Peptide Sequence Number=SeqID_153173
atggagagaagtatgatagatgctgccagtggtggagcccttggagacatgactcctgctgaagccaaaaatttaattgagaagatggcttccaactcccagcagtttagcgccagaaatgatgctatagtcattagagagtgcaagagaaatctgtacctgtcacaagggtctgtggtttgtgctcctctgctgaccaccatacagacctttgcccttccatgcagcaacctggagcaattgagcagctcaaagcttatgctgcaaacatttacaatagacctcctcaacctcagtagcaaaatcaaccacaacagaactattacgacctctccagcaacagatacaaccctggatggaggaatcaccctaatctcagatggtctagccctcagcaacaacaatagaagcctgctccttccttccaaaatgctgctggcccaagcagaccatacattcctccaccaatccaacaacaacaatagccctagaaacagccaacagttgaaggtcctccacaaccttccctcgaagaacttgtga

SEQ ID NO: 61489 - DNA, 159 bp, Glycine max
  Peptide Sequence Number=SeqID_153174
atggcctcctatggtggtgagctttttctagactcatcttctcttgaagtgccattcaacttcaagaagcaaaggactccattgatgaagaagatccaaggtctacaaactccacatggagctacatcatgtggtatcagagcaccttcatctaggtga

SEQ ID NO: 61490 - DNA, 208 bp, Glycine max
  Peptide Sequence Number=SeqID_153175
gctcgatcgtgtccaacaaaacgcagagacgaatcatggtcgttcggcgtcttgtatcaaccgagtggaacaagttcgacagtatcgggatgatgtgtcggttccgctggcaggaaggttcactggccgaaaggggcaactgtcataccctaatttcatccggggaccatctgttgttgggatgcgaccctcatttgaccacttcgag

SEQ ID NO: 61491 - DNA, 194 bp, Glycine max
  Peptide Sequence Number=SeqID_153176
gtcaaggttagtgttgagaaatttacaaatgccgatgcttacattcctgtacccactgaagaggttatgtgggatgctatcgtgtttggggtgtttaatgataacttccccatgtacataaaacatgaagatctatctgaaatagcacacggtggtcaatatctcaacatctctattatacagttgtggattct

SEQ ID NO: 61492 - DNA, 261 bp, Glycine max
  Peptide Sequence Number=SeqID_153177
atgggtgtcgttacgggtgcagacagcaaccaggcccacttgggccttccaggggattccaacaaaaggcggtgccttctggtggaagcaacccagctcgcctgggcgagctgggcggcaaccacctccctcttttctcctataaataggggaaagagggcagagcaaaaatgttcaacccttctggtatttaggattctctcgaaattagtgaggaaaattgtttctgtgaaaaaaatccaagccgaggcgcttccgtaa

SEQ ID NO: 61493 - DNA, 83 bp, Glycine max
  Peptide Sequence Number=SeqID_153178
gatccccaataagggcccaattggcaacctaggcatcagccttttgggagaccaaatggtggctgacttgttggctgttgggg

SEQ ID NO: 61494 - DNA, 345 bp, Glycine max
  Peptide Sequence Number=SeqID_153179
atgtcacggaacttcacgaattacctaacgatgggtgccaagtacctcgaagtggtcaaacgagggtcgcatcccaacaacggatggttacaggttgtaccatctgtggtgaggctcatgaaacaggccaatagacaaggatatactcaaggaggattttcaggcttccagcagggtccttataaccaacaaggacagtggagatcacaccctaacaatcaattcatcaaggaccagggtggaccttccaacagaccaattcaacaagggcctaacatctttcagaggactactaagctggaggagactgactcagtttatgcaagtaacaacgtcaaatcataa

SEQ ID NO: 61495 - DNA, 435 bp, Glycine max
  Peptide Sequence Number=SeqID_153180
atgacagatcttgtgagcgcggaagatgacgtaaatctccgcgtgtcaacgggcttgtcggccgcgattgacgaagggcgcaggagacgacatagcaaaaaggtttatacgaataaccactcgggtatctccgcccgtcagcgtgactccaaagtcagtatgacagatcttgtgagcgcggaagatgacgtaaatctccgcgtgtcaacggcttgtcggccgcgattgacgaagggcgcaggagacgacgttagtctctgcgtgctcaatcaggcttttcgtcttacggatagcaaaaaggctttcctagtgaaacatattactagggctttgggggttgggggaaccttcttttcttccgactgcatgcaaatctgtggttcttccctccctcctttagacacttcaagctgcccccagtccatgagccgttga

SEQ ID NO: 61496 - DNA, 657 bp, Glycine max
  misc_feature (12)..(12): n is a, c, g, or t
  Peptide Sequence Number=SeqID_153181
atggggcaggcnacttcacaccttccttgcttggccgacacatctggtcaagtctttatcacagcagcgtgcctcaaattaggccatttaactttgtttcatgaacaggtagttgtgtctccggcaaaaccacctccaaagcccgatccggaggttgatgatccgctttatctgatgacattgaccatcccagagcttttcttgaggccttatcaggttacatgggatgccaccatgttcggggcctttaatccagatttcccgctctacataaagcacgaagacctctccgaaatcgcacacggtggtcaatgtctcagcatttcagtgttaaagttgtggattatgcatctcactgatacaagtatgcgagcggggaattatgatatctatggattcctcgagccacagtccattcagaggtttggacaatcacagtttgagtctgaaagttacataaaaacttggatgcagagttcaaaacgtgatgtctatcttggagcctacctaaatgggctagacaactaccttcaggggattattaacagcctaaatcaaaggctcctgctaggtggattgtcgtcaagtgtaatagacaaaaaggaagtactgagtgcggctactatgtcatgcactggatgtccaccatcattttag

SEQ ID NO: 61497 - DNA, 396 bp, Glycine max
  Peptide Sequence Number=SeqID_153182
atgttgctaagtagcaatgtcatctatatctgtgtaagagtggtcatgttggtgcgcatgatccgtacttgtctctttgcagcggcacgggtgaaatcttgccccggtatgcatagtagttgtgtgatagcctccctctctggttgtgcttgcacagttggtcgccctccaatattagggggtggcccaagaacagttaaaaggaaactactggtgcggatgtggagcacactgaaaatgaggacacgtagccctctaaaggtgagggcgtgcagccctctcaaggcgaggatgtgtagtcctctggaggtgagggcgtgcagccctctgttggcgaggacgtgtagtccacttcaaggtgagggcgtgcagccctctgttggcgaggacgtgtaa

SEQ ID NO: 61498 - DNA, 528 bp, Glycine max
  Peptide Sequence Number=SeqID_153183
atggatattgactatgctataaggaaggatgagccaccggctattactgaaactagcgaacctgatgctgttgatctttatgaaaagtgggagagatctaatcgtctctccgttatgttcataaaaaccaacatatcagctagtatccggggttcagttgaccagcatgataaggttagagatctgttgaaagccattgatgaacagtttacgacctctgagaaatcacttgctagtacactcattatgcaattctcttccattaagcttactggaacgagagaagatgagagattgataatggaagagggtgagaaggtaaatttgactacttctaattctggaaaggataggaagaagtctgtaggcaccaataaaggaaagattccgactcaaccaacaattaaaaaggagtcaaagtgtttcttctgtaaaaagaaaggacacatgaagaaggactgccccaaatttaaaagttggtttgagaagaaagggtatggaaagcctaaggaagccagtgggaagtga

SEQ ID NO: 61499 - DNA, 168 bp, Glycine max
  Peptide Sequence Number=SeqID_153184
atgactaaagcacgtcaaaagggggtacggaaagaaaatgagggaggagcttgccacccagctcacccaggcgagctaggttgcttcctccagaaggcaccgccttctagagaacttcctggaaggtccaagtgggcctggttgctgtttgaaccccctatttactaa

SEQ ID NO: 61500 - DNA, 330 bp, Glycine max
  Peptide Sequence Number=SeqID_153185
atgaggccactaagggaaaataggggaggagcttgccacccagctcgcccaagcgagctaggttgctttctccagaagcaaccgccttctggaggaacatcctggaaggcccaagtgggcctgaactttacggattgcacactaacacttccttttaatttccggcatgtcacagaacttcacggattgtgctacagcgcttttctttcagcttccgaaatatctcggaacttcaccaattgcctaacgatgggtgccaaatacctcaaagtggtcaaacgagggtcgcatcccaacaatggatggtccccagaagaaattagggtatga

SEQ ID NO: 61501 - DNA, 387 bp, Glycine max
  Peptide Sequence Number=SeqID_153186
atgaagatgaaagcaaacaaaataagaaatgaattgaaagtctcagattcgaacacttatcagttgaagaccgaagaacgaacaaagaacggtgaagaacgacggaaaatcttcatggatttgctcacgaaaacgtctcagaagtgttacggaagcacctcgcatagaggtcagggacccttgaaactcaacctcctccccctatttataggagaaatggggaggtgcttgccgcccagaggcttcttgaggaagatttctgagcgcactcaattactaagttcaccccccttttcgtactttacaaaaaagttatggaagccttacagaagcattttggacttgattttcctcttttttctcttccctttcaccaatattaagtga

SEQ ID NO: 61502 - DNA, 156 bp, Glycine max
  Peptide Sequence Number=SeqID_153187
atgactctaagacaacatggattaagcctaggatcttcttcatcaatggattcctttgctccttggaagatgaatggcagcggaatggagaaggaagagagagaggagacgccacttcaaggagaagatgagtctagaagaagctcaccaccatag

SEQ ID NO: 61503 - DNA, 354 bp, Glycine max
  Peptide Sequence Number=SeqID_153188
atggtggtcatcctgcccaaggaacacccagttgtctggttttgttcattgcataattggccagacaactaccttaaggggattattaatagtgctatcaaaggtcttgatgttgcttcacagcctaaatcaatggcttctgctaggtggattgtagtcaagtgtaatagacaaaaaggaagtactgagtgcggctactatgggatgcactggatgtccaccatcattttaggaacttttaggaataattgggaagcgtattttaatgatcttagaccattggtgccagagagattaaaagcattatggatccagtgggcacagttttatctccgagttagagatcaggcctag

SEQ ID NO: 61504 - DNA, 426 bp, Glycine max
  Peptide Sequence Number=SeqID_153189
caaatgagactttttcgcagtctcggctggaagatgttgacatcttcgggaaatgtgcagaagatgctgacatctctggggaaggtgcagatgacaattctcgactggaagatgttgacatcttcgggaaagatgtaggtgatgacccggaagatgctgacatctctaggaaaagtgcaagtgacgattctcggctagaagacgctgacatctccggggaaggtgcagatgacgattcttggccgaaagacgctgacatctccgggaaaggtgcagaagatgttgacatctctgggaaaggtgcagggcgtctccgcatgccaacggactcacaggtcacgatagcaaaaagtggggcagtcgacaaaagcaaggcttttgctcctacgtatcctcaatttgtgatgaggaactcagacctacgta

SEQ ID NO: 61505 - DNA, 132 bp, Glycine max
  Peptide Sequence Number=SeqID_153190
atggctcttgaatcctatgaaggtggagaactttttgatcaaataaccaggaaacccgttactaatgatgtgctcataaacatccatccgagagcgccacttgcaattgacacatttggtacaatggcataa

SEQ ID NO: 61506 - DNA, 276 bp, Glycine max
  Peptide Sequence Number=SeqID_153191
atggtggggtacgcaccttcaagctttgtggatttggtcttcgccggtaaaagggtcaaagcgggtctgaaaagaggcaaatttgatcatcctgctttgatgaatgagaaaattggggcaaatgaagaggatgagaatgaggaaggaacccatgttgtgactgccattcctatacggccaagtttcccaccaacccaacaatgtcactactcagccaataacaacccttctccttacccatcacccagttatccacaaaggccatccctaaattaa

SEQ ID NO: 61507 - DNA, 453 bp, Glycine max
  Peptide Sequence Number=SeqID_153192
atgcccccatctggcctcaaccaaatgaatcatccaacctctgatatggtaggcaaaaattcgggaagtagggaaacaccccatgatgtgcaaattcaaaatgagcacgccttcccgccatatagcttgcctcccaactatacaccacccaatgtggtgtacactcccaatgagaatgtcaataactccactcctatactcattgagagccaacaacctcaatctgatcatgcacatgtctctcaacccatgggggagacacatgaaataccccaccacaatttagccaacttcgagccttgcctcatatatgccactgaagggcaagcagttggtggtatacccctgcaaaacactttggagggccctcagtatcacccacaaccacaccccttgcattccacagtggataaaaaccctcatcctatggaagaaatgggagaatttggataa

SEQ ID NO: 61508 - DNA, 54 bp, Glycine max
  Peptide Sequence Number=SeqID_153193
atgtcggctattgagttttctattcactcccttaatgaaatatgcatgatgtcg

SEQ ID NO: 61509 - DNA, 489 bp, Glycine max
  Peptide Sequence Number=SeqID_153194
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaattgcatacaatttcggaaacagctatgaccatgatgtacgaacttcgagccgggggtacgggcacaggtactccgtagaactgacagagcccgtaattagagctttggacaaccccagggccctgttgaacttcttcgggcccactgg

SEQ ID NO: 61510 - DNA, 402 bp, Glycine max
  Peptide Sequence Number=SeqID_153195
atgccaatctccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggtcacgtcatcatagggagtgtctgtcgcccccagcaaagtcatcagaccccctaccaatcgagctttcatcaagaagtactgcgccccaggcaggcgcagggcgaagcaccacagcagcattgggatggccggtagcaggcaatagacacaccaccaccacctctaaagttcacctcagctcatccataaaaaggttagagcgtttcctacgacacatggccgaccaatag

SEQ ID NO: 61511 - DNA, 822 bp, Glycine max
  Peptide Sequence Number=SeqID_153196
atgcatttccccctgatccttgtctcacccgctcgcccggagaatatcggcgcggccgcccgcgccatgaaaaccatgggatttagcgagttgcgtattgtcgccagtgacgcctggcaggatccggccgcgcggcgtgtggcccacggcgccggtgagattcttgaccacgtgaaaacctatgacacgctgagcgccgcgctggcggatgtcgatttttccgtggccacgaccgcccgcagccgggcgaagtttcgctattacgccacgccggcgcaggtcgaaaccatcctgcaggagaagcgtcagtggctgaatcgcatcgcgctggtgtttggccgtgaagacagcgggctgactaatgaggagctggaacaggtcgatctgctgaccggcattccgatggcgcaggactatccttcactgaatctcggccaggcggtgatggtgtactgctatcagctgtcggcgctgcaccaggtagcggccgcgccggttgaggcggctaacgcgcagcagctgcaggcgctgcgccagcgctttcatcagctgctggtgacgctggaggtcagcaatgatgccaagctggcggactggatcgatcagcgcatcggtctgctggagcagcgcgacagcgccatgctgcaccgtttgctgcatgacgtagaaaaaaaacttatagataattgctcgggaaaaccggctccggacagcagacggacaagacaaagacagacagaaaaaatctcaatgcgtaaccacagcctgaacaccaccattattattaccaccaccattaccacaggtaacggtgcgggctga

SEQ ID NO: 61512 - DNA, 267 bp, Glycine max
  Peptide Sequence Number=SeqID_153197
atgataacaaagattataacaaaagatgatgacaaaggtgatgacaaaaagctcaaaggtcaatcaatgaatgagttcaagatattcaagatagaatcaagaacacttcaagattcaagagaaaagttgatttcaagaatcaagaatcaagattcaagagatcaagactcaagattcaagagatcaagatttaagactcaagattcaagagaaggcttaatcaagataagtatgaaaaggttttctcaaaaattgagtagcacatga

SEQ ID NO: 61513 - DNA, 420 bp, Glycine max
  Peptide Sequence Number=SeqID_153198
atgttcagcaggaattctttgactcctgtcatgtgtctggaacagccgctatctaggtaccaatcttccttagctgatgctctaagtgaagaacaaattctgtcatggttgtcagacttcatcagtaaatccaaggtctactctcttcttctccttctcattgacacgaaagccagattcttgctcttcttttcagccctatccgagagtcctagctcaaaggttcagaagagaaccaatgagttcatctactctcatgttgcaaatgtcttgggcctcctcttcattgcagtgactttcatgtcaaatctcttaggcaaggatctgaggatctttctcaccagcttttcatctgttatcctctctcccaaggcagtgcaagcattggcaatttcaagaatgttcatgtggaagtcatga

SEQ ID NO: 61514 - DNA, 414 bp, Glycine max
  Peptide Sequence Number=SeqID_153199
atgtacgaaactgatgatggtatcacatttgaaggccctaaaaaagctattcaaataaagcgtggtattagttttgagagtttaaaaaaaaggatacacgacaagatttttaattgcagaaataatatgtctcacaatgaatcgggtagtgcaagagttggaacaaattcaaaagaagattttgatgatgattattatttaatatctaattcatacgttgaggactcattagatgaggatgaggatattgatgaaatatctgacatagatgatgaagctgcccgtttgatcgaaccacttacagttgtgcaatcgggagaaggtgtggaagtcagactccattctgggattctgcttctcactatagtaatattaattggagtcatcctgaccaagaagaaatttgcgatttag

SEQ ID NO: 61515 - DNA, 519 bp, Glycine max
  Peptide Sequence Number=SeqID_153200
gctttccttctgcctttgatcaagggaagagaactggatcccttccaaggttatcatagactacttttaattgacattgttgttgaaggtcgttcgggttatagcaactccaggcagtttaaatcagacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccaaaagcagaatactgccccccatgttttgtcttgtgggggttatgattatttggagcagaagctcctggctgagaagaccaagaagaagatgcaggaagctgcacaattaggaagtgttgatggcgtcatcgacgcttcatccccagtcagacgccacgtgaagtggaagatgacccgcacgaagaagacaggggagatgacgactgaggccgcaaaggacatcgctgagaagatt

SEQ ID NO: 61516 - DNA, 474 bp, Glycine max
  Peptide Sequence Number=SeqID_153201
atggtttgccctccggacttcactccccgtaccactccagacgatttgagccaagcccctaccttcgaggggcagctccctcctcatgccgactatcctctgcaggaagatgatgaaggagatgcccatgtaggccctctacttcccctcaaggaaccggccccccatgagttgccccaaccaaacatagtctgccacgtcccgtctccatccgcccccgttaaggaactcgttcccgttgcaaaagacaagggaaaaattgatctgcttgaagagaggctgagagcggtagaaggcctcgacaactatccattctcggatttatcggatctatgtttggtacctgacatcatcattcctcccaagtttaaagtaccagattttgataaatacaaggggacgacgttccaaagagtcatcttcggatgtattgccgaaggatgggggcatattctacggacgaaaagttgttaa

SEQ ID NO: 61517 - DNA, 882 bp, Glycine max
  Peptide Sequence Number=SeqID_153202
atggatttacgagacctgaaactgtttcttcacctggcggaaagctgccactttggccgcaccgcgcgcgccatgcacgtcagcccgtcgacattatcacgccagattcagcggctggaagaggatgtcggacacgcgctgttcctgcgcgacaaccgcaccgtgacgctgaccgaagccggcgagcggctgcgtcagttcgcccagcagaccctgctgcagtatcagcagttgcgccatgtcatggacctcaacggtccgtcgctaagcggcgagctgcgcctgttctgctcagtaaccgccgcctacagccatctgccgccgattctcgaccgctttcgcgcggagcatccgcaggtggaaattaaactcaccaccggcgacgccgccgatgccattgaaatggtgcagtccggcgaagcggatctggccatcgccggccggccggagtcgctgcccgccagtatcgattttacaccgctgggtttgatcccgctggtgctaatcgccccggcgctgccctgcccggtgcgcagccaggcgacgcaggaacagccggactggtcgcagattccctttatcctgccggatcaggggccggcgcggcgcggtattgatttatggtttcgccgccaccgcattgccaacccgcagatttacgccacggtgtctggccatgaggcgattgtgtcgatggtggcgctcggctgcggcatcgcgctgctgccggatgtggtgctggaaaacagtccggaaccggtgcgcaatcgcgtgctgacgctggagaatgtcgagtcggtggcgccgctggagcttggcgtatgcgtacaaaaaaagcggctcggggagccgctgattaatgctttctggcacctgctgtaa

SEQ ID NO: 61518 - DNA, 372 bp, Glycine max
  Peptide Sequence Number=SeqID_153203
atggggagcttcacagattcagcatgggaatggaacctttcttggagaaggcccctatttgacaatgaggtagcctcgactgtaggttttttggaagatatatctcacactgcactccaacaacatgcagcagacagctgggtatggaaacctgaatccaatggatactattcttctaggagtgcctacattctgctgcaagggaactcagaggagggaaacatggatgatatattcaaggacttatggaagctaaagatcccagctaaagcatcaatttttgctgggagtattaaggaggaaactgcatctcatcttttctttgactgcagcaaaacacaacattttggtgggaatccctatcatggatag

SEQ ID NO: 61519 - DNA, 372 bp, Glycine max
  Peptide Sequence Number=SeqID_153204
atgaaggaaggcataggtcacatcttagacctcactcccataggagagaaaaggaaagaaagccttaagaggctaacattaatctcccatacttctatgggaaggacaatgaagtatactttaaaatcttatggctctcactcttatccaaagaaagaccaagggcaaggaatcttaggggtgacaccttctacgcccaaagatgataaggggaagacaatagaaaaacaaccccttaaggctagtatgcaagagaagactagctccataaagtgctttaaatgtcttggaagaggacacattacttctcaattccccaccaagaaacccatgattatcagaggccaagacatttatagtagccaagatgag

SEQ ID NO: 61520 - DNA, 487 bp, Glycine max
  Peptide Sequence Number=SeqID_153205
atgccgagaggaatgagtaaattaaatcatttacaacgtctggatttctttgttgtgggcaagcacgaagagaatggaatcaaagaattgggaggactttcaaatcttcgtggtgatcttgaacttaggaacatggagaatgtttcccaaagtgatgaagcgttggaggcaaggatgatggataaaaaacacattaatagtttacagttggtatggtctggatgtaacaacaacagtaccaacttccaacttgaaatagatgtgctttgcaagttacagcctcactttaacattgaatcgttgtatataaaaggctataaaggaaccagatttccagattggatgggaaattcttcctactgcaatatgacaagtctaaccttacttgattgtgacaactgtagtatgcttccttcactaggacaactaccttctctcaagaaccttagaattgcacgattgaataggctgaagactattgatgcag

SEQ ID NO: 61521 - DNA, 173 bp, Glycine max
  Peptide Sequence Number=SeqID_153206
atgggggtgcaaatagcaaccaggcccacttggccttccaggatgttcctccagaagacggttgcttctggaggaagcaacctagctcgcctgggcgagctgggtggcaagcatctcctttcttttcctataaataggggaaggagggaagagcaaaaggttcaaccctcctg

SEQ ID NO: 61522 - DNA, 315 bp, Glycine max
  Peptide Sequence Number=SeqID_153207
atgaacacccactcaaacttaacatacttctaccatcgtgcacacagcaccctagtacctagcggaggagtgtatagggttttcttcgagccacaattccaagagcagtgtagggggttctgtgggttcaagcgaggggtttccggcagtattgaaaacaatgtgggacaatgtaggtgtcgagggagcgatttccagcagatttcaggcgggaggagaaagagaagagcgatttcaagcatgaggagaaagagaagagcgagtgcaaggttttcgagcgcgccggttgtgaaatgtcaacgttttaacttataa

SEQ ID NO: 61523 - DNA, 597 bp, Glycine max
  Peptide Sequence Number=SeqID_153208
atggatggcgctaaagcgcgcgaactatacccggccgtcggggcaaggaccaagccccgatgtgtaggagggcgcggcggtcgctgcaaaacccagggcgcgagcccgggcggagcggtcgtcggtgcagatcttggtggtagtagcaaatattcaaatgagaactttgaaggccgaagaggggaaagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcaaaacagtcaactcagaactggtacggacaaggggaatccgactgtttaa

SEQ ID NO: 61524 - DNA, 108 bp, Glycine max
  Peptide Sequence Number=SeqID_153209
atgagcaagaggttccaagaggattgggctagagctgctgaagaaggccctagggttttcatgaacctcagggtagatttccgagcccatgggccaaggagtccataa

SEQ ID NO: 61525 - DNA, 516 bp, Glycine max
  Peptide Sequence Number=SeqID_153210
atgcaattaccgcaaaagcccttgaacaagagaccaagagggctcgcaaggaagagtatggccggaacaaatttcgcggagctctatggggtagcaataatgaactcaagttgcgaagggaagaaagggaccagtcgcgagcacatagcatggtccaaaagaagcttgtctcagtgtctatgcgagacagaaaccaacatgttagccatcatcgccaagtaccaagaagagttgggtctagccatggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 61526 - DNA, 324 bp, Glycine max
  Peptide Sequence Number=SeqID_153211
atggccaagttcgacccagacatagtcctcgaatcttatgctaatgcttggcctacagaggagggcgtgcgagatatgcgatcctgggtgaggggtcagtggatcccgttcgatgcggatgctctcagccagttcctgggataccctttagtgctgggaagagggcccggaatgcgagtatggccagaggaggaaccggtccgatgggattttgcccggactgctgctggaagacgagtgcggatcatgcgcaccaacatgaccacccctgactcagatctggatgactttgctgctcagcaacatccagcccaacgatcataa

SEQ ID NO: 61527 - DNA, 186 bp, Glycine max
  Peptide Sequence Number=SeqID_153212
atgggacaccttagtgatcaaggggttcccaaggaccctaagagaataaagatcattcctgattggcccactccaccaagtgttgagggaaggagcccagagtatgaagaacctcgggatttgaggtcaaatcctttccaaggtggaggggatgatgcaatcctaccccacaagggcattggatag

SEQ ID NO: 61528 - DNA, 306 bp, Glycine max
  Peptide Sequence Number=SeqID_153213
atgatgctggattttgaaatcctcgcacatttcctgcatcattttgttattcagattggtgctgtcgcaacatgcccttttgcgggcgagcgaggcgaggctcacgggtgcgctttccaaaggaggaaagatgcgcggagtcgccaccaacgtttgtttgtggaaaacatcggaaaaatcgaaggaaaccggtcaaaaacaaaaattctaagttcgggagttgtatttacgtttgaggaaggtcgacaaaagcggggctcttgctcctacgtaccctccatcgaagaggaaatcagacctacgtag

SEQ ID NO: 61529 - DNA, 690 bp, Glycine max
  Peptide Sequence Number=SeqID_153214
atggtggaagaatttgaagagatcctaggatgtcctctaggggggagaagaccatacctcttctcagggttctatccctcattagctagaatttctaagatagtccaaatctctgtgcaggaattagaccacaggaagcaagtcgaaaatggggtggttggaatatcgagaaaatatttggaggcaaaagcaagaatcttggcaagtaaaggcgagtgggccccgttcatagatattctcgcactgttgatcttcggaggagtcctctttccaaatgtggatgagttggtggacctagcaccaatcgacgcttttctcgcctatcataaccacaagggaagcccggttgtcgctatgttagccgacctatatgacaccttcgaccaaagatgtgaaaagagcaatacaaggattgtttgctgtactccagctctttatgtatggaccaacgtggagacacttcgaaaggtccgcaaggcatgggaggtgttgcaaaagaaggacaaggaactcaggggcagtaacaataggcccatcggtggctatcgtaagtggttaaaagcccacgtgcaaggtttggattggcttccaagtttgagaaccgctaaaagagaggaagttgaggcaccggaggaagacgaaaaagtgcaggcccttagggcggaactccgagcaagcccaaacagttaa

SEQ ID NO: 61530 - DNA, 111 bp, Glycine max
  Peptide Sequence Number=SeqID_153215
atggagtcgtttgatgctcatgcacggtgcccctcattgccccagtgtaaggctttgaggtaccaatcgttgtctttcgtcatgacctgtagctgggaacctattgagtga

SEQ ID NO: 61531 - DNA, 867 bp, Glycine max
  Peptide Sequence Number=SeqID_153216
cagctgacccagcaaatcagggaccagctagaggagtccatcacagagaaagtgacgaggcaagtcatggcatccttcagccagcttcagtcacagatgcaatctcagggacttgcagtgcctcctaagcctctggttggtcctggtccctccggtcctcaagtgagcacaaaggagagttgtgttgatccctcaggaaacgatcctgagacgggtgactctgacaggtgcagcttgtgcatagaagcagatcctgcccgcttggttgccatggggagagtttatgagggatccactgttgttcataacactccttttttgcctggccaagtaaaggtgagtgtggaggaggttacagatgcagatgctccagttcctgtacccactgatgaggttttcttagtggggcaggcacttcacaccttccttgcttggccgacacatctggtcaagtctttatcacaacaggtagttgtatctctgccaaaaccacctctgaagcccgatccggaggtcgatgatccgctttatcaggttagatgggatgccaccatgttcggggtcattaatccaaatttccccctgtacataaagcacgaagacctctccgaaatcgcacacggtgggaattctgatatctatggattcctcgagccacagtccattcagaggtctgggcaatcgcagtttgaatctgaaagttacataaagagttggatgcagagttcacaacgcgatgtctatcttggagcctacctaaatgggccagacaactaccttaaggggattattaatagtgctatcaagggtcgtgatgatgctccacagcctaaatcaaaggcttatgctaggtggattgtcgtcaag

SEQ ID NO: 61532 - DNA, 648 bp, Glycine max
  Peptide Sequence Number=SeqID_153217
atgtctcgctgttgtattggacgtcagagcaccctggacgtgtcatgctgcaggagtcgatgtcaccatcaagcaatactttggatcggctccacgaacggaccagctagaggagtccattatagagaaagtgaccaggtaggtcatggcttccttcagccagcttcagtcgcaaatgcaatctcaggacttgcagtgcctcctgagcctctagttggtccctccggtcctcgagtgagcacaaaggggagttgtgttgatccctcaggaaacgatcctgagacgggtaactctgacaggtgcggcttgtacatagaagcagatcctgctcgcctggttgccatggggagagtttatgagggatccactgttgttcataatactcctttgtttcctggccaagtaaaggtgagtgtggaggaggttacagatgcagatgctccagttcctgtacccactgatgaggtttccttagtggggcagacacttcaaaccttccttgcttggccaacacatctggtcaagtctttatcacaacaggtagctgtgtctccaccaaaaccacctccgaagcccgatccggaggtcgatgattcgctttatctgatgacattgaccatcccagagcttttcttgaggccttattag

SEQ ID NO: 61533 - DNA, 492 bp, Glycine max
  Peptide Sequence Number=SeqID_153218
atgacccaagagctggtaacccgcggagacaccttacggttatccgcacctcgtcattcagtgaccccaagtgtgattgatgagcaaaggccagtgtggtcatttgcaccctttccagagatgtcaacatcttccggtcgagactttttcaagtctcacaagatacgtaggagtaagagcattgcttttgtcggccgccccacaagatctgtcatattgaccctgaggtcatgtgacatgcggagacaaaatttggtcattccgcacccctttgccattcagacacagtcgtgtccgatggctcgcagagacaaaaattggtcattctgcaccctttgtcatccagaggcggcgggcccgatgacacgcggagacaaaatttggtcattccgcacccctttgccattcagacacagtcgtgtccgatggctcgcagagacaaaaattggtcattctgcaccctttgtcatccagaggcggcgggcccgatga

SEQ ID NO: 61534 - DNA, 336 bp, Glycine max
  Peptide Sequence Number=SeqID_153219
attggtaagttggtggacgacatgactaaagttgtggtaagaagagaagaagagtatgcagagattgaaacacatcaagaaagcattcttcaagttaacacaatacaccatcaattgatcaggaaagaagaaaaggatgaagtctccattattccagaatatccctgcatggcaactactggatatgttgtaggcaaagataaaggtcgtatggaactcactgtagaggatcagaaaatctcctttgacctttttgaagcaatgaaacacccagatatgagtgatgcctattttgaagaagaagaagtggagcaggagatagcattatcaacttga

SEQ ID NO: 61535 - DNA, 749 bp, Glycine max
  Peptide Sequence Number=SeqID_153220
gtagaggtgaatgggccccgttcatagacattctcgcactgttgatcttcggaggagtcctctttccaaatgtggatgggttggtggacctagcaacgatcgatgcctttctcgcctatcatgaccacaaggaaagcccggttgtcgctatgctagccgacctatatgacaccttcgaccaaagatgtgagaagagcagtacgaggattgtttgttgtcctctggctctttatgtatggttggtttcgcacctttttcaccaagaggtgaggcatgcttgcccgctagaaagccaccgttcatgcacagagaaaggaggggcaaattgggaccgactcttagcatacaaagaaggagcgtctgtcaactggtttcctcgatggaaagaaggaagaaccggggttcttatttcgtgcggaggatttctgaatgttcccttgatggggacaaggggttgcatcagttacaatctcgttctttctataaggcaacttagctaccctatgagagggacaccactagaggaagagctcgcgcctgtcatttcacgaggtttcaataagaccaacgtggagacacttcagaaggtctgcaaggcatgggaggtggtgcaaaagaaggaaaaagagatcaggggcagtaacaatgggcccatcgatggctaccgtaagtggttgaacgggagtcaagatcttccccgattgctagccaaggccaaagcaatggtgaacacctactccgatcccgag

SEQ ID NO: 61536 - DNA, 69 bp, Glycine max
  Peptide Sequence Number=SeqID_153221
atggagttgatggaattgaagcagaaaggagagttggaatgtacacacaggttagagagagatttctaa

SEQ ID NO: 61537 - DNA, 135 bp, Glycine max
  Peptide Sequence Number=SeqID_153222
atggatcattggaaagcagccaaaagagttatgaggtatttgaagagaacaaagtattatatgctcacatacaagagtgccaagcaaacttactacttcatccactatgatgacataatttgtggcatgctatga

SEQ ID NO: 61538 - DNA, 273 bp, Glycine max
  Peptide Sequence Number=SeqID_153223
atgtcagttctagaattgtacatagaaaaggatgttgctggtggttctatgtttcattctgcaaattatgttacatcatgtggacataatgtatctcatcatgagtcggaactgccaagaaatataagcaatttacatgatgatgaagatgatgatgatgattatcttgcgtctaactcatacgttgaagagtctttggatgaagatgatagtgtaccaggaattcaaaatccattttggaatgatgctttgcattataacaatatcaattag

SEQ ID NO: 61539 - DNA, 288 bp, Glycine max
  Peptide Sequence Number=SeqID_153224
gattgtcatcataaaaatgggggagattgtggaagcaatatcttccaaggttattttgatgatgccaaagaatcaagagtcaagcaaaatccaaagattcaagaatcaagtttcaagaatcaagattcaagattcaagaatcaagattcaagactcaagattcaagaatcaagagaagactcaatcaagataagtattaaaaagtttttcaaaacattgagtagcacaagaaattttcacaaaatcattaccgaagagttttactctctggtaatcgattaccagaag

SEQ ID NO: 61540 - DNA, 413 bp, Glycine max
  Peptide Sequence Number=SeqID_153225
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagctcctagtctatcacctaccatagcagatggaacagaccaccatgactga

SEQ ID NO: 61541 - DNA, 378 bp, Glycine max
  Peptide Sequence Number=SeqID_153226
atgagtgaagtagaggaggcgcaagagcagatgaaggccgacatggaggccatgaaagagaaaatggccacaatgatggaggccatgatgagcatgaagaaaataatggaagccaatacggttgcagttgccgctaccagtgttgttgcgaagatgaacccgatgcccccatctggcctcaaccaaatgaatcatccaacctcagctagagtaggcaaagatttgggaagtacgggaggcccccattatgcgcaaattcaaaacaagcacgccgtcacgccatatggcttgccttccaactatacaccacccaatgtggtgtacactcccaatgagaatgtcaataactccactccgatactcattgagagccaataa

SEQ ID NO: 61542 - DNA, 189 bp, Glycine max
  Peptide Sequence Number=SeqID_153227
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggcgatccggcccaacctgcgattatgcaacaaggttga

SEQ ID NO: 61543 - DNA, 243 bp, Glycine max
  Peptide Sequence Number=SeqID_153228
atgaggaagcatatgaaccattcaatgagaattgctaaaaggagcagtggcgctaagtggaccctatgggctcaatgcacatccactactaagcacaacttcagcgcgcttagcgtgacaagggaatctggaagagcacaaggatcaaggccgtgtgctaagtgcgagattagctcgctaagcgagacgtttgtctcttgccaggctaagcgcacgaatggcgataatcccaaatccacttaa

SEQ ID NO: 61544 - DNA, 285 bp, Glycine max
  Peptide Sequence Number=SeqID_153229
atgtcaactagaaaatatgaatcaggctattcaaaaattcagaaaaagagaagagtcaaggctttaattgcatcacaaaaaggagctatggataaatttataaaaatggatgagaaaaatgaattagaaaatataggtgggtactctttgaatgaacaagataacaatttagatatgggtggaagcaaaaatagagaagcagttagtgatgaggaaaattataattctgattctcaaactcatgataacgaggaggagattgggagactagatgaatatatatga

SEQ ID NO: 61545 - DNA, 384 bp, Glycine max
  Peptide Sequence Number=SeqID_153230
atggacaatggagatggaatagccgtcggttggttaggacatcctgtctttagagataaagaggggcatgaactttttgtagatggggatggaattgtcagggccgatgttccttttaggagggcagaatcgaagtatagtgtggaacaagtaggtgtaaccgttgagttctatggtggcgaactcaatggagtcagttatagtgatcccgctactgtgaaaaaatatgctagacgtgctcaattgggtgaaatttttgaattagatcgtgcgacttcgaaatcagatggtgtttttcgtagcagtccaaggggttggtttacttttgggcatgcttcttttgctctgctattcttcttcgggcacatattggcaaggtgctag

SEQ ID NO: 61546 - DNA, 604 bp, Glycine max
  Peptide Sequence Number=SeqID_153231
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgaatctctgcatctttggttctagttcttttcgcggtttttgcgtgcagagaagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 61547 - DNA, 333 bp, Glycine max
  Peptide Sequence Number=SeqID_153232
atgcagcatctgatgaagcttctcgaacgtgatcaatacattcattggcatagattgaaggatgaagttgtggtgcgtgatctgttttggtgtcacccagatgcagtaaagttatgcaatgcatgtcatctggtatttgttatagacagtacctacaaaacaaacaggtttcatatcgataagaatgtgaaggcgaaatgcaaatctttaatcggggaaaaaaatgcgtgggactatgtaatggataactgggggttgaatcagctcattgggctctcaaaagagtactacaaaatagcgttggagacctatgtagtgtttgggatgccatga

SEQ ID NO: 61548 - DNA, 177 bp, Glycine max
  Peptide Sequence Number=SeqID_153233
atgcttatgctgacaagcttgcttcttttggtgcatagaatgcgagaaaaaaaatactttggtgctagaatgttcaatttggagtccacaagaggaggatctccatatggtgctggagtttttgctggtgatggtacaagacaagcaagtgaaatggaactggagcttgcagagtag

SEQ ID NO: 61549 - DNA, 342 bp, Glycine max
  Peptide Sequence Number=SeqID_153234
atgcggaggaactcgcctgcttcctctagcgatacttctttcttgccacagccatcctttttctccaaaaaacctttcactggaatattctcgttcggagtagggatcgttttgtcattttgttctttctctatttttgccttccctttaacgtatgcgggttgtgttggcagccccgtgatattggttaccttggccgacaacgagctgatgtcggtggcttcttccttcctttcgcttggaggcgcatacctccacggaactgcgtggcttatccggtatggaaacgaaataggtttaactaccgaggggtatcagggcgtttggggagctgcgtctctg

SEQ ID NO: 61550 - DNA, 882 bp, Glycine max
  Peptide Sequence Number=SeqID_153235
gaggcaacgcaatcaattggtttcctcgttggaaggaaggcaaggaaggagttccctttctcgtgtggggactaccctaatgttccattgatagggactaggggttgtattaattataatcccgcactcgccataagacagctagggtaccccatgaggggagcgccaaccgaagaaagtctcttgcctttccttgtgagggatctaggcgcgcaaagtctcaaggtgatacaaagagtccacaaggcgtggagaagtccattgaagaaagacaaggagcttagatgcatccgaaatggcgtcatcggtggttatcatggatggctaagagttcacacgcgagggttagattggctctccaaattgaaagttatcaatgaggagaacttcgaagctccggaggaagatgaagaagagaagttcaaatcagccgctacatacatccggaaagagtgcaccgagttacaaaaggaaaacgtggccactgcaagagcccttgaacaagaaactaaaagggcccgcaaggaggaatatggccgagagaaattccgaggagcattgtggggtagcaacaatgagctcaagctccgaagagaggaaagagaccggtcacggaggagtttggctcaacacttggaagccacggagcaaagcatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 61551 - DNA, 210 bp, Glycine max
  Peptide Sequence Number=SeqID_153236
atggaggacttgattacaaaacgcaactctctctcccaaaataatgccaatgtcatcacgttggctcagcagctcctcaccataatcttactccttgcaccatgctgtagtcattctgcttccacgaacaaggttcgcaatcatcacagatgcaatgtggtacgtaccatcaaccgataccaaggaaatagcctaagcgtatccacatga

SEQ ID NO: 61552 - DNA, 186 bp, Glycine max
  Peptide Sequence Number=SeqID_153237
atggtggtgggtggttgcggcagcagtgtttggtttgacggtggtcttcagtggaggttggacttgcttgggagaggcagagagaaaggagaaaaagagagacaagagggaagagaaaagaaagagcaaaggaagatagagaaaagagaaaaagagataaaaacttgtttggtgaccaaaatatga

SEQ ID NO: 61553 - DNA, 159 bp, Glycine max
  Peptide Sequence Number=SeqID_153238
atggacatgaacattggcgttaattttccaaaggcaaggaagaccaagctcagagtagctgatgttccttcttcctttgcaccaataactggcatcccttcatcttctacttcagccccacttccagctttaacagacttatctgcccagagctcttag

SEQ ID NO: 61554 - DNA, 282 bp, Glycine max
  Peptide Sequence Number=SeqID_153239
atggctccgagaaagctttccataaaaagatctaggaaggacgcgcggccgaagggactagtgccgctcccaagttcgatagccatcgtttcaggagcgctgagcacctgcagcgtttcgaagccatcaagggatggtccttccaccgagagagacgcgtccagctcagggacgatgagtacacagtggattccttttgccaagtttgatccggatatagttctcgagttttatgccaatgcttggcccacggaggagggcgtgagggacatgcggtcatgg

SEQ ID NO: 61555 - DNA, 441 bp, Glycine max
  Peptide Sequence Number=SeqID_153240
atgtcgctgagctattgccacaaacaccagcctatgaaacattgtgcaatagcttccgattttcgacaaatggttgcaaggattaacattgaaatcatcttgatggatgagaaggctaataagatttttgctccaattaaaaatgttgatcctggtaagtggaatgatgttgttaaagtggttgaaaagaatttggacagcccaacaaagcacacctttaaactgaactttgtcaatttcacaaaagtaaaaaagcaggattttccaatgataccagaaatggtgtatgattttatactacttgatgatgttcttactggcaatgtcaatcctgactacttaatggaggcttatgcagtgtccattcaaaactcaatgtatggttctaaactatttatcaatgaagatttgaaggacattgaagattataaaaatgggtag

SEQ ID NO: 61556 - DNA, 702 bp, Glycine max
  Peptide Sequence Number=SeqID_153241
atggttagagctagaagattgtgttcggatttaggcaaagttataggaagagccttagggacacaagttagtggtgatgcggatgaagcccctcagcgtcgaaggccaacaacatttgcacatagacaacaggcagttgcacctattgctgaggatgttgagcatatggatcatgtagctgatgaggtgataaatattttttttcaagaacatcctgagttgaagttgtcctctcatagaagaaaggtacaaaaatttggaaggtcagctccagagattgaaggcatagtggttactacaggattaagtcctctaattgaatgttccttggacactggagaggtcactatcacccttgatgatgtggcatccttgctacatcttcccattacaagcgccttccatacctttgatgctcttcatgtagacaaagtcgtggacttgctagttgagttgcttgaacctggggatcctcttagacatctacccatggtgcacgatgatacatttattgaaccagatcctcctcagcagtcagtcgttgcagcggctatgcaaaaaccacatgtacctgcacttgttgatgtagacatgcctcaacatgtagtgaaggcttgccaacggatagcaaaaaggttggaacgcttgatcaacatgaggatagttactgctggaattgaagcatacattgtgaccgagtag

SEQ ID NO: 61557 - DNA, 708 bp, Glycine max
  Peptide Sequence Number=SeqID_153242
atgtcgtcatcacctctatggtccaccctctatatcatctccaacgtcggaatagtccttttcctgatggagattctggaaggtgatgacgtggtggaggctgtcaaagtcgattcggttgcggacacagatgatgaaggggatggagttggtgacattggagttatcgatgatgatggtggagtgtgtgagagtaggaaacagaactggagagagttgatttgcaaatggagtgaggagaaggttagggttcatggaattaagggtgtacagagggggagtcaattcgaaggaaaaatttatcagggatcaaatgcaaaagccagtggtggtggcgatgccaatagtggtggcagtgatgacttgatggtgatagttgtgatgatggtggtggtagtggcggcaatgttggtggcgatgacaatgacggaggtgttagttgtggcaacggtggttgcaatgatgttggtggtggttatggtggcagtgacgattgatgaaggtggtattgttgctagtggtggtggtggtgacaatgacggtggcattgatggtggtggtggtggtggtggtgccaccaattatggcggtaacaaagatggtggagatggtgttggcgatgatggaggtgacaatggcagcgacagtgatattgacagtgacgatgatgctggtagtgatgatgttaacaaaaagtatcattgctaa

SEQ ID NO: 61558 - DNA, 240 bp, Glycine max
  Peptide Sequence Number=SeqID_153243
atgtgtcaactatgcacaggtggccttgttggtgcatgcacgcttagcgcaactctgtctcgcttagttcacattagtgaatttcggcttagcgctcgtctttttgctcagcggatggactcaagcagtgtgcttagcgggattagcccttgctcagcgaacatgcatagctcatccttcttccaaattcttcctcacgctcagccaaaggaatgttgcactcagcagatggctcgctaa

SEQ ID NO: 61559 - DNA, 693 bp, Glycine max
  Peptide Sequence Number=SeqID_153244
atgaattctatactagttagtcccaagcttgggctaggtctagtcctcacccttcaagattatatttcaccaacacaagcagctagtgttggaccaacaaccactagatttcaacaacctgctaatattcccaatgtggttttctctataacttggtgggagcataacaatatgcttcatgtggattgcttctacaacttctttcgctatcgtagtgcactggtggatgcaccagattatagacctcgtatagttgatttctacatttggtggacccagcccatgccatcttactaccattttgctgtgcctatgctagaggtcatcattccatccaagtcatactcaccacctgtggacgacacaatgtcctctaccaaatctgattcttcatccaaggacactgatgctacttcatctgcactaatgtctccacaatcggtgttacttgagacttgggtaccacccgaggtaaacctaatggatcttgtgtctaaggatgaaggtaaagttgcggaggaggatacatctagaccgatgtctacacgatcagtgttacctaagtcttgggtaccaccctgggtagacttgatagatcttgtgtttgaggatgaaggtgaggatgtggagaaggatacatctatcaaggaagatacattaatggatgaggagaaacccatcatggagttgtag

SEQ ID NO: 61560 - DNA, 192 bp, Glycine max
  Peptide Sequence Number=SeqID_153245
atggctgagggtcacagagtttggatgatgcgacttccagagagggaagataagtcaggaattgtttgttccttaatcattgcaggaaccggtgatggtggtggtgaatatcatcaactggatgtggtgatgactacagaaatgcaacatttgctaaatcgtaacaatgaagagctctatagacgaatataa

SEQ ID NO: 61561 - DNA, 612 bp, Glycine max
  Peptide Sequence Number=SeqID_153246
atgaagaagatcataggcctacaagctccaatggagcttacatcagggacaagttatgaatcaatgactcggaaaaagccaaaagcttattacaagggcgtagaaaaatatttcaagtgtggatcgcatctaaaatggcctgaaggagttgtttcaagggagagcattagtgcagtgaagaagcttggtcatcttaaggatattgtatcacgaaatgtggactcttcaaggcgaagtgatgaagtccacaatgccacaaaatttgatctaccaaataaggatagaaaggattcccaaggaatatgctttttgggcaaggtatatggagtgagcagctcctttacatcatatctatttcatggtgctggatttggatctaagaaaaaatatatgtttcggaaagtgaccatccagctcaagcttgtggagggtgactctgttggaactggaccatttctatctcaatgcattgagcttttctcaagtgcagacaaccagatttgcatcaatgaattgaatattaccagtttaggcatcatagatattcctatttgcttaggtggctccatttcatccactggctccactttatatgtgctcatgttttcctga

SEQ ID NO: 61562 - DNA, 114 bp, Glycine max
  Peptide Sequence Number=SeqID_153247
atgaagatgctctcgataccacatgatatgaatggaagtggaatggagaagaaagagagagaggagacaccacttcaaggagaagaagaatctagaagaagctcaccaccatag

SEQ ID NO: 61563 - DNA, 673 bp, Glycine max
  Peptide Sequence Number=SeqID_153248
aggcggcgggcccgatgacatgcaggaaccatttggtcccacactttttcaccttttgtcatccagaggcggtaggcccgatgacatgcgggaaccatttggtcccacactttttcaccttttgccatccagaggcggcgggcccgatgacatgcgggaaccatttggtcccacactttttcaccttttgtcatccagaggcggcggacccgatgacatgcgggaaccatttggtcccgcactttttcaccttttgtcatccaaaggcggcgggcccgatgacatgcgggaaccgtttgaggcggcggacccgatgacatgcgagaaccatttggtctcaggcggcgagcccgatgacatgccggaaccatttggtcctgcacttttaccttttgtcatcttggcacgggacagtgagtcgagaggtgggcggagacaaattatggtcattcccgacaccttttcgccatccagaggcgatcgtgtccggtggcacacagagacaaattatggtcattttgcgccttgccacccaggctcgatcgtgttcgaagacacgcagagacaaattgttgtcattctacgccttgtgtcaagcaagaggaacgaactcgacaatatcaggataatggagattgatcggccaactggtgtttcgctcgaacgaaattag

SEQ ID NO: 61564 - DNA, 264 bp, Glycine max
  Peptide Sequence Number=SeqID_153249
atgaagacaataaccagtactttcgaaggtatgtctgatcaagctgcagcttggaagattgaaccaaagagtcatgttcaaatcagaggctatgagtgtggatattacgtgatgcattggatgtggtgcgtagttgctggcggtttgaaggatgattggaacaagtggttttctcatggatcagcgttagacgtggaggccatcacaatacttcggaagaaatgggcaacatactttttagctattagaaaaaggggatgttaa

SEQ ID NO: 61565 - DNA, 414 bp, Glycine max
  Peptide Sequence Number=SeqID_153250
atgagtgaaatagaggaggtgcaagagcagatgatcacaatgatgaaggccatgatgagtatgagaaggatgatggaggtcaatacgactacagttgttgccacaagtaccgccattgaggtggacccaactcaaccacctggtttcaatcaagtaaattgtccatcctcgaatatggtaggtcagggaggcaaagcattgggaaatgcgggcagcccccattttgtgcagattcagaacaagcatttcttcccaccatatggcttgcctcccaactgtacaccacccagtgttgcacatgctcctgatgagaatgttgacaacttcgcacctatacccattaagagccaacaaccccaatctaatcatgcacatgtctctctacccatgggggagacacatgaagtaccataa

SEQ ID NO: 61566 - DNA, 621 bp, Glycine max
  Peptide Sequence Number=SeqID_153251
atgttaatgttcaatgagcaatactcatgtgttggccctatagaattattacgtaccatcaatagaacaccagatggtatactcaacctgcttcaatccactattactcctactcaagatgcaatattgtatcacaacggaaagtcaaacataccacaccaagaaaaaaaatctacaatcaacaacattcagattttagccaaaataaaaaataaaaatcaaaactcagtcaaaatcaaaaatgaaaataaaaatcaacacttagccaaaattgaaaataaaaataaaaataaaaaatcaacacttagccaaaaacaaaaaccagatcgcaagtcaacagcggtgttgaaagttttggcgaagaagctagcgcagtctcacggtggtgtgaaattagatttggagttagacgagtctcatggaagcattaaccaaccagatttggaaccagatctagaactcgtggaagtaaggaaccaattgaatgaaggcaagaaggttgacgaaacgaggaaggaagtgatacaagtgaaggaacaaaggaaagaagaagatcaaagatgtaggaaactagaaaagagtgaagaaagggaaaatgaagcttgtatttcttatttctga

SEQ ID NO: 61567 - DNA, 900 bp, Glycine max
  Peptide Sequence Number=SeqID_153252
atggtggttccaaagtcagaaaatgatgcaaggataagcttaaactaccaaggaacaagcttagaatcacggttacctcgaagaaaactgcgaaggtcagattgggcttcgttctcaaccgaaaccggttcctctcggtgtgaggtttcaacggagaactacgacggttcgtggtggctactggtggttgtggtgatggagaagaagcttgggacattggaaatggttttggaagaaggaaggagaaagaaatggcgtttttccaaggctacacgaatcacaaaggctgaaacactcaagtgcttctgctctcggaaaaggaatgtttctcacacgttagacgtcgtatcgccaattgcaacgggtgttacagtgcaagttagtagtgcaacaagaatcgctcctatgagaaatgtgttgaatacaattgtgttgatgagcacattatttagtgtccaatacaagattagaacaaattcctccatttatcaccatgcccacaattgggtaggatcttcataccaaggaggccatgcattcaataacaataataatggaaccctttttaatttgaggtatctatggggcatgcctaaattgagaccccaacgtttagggttagattcttctcaacccttcaatggaacatctaggcagaattcaattacttctcaaaatagaaatcaaagccaaaatgaccaaggaaatgcttatcacaatgggtcagaacaattacaagggtcaggtaggaataggaaaaatgaacctttgtttgcaaggatttcaaacaatactttaatagccttaagacaacaagtggactatagtaatcatgatacgatgaacatgctatctcagcaaataacaactgtgttaaatccattagttcaaacgtcctaa

SEQ ID NO: 61568 - DNA, 228 bp, Glycine max
  Peptide Sequence Number=SeqID_153253
atgaagggaagaaggcataaatatgggtttaacaacaacaaacgtgagaaggcagagaagaaaagggtggtggatgatgaaactggcgacaaacatcagctggatgaagtcctacgaagatcctcctcaatctcaaagaggggaacgagcagcaatttgaagcaccaagagcggctacgtaagaagcttgcacttgaggaggggaggatatttgtagctaatgaacaa

SEQ ID NO: 61569 - DNA, 841 bp, Glycine max
  Peptide Sequence Number=SeqID_153254
atggctctgaagaaactctccatgaagaggtctagaagagacgccacaggagaagaatccagtgccgacccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcaaacgttggacaccgctagtgactcccatggctaagtttgaccctgagatagtcctagagttctatgctagtgcttggcccacggaggagggagttcgggacatgcgttcgtgggtaaggggtcagtggattccctttgatgtagattccctcagccagttccagggtgacccgctagttttggaggaaggccacaagtgtgagttcagccagaagaggaaccgggccaacgatttcgataaggaagccatcgcccagctggaggcgggtgcggatcatgcacaccagcatgaccaccttgacccagacatggatgatagtgctgctcagcaatgtatggcgcctaccaggcaccctctggacccagataagtccaacagggccctggggtttccggcgctaatcaccagcctctgccagtcctacggagttcccatcacccccagtaaagtaatccgaccgccaatcacccgagccttcatcgagaagtactgcacgcctaggcaggcgcagggtgatgcacatcaggccgcagacgcatcgccaccacctcggcaggccgatccagctgggtcactgggcgtggagcgttatctacagcattgggttcgccagcaggcggccaaccacc

SEQ ID NO: 61570 - DNA, 201 bp, Glycine max
  Peptide Sequence Number=SeqID_153255
atgggtgaccaagaggaagtagaggaacagatgaaagccgacatgtcgactttgaaagagcaaatgacttccatgatggatgccatgctaggaatgaggcaactaatggagaataacgcggccatcgctgccgctgttagttcggctgccgaagcagacccaactcatccagctactgcgcaccaccctatcccaaacgtg

SEQ ID NO: 61571 - DNA, 649 bp, Glycine max
  Peptide Sequence Number=SeqID_153256
atggcttcctcaccaaaagaaacttccgcttctggttcacccgctgtaccatcatctccgcaccaggaacaatcagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgaagctgatgaagatgtcccaacatcttccaccccaaatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtgacctcattgacttagaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcacttcctgccacatccagaaagagcaag

SEQ ID NO: 61572 - DNA, 165 bp, Glycine max
  Peptide Sequence Number=SeqID_153257
atggataagagcttaaaggtaggagaatatgagtggagggagagggagagaaggaacacgaaattttgtgcctcaaatgagctatggttcagcccactaatccaagatcaagtccaagatgctccactaagtgtgcttaagagtcatgaggcatgtaaagcatga

SEQ ID NO: 61573 - DNA, 417 bp, Glycine max
  Peptide Sequence Number=SeqID_153258
atgacattcttgggagaaacaagcagtcagacaattatgaactcgacattatgttttatttttccaaatggattcattgttcacaatgacagtggtgtttattttcaaacttccaatccagtacccattcgagtacttaacgcttgtgattttcaaacgttaaaaaccagaatacacaatacccttcagctaaccgacaaacaatatttggatgaaatttactaccggcagccattcgcagatccaggaaaaaatcccaaaaagtttgacattccttccggatgtagcatggatgaactgaaggatttgatcaagcaagttgcgcttcaagggattcccctttatgaagcaagtttcatgatgatgaatcaagttgattcaagtagttttgatgatgacaaaaagcccaaagaatga

SEQ ID NO: 61574 - DNA, 246 bp, Glycine max
  Peptide Sequence Number=SeqID_153259
atgtcgcaacgtgcccttttgcgggcgagcgaggcgaggctcacgagtgcgctttccaaaggaggaaagatgcgcgggaaaatgtcaccaacgtttatttgtggaaaacgtcgggaaaatcgaaggaaaccggtcaaaatgaaaattctaagttcgggagttgtatttacgtttgaggaaggtcgacaaaagcggggcttttgctcctacgtaccctcctttggagaggaaatcagacctacgtag

SEQ ID NO: 61575 - DNA, 741 bp, Glycine max
  Peptide Sequence Number=SeqID_153260
atgcatgatatgcaaatcatggttagaacgagaggtttaggtcgtgcattaggtaggggtataggcaaaggccggggtggacaggatgagcatcatgcagatgatgttccccggcggcgtaggtctaccgtatccgtccgtaggcaacgggtacatgtttctgttgctgaggacgttgctgatatgactgaggatgttcctcagatgactgaggatgttcctccgatgactacggacgtacctgcagctggtgtagagggcttagctaatgatgttgctacaggatcagttgctaatcatgctaagggattcctaggtgggccgcgggacccatcagtgctgacttcatttgcggagcatgttgcaaacaacatatggactggagagtcaccgacgatccgagagttctatccgctttcatggagaggtggcatagggagactagcaccttcctgtggaagcaatgccttcaaaggttattttgatgatgccaaagaattcaagaatcaagagaaagattcaagagaattttcaagtttcaagttttcaagaatcaagaataatcaagaacaagattcaagactcaagattcaagaatcaagagaagacttaatcaagataagtatgaaaaggttttttcaaaaactgagtagcacatggatttttctcaaaacatgtttaccaaagagtttttactctctggtaatcgattaccagattgttgtaatcgattaccagtag

SEQ ID NO: 61576 - DNA, 321 bp, Glycine max
  Peptide Sequence Number=SeqID_153261
atggttacctcaaagaaaaccgtgaaggtcagattgggcttcgttctgaaccgaaaccgtgaggcaagtttggaagattccgctccaattgaagggttcctctcggtgtggggtttcaacagagaaatacggcggttcgtggtggctactagtggctgtggtgataaggaaggagaaagaaatggcgtttttccaaggctacacgaatcacaaaggctgacacactcaagttcttctgctctcggaaaaggaagcgtttctcacactccggatgtcgtatcgccgatcgcaacggtcaggtcgtccaaaaatgtcttatga

SEQ ID NO: 61577 - DNA, 195 bp, Glycine max
  Peptide Sequence Number=SeqID_153262
atggtggtcggaagtgatgctaaagccttgggccattatgtattggctatggctctttttgctgaccaatgcccttatgaattggccatggctgtgaaagaagtgctctcacggaaagacaaattcgaattcaaaaggaacaaccatagtagtttctttgcaaaggaaccagacgtagcaagtaacgtcgtttga

SEQ ID NO: 61578 - DNA, 195 bp, Glycine max
  Peptide Sequence Number=SeqID_153263
atggaaaagtgcaaagaagcatcaacaccaatgacaatatccacttatcttgacttagatgaaaaagttagtaaactggtagagaagattggtagagttagcttagagttaaatgtgaggaaggtagtgttgcaggtggaaaagtgtgagattttgaggtttagaaggtcaaatttggtgttagtggaaatctga

SEQ ID NO: 61579 - DNA, 129 bp, Glycine max
  Peptide Sequence Number=SeqID_153264
atggataagagcttgaaggtaggtgaagatgagtggagggagaaggagagaaggagcacgaaattttatgcctcaaatgagcccattaatcctagatcaagttcaagattctccactaagtgtgcttag

SEQ ID NO: 61580 - DNA, 177 bp, Glycine max
  Peptide Sequence Number=SeqID_153265
ccagccggcactaatcaggtgctgcaccgtatacttgaatgggatgcaggagtcaatgttgtgtccgggagctccactatgctcgcgccgagggctgtattattgactggctggggagcggctggagctgtgcgttgggccgacgctctttctgctgcgggtggtccttttacttga

SEQ ID NO: 61581 - DNA, 236 bp, Glycine max
  Peptide Sequence Number=SeqID_153266
gtgcagacctcgagggtctctaccatttcagccgcagtcagcaggggttttgttgcaccccatttgtgtgccctaccctagaccagtttgcggctgaggtcgcatggccgggagactggcccgatgcccaggcaggggaggagcctacaggatcccccggtaggatggacgagccccgcatggacgaggatatgactgacctattcaatttcttgggaggaagcggagccacatga

SEQ ID NO: 61582 - DNA, 294 bp, Glycine max
  Peptide Sequence Number=SeqID_153267
atgactaaagcacgtcaaaagggggtacggaaagaaaatgggggagatgcttgctacccagctcgcccaagcgagcaaggtgacttcctccagaagcaaccgctttctggaggaatcttctggagggcccaagtgggcctgaaccttgcggattacataatcatcccctttttgacttacggaatgttacggaacctcacgaattgtgcaacgatgctaccttttgagttccggcatgtcacggaacttcgcaaattgcctgatgatgggtgccaagtacctccaaatggttaa

SEQ ID NO: 61583 - DNA, 294 bp, Glycine max
  Peptide Sequence Number=SeqID_153268
atggacccggagaagtccaacagggtcctggggtttccagctctgattacgagcctctgtcagttttacggagtgcctgtcacccccaacaaggcaggcatagggcgagacaccacagcagcctggggatggccggcagtgggcaacaaatgcactaccgccacctcaagagcacctcagctcatccacaaaaaggtccgtgaccgacaagtcataatgcgtccagctcaagacgttaaagaagcgctattaggaggcaacctagtaccttttgaatctatgcttgttatttga

SEQ ID NO: 61584 - DNA, 561 bp, Glycine max
  Peptide Sequence Number=SeqID_153269
atgggcataccaaattgcggatttcagggttacaaccaggggaactcatccggattccatcaagggggagcaggattcaatcacgggccaccgggattcaatcaaggaagaaatttcacgcaaggttcagggtggaggaatcagggaaaccaatataaggagaaaaggaaccaacaaccataccaaccgccatgccagcaccctagccaaggtccgactcagcaagaaaagcccaccaatatagaggaactactgctgcaattcagccaggagacacaatcacatcaaaagagcacggatgcagccatttggaatctggaagttcaaatgggccaattggcacacgacaaagccgaacggcccactagaactttcggggctaacacggagaaaaacccgaaggaagaatgcaaggcagtgctgactcgagggcagaaaaaagaacaggaggagggtaaggttgaagaagaagaccgtctagaggaagacaggacagagacaccagaagaaaggacagaagaagaagagaaggtggcatcaccacctaaaaccaagagctag

SEQ ID NO: 61585 - DNA, 282 bp, Glycine max
  Peptide Sequence Number=SeqID_153270
atggcttctgaaaggggggacaagaagtttttgaatgcaaaaacgtcccccctttcgtcactcttatatcttggtgcacgggttgctcgcccaggcgagctaacctgcatgtcatggcgtaaaggaacattaaccatgtcccctccttccttatggcaaaagaaaactgcgaatacaaaggatacggggctgccttgcagcgacgttctctgtttgtttagcgcagagaaggggcgacgatcagtcggtcgtgaccccatccctaattgcatccgttcctaa

SEQ ID NO: 61586 - DNA, 177 bp, Glycine max
  Peptide Sequence Number=SeqID_153271
atgaggaaagaccttcagaaagatgtgatcttcttggacatctggaggtttcatggtggagtagacaatatggaattctttcatattcttatgagggtcttcacctgcaagaccatgaaacttgggcaacaagtggatcagtctagttttaagaacatatgggacatcctcatcagg

SEQ ID NO: 61587 - DNA, 777 bp, Glycine max
  Peptide Sequence Number=SeqID_153272
atgctagccgacctatatgacaccttcgaccgaaggtgtgagaagagcagtacgaggattgtttgttgtactccaactctttatgtatggttggtttcgcacctttttcgccaagagttaaggcatgcttgcccgctagaaagttaccgttcatgcacagagaaaggaggcgcaaattgggaccaactcttagcaaacaaagaaggagcgtctatcaactggttccctcaatggaaagaaggaagaattggagttcttatttcgtgcggaggatttccgaatgttcccttgatggggacgaggggttgcatcagttacaatctcgttcttgctataagacaacttggctaccctatgagaggggcaccactagaggaagagatcgcgcctgtcatttcacgaggtttcaataagaccaacgtggagacacttcagaaggacaatgaactcaggggcagtaacaatgggcccatcggtggctaccgtaagtggttgagagcccacgtgcaaggtttggattggctcccaagtttgagaaccgctaaaagggaggaagttgaggcaccggaggaagatgaagaggtgcaggcccttaggacagaaatcgagcaagctcaaacagtcaaagaaaggttcaaatcagcagctctgaagatccgaaaggagaatgccgaactgagagatataaatacagctaccaccaaagccttggaacaagaaaccaagagggctcgtagggaagagcacggccggaacaagttccgaggggctctgtag

SEQ ID NO: 61588 - DNA, 414 bp, Glycine max
  Peptide Sequence Number=SeqID_153273
atggaagtgagggataaggttgaacttcttccatatagggacctagatgagctagtccaactttgtataagagtggagcaacaacttaaaagaaagtcttcttcaaaatcttatggctttcactcttatccaaggaaggaccaagcccaaggaattttggggactgcaccttcaaaacccaaggaagataagggtcacattgcctctcaatgtcccacaaagaaaaccatgattatgaggggtcaagacatttatagtattcaagaggagactacttcttccccttcctctagtggaagtggagataaagtaaggggtgaagagtctagtgaggaagtctacccccatgaagaagttgtgatctatctcaatcccaaagagataacatctttcatacacgatgcaaaattttag

SEQ ID NO: 61589 - DNA, 1187 bp, Glycine max
  Peptide Sequence Number=SeqID_153274
atggggacaaatcaaaacagcaaaaggttttatcaagtcaagcttaaaagtctagatgtcactagcctcaaggaattgggacgattgatgggacctctccaaaggcaagccttccgcaaagtgtacgggaggattctagatttgaccgcagcggaggtatttacggaagctgtcatatccctcgcccaatactatgaccagccgttgaggtgtttcacgtttggggacttccaaatggtcccaactattgaagagtttgaggaaatattaggatgccctctaggggggaggaaaccgtatctcttctccggttttcttccttccttgagcaagattacggctgtggttggggattcagcaaaggagttggatcgcacgaagcaaactcggaacgacgtagtgggcttgcctcgaaaatacttggaagacttagccgccattgatgctttcctcgcatatcaccatagcaaggaaagtccagtggtggctatcttggcagatttgtttgacacctttgaccggaggtgtgagaaaaacagcgtgcggattgtctgttgtttacccgctctctgtgtatggttgatttcacacctattccgacaagacacgagacacccgtgtccgcttcaaagctatcgctcatgcgccgaaaaaggaagagtcgattgggaccaacatttggctgggataggaggcagcgcgatcaattggtttcctcgttggaaggaaggcaaggaaggagttcttttctcgtgtggggactaccctaatgttccactgatagggactaggggttgtattaattataatcccacactcgccataagacagctagggtaccccatgaggggagcgccaaccgaagaaagtctctcgccttgccttgtgagggatctaggcgcgcaaggtctcaaggttatacaaagaatccacaaggcgtggaggaatccgttgaagaaagacaaagagcttaggggcatccgaaatggcgtcattggaggttatcatggatggctaagaattcatgcacgagggttagattggctctccaaattgaaagttatcaatgaggagaatttcgaagctccggaggaagatgaagaagtccgagctctaaagttagagttagggaaggcaagactcgccaaggagaagttcaagtcagctgctacacatatccggaagga

SEQ ID NO: 61590 - DNA, 204 bp, Glycine max
  Peptide Sequence Number=SeqID_153275
atggaggttgaggaaccctggcgggggttatggctaccattgcattatcaagtggtgtttgggcattgggagtgtggtaagcaggcatgccttgtggcttatttggggatggcttttgtggatgactgggtgatgggtaatgagaagggccgatattggctgagcgatgacattgttgggctggtgggaagtttagccatgtag

SEQ ID NO: 61591 - DNA, 417 bp, Glycine max
  Peptide Sequence Number=SeqID_153276
atgacgttgctacttagcaacattctgcccagtgaccacaataccgatctccccctacgaaaggatcgcacccacaagacacccaggggacccggagaagtccaacagggtcctggggtttccagctctgattacgggcctttgtcagttctatggagtgtctgtcacccccaaacaaggtcatcaggccccatattaatcgggctttcatcaagaagtattgcgccccccgagcaggcacagggcgagacaccacaacatcctggggatggttgccagcgagcaatagacgcaccgccgccacctccagagtccctcagctcatctacaaaggctggagcgtggcctacgacccgtggccgaccagaaggcgaccaagtccaaagccaaaggcaagcaatagtactaggtctgtga

SEQ ID NO: 61592 - DNA, 459 bp, Glycine max
  Peptide Sequence Number=SeqID_153277
atgaaagataagagggatgaggaggaaaaactagaaaaacaaaagaaaaagaaggatagtaaggccttgtcttcaaaggccaaggggaaggaaaaagaggaaaaggattcctccaagaagattgttaagaaggaaaatcatttcgcaacaaaaggtattattaggcaccaaatccctatgataggtggtatgatgaatttgttgagtggtgcaacactcttttgtaaaatcactcatgcacccaacatcttcatgatttgtgtacatagggactcattaggcaggaataatcaacatgaaaataaagaaaaagggcttcccatggaccctaagagaataaaggtaattcttgagtggcctactccaccaagtataaagggaaatttggggcttcaatatcttaacaaactcttacaaaaggtgttgaggaaagaatccatgagtttcaagaacctctag

SEQ ID NO: 61593 - DNA, 324 bp, Glycine max
  Peptide Sequence Number=SeqID_153278
atgcacacacaaagtttcacaattccacaattccctaaaataggcctaactcacaaaaacagtccccagtggagtcgccaattgtcgcaacctacccttttgcgggcgagcgaggcgaggctcacgggtgcgttttccaaaggaggaaaatgcgcgaagtcgccaccaacgtttatttgcggaaaacgtcagaaaaaccgaaggaaaccggtcgtaaagaatattccagattcgagagttgtatttacgtttgaggaaggtcgacaaaagtggggctcttgctcctacgtaccctccatcgaagaggaaatcaaacctacgtag

SEQ ID NO: 61594 - DNA, 497 bp, Glycine max
  Peptide Sequence Number=SeqID_153279
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcatgagcttgtgacagctgttgccgatccatcgttacaacatttaatcctcgtgtacccctaccatgtgtcgtggggatgtaccctccaatgtgttgggacaaagaattctcacgagggaaagggaagaatcaaaagaattcttaggtggttagggatcctcaagagtcgacctgcaggcatgcaagcttggcactggccgtcgttttacaacgtcgtgactgagaaaacactggcgtga

SEQ ID NO: 61595 - DNA, 252 bp, Glycine max
  Peptide Sequence Number=SeqID_153280
atgttgagtcaacatcccaatattttaaactacactgactctgtgaagaagagagaatctgctctatccctgcattacaaactgtttgaggggacacatgtcccagacattgtctcgacatcagggaaagctgctgcttcagctgaggaaaaagaaggagcagctgaagaagaagaagaagcacctgagaaagaggaagatgcagcagaggatacagaatcagatgatgatgattctgaagccaccccatga

SEQ ID NO: 61596 - DNA, 414 bp, Glycine max
  Peptide Sequence Number=SeqID_153281
ggatcaggcccacaagacatccagtggacccggagaagtccaacagggccctggggtttccagctctggttacgggcctctatcagtcctacagggtgcccgtaccccccggcaaggtcatgccatcgcgacatagggatcgcgcccgcaggacacccagtggactcaaagaagtccaacagggtcctggggtttccagctctgattacgggcctctgtcagttctacggagtgcccgtcacccccaataaggtcattaggccccctattaatcgggctttcctcaagaggtactgcgcccccaggcaggcacagggcgaaacaccacagcagcctggggatggctggcagcgggcaacaaacgcaccgccaccacctttagagttcatctcagctcattcacaaaaaggctag

SEQ ID NO: 61597 - DNA, 771 bp, Glycine max
  Peptide Sequence Number=SeqID_153282
atggcgaatcaagaggagtgggtcctgtttgcggatatactagctttgttaatctttggggttgttctctttccaaacgtggacggtttggtggacctagccgcaattgatgctttccttgcatatcaccatagcgaggagagcccggtggtagctatcttggcggacttatttgatacatttgaccaaaggtgcgagaagaacagcgcacggattgtctgctgcttacccgctctttgtgtgtggttggtttcgcacctattccaacaagacataaggcacccgtgtccgcttcaaagttatcgctcgtgcgtcgaaaagagaggagtagattgggaccattacttggctgggataggaggcagcacaatcaactggtttcctcgatggaaggaaggaaatgagggagttctcttctcatgtggggactacccaaacgttccgttgatagggacgaggggttgtattaactataatcccgcacttgccataagacagtttgggtaccccatgaggggagcaccgacggaagagagcctctcgcctttccttatgggagatttcggctcgcaaagtttcaagattgtacaaagagtccacaaggcgtgggaaagcatgttaaggaaagataaagaccttaggggcatccgtaatggcatcatcggtggttatcatgaatggctaagagttcatacacgagggttagattggctctccaagctgaaaattatcaacgaggagaacttcgaagctccgaaagaggatgaataa

SEQ ID NO: 61598 - DNA, 432 bp, Glycine max
  Peptide Sequence Number=SeqID_153283
atgatcatgaagggtcaagacatttatagtactcaagaggagactacttcttgcccttcctctagtggaagtgaagatgatataaggggtgaagagtctagtgaggaagtctacctccatgaagaaggtgacctcttaatgattaccctcacccatcttgagcataaatttgtgttgcatcctcaaacaccttcacaagtggccaaagatcaactaactatgaaagataaaagggatgagaaagaaaaacaaaagaaaaagaaggatagtaaggccttgtcttcaaaggccaagggtaaggaaaaagaggaaaaggattcctccaagaagattgttaagaaggaaagtcattttgcaacaaaaggtattatgaggcaccaaatcactatgataggtggtatgattcaacatcttcatgattcacatacctag

SEQ ID NO: 61599 - DNA, 331 bp, Glycine max
  Peptide Sequence Number=SeqID_153284
atggagaatggcttggaacaggttttggagacacgaaggaaacgcttttccagaactttctttgctgtttcacaaggttttcttggtgaaatgccggatgttgaagaactggaaaaccctgacatttatgttgcttctcagattttttctgcagatggtgttcttttaggcaaatttgaaaaagaaaaaacccaacctattacctataaggatcttcctccttttcttgtgtatgcactacaagctaaagaggatgagcgttttaaagaacactccggaattgatctacaatcaattgccagagcagttgtttatggaggtggcagaggag

SEQ ID NO: 61600 - DNA, 233 bp, Glycine max
  Peptide Sequence Number=SeqID_153285
ataaccactcgggtatttccgctcgccagcgtgactcaagcgtcagtatgacagatcttgtgagcgcggaagatgatcaaaagaaagtttatacggataaccactcgggtattttcacccgtcagcgtgactcaagcgtcagtatgacagatcttgtgagggtggccgacaaaagcgaggctcttgctactacgtatcctcaaatgaggaactcagacctacgtagttcttga

SEQ ID NO: 61601 - DNA, 504 bp, Glycine max
  Peptide Sequence Number=SeqID_153286
caaatatctaatcctacagtcaagtatggccttgatccagaaacatgggcggaatttgcaaaaagccgcaaaactcctaattggcagggtatacgaaagaaggcccaggaaattcaaaaatttaatgactgcccacacgtactgtctcgtggggggaatgaactgcttgacaagaaacttatggaggagaagagcaagcgtggacatgaggaacattcgtgtactgaaagcccaacactcaatgtcgacccaccatccccagttgcaagacacttgaagtggaagatcgcctgcactaagcggcatggccaaatgacgcctgaagtggcacaagaaattgcagacaaaattgaacaagcaacacatgggagttttgttccgcatgggcgacaggacatacttaacacatcccttggccgacctgagcatccaggccgtgttcgcgtcgcaagggacaggtgtcacaataagccaatactttggccaagcctcacgtgcttctag

SEQ ID NO: 61602 - DNA, 312 bp, Glycine max
  Peptide Sequence Number=SeqID_153287
tgggctcggtcagtcgcttatgaaattggatttgtggcggtgattatgaagtcagacacgaacactggagtggttagtataggtctaggaagaaagattttgttagaagagatattggccgtaagaaatgtgggtgtcccttcaagtttcatcggaaaccagtggttgaagggcaaggtgaaaaagaggctaagttttgaattgcaaaaagtagcagttgggctaagcgcatatccaccgctaagcatagcttcagcgcgcttagcgcaaaggagaatctggcagagcatcaacatcaaagtcgtgcactaa

SEQ ID NO: 61603 - DNA, 450 bp, Glycine max
  Peptide Sequence Number=SeqID_153288
taccctcaccctcagaggactgcacgtcctcaccctcagaggactgcacgtcatccccttcagaggactgcacgtcctcgccttcagaggactgcacttcctgggccacaccctgatcctggaggagggccaactatgcaagtacaaccaaaggaggaggctatcgtgcaactactgtgcataccggggcaagatttcacccatgccactgcaaagagacgagtgtggatcatgcacaccaacatgatcactcttacacaaatatggatgacgctgctacttagtaccatttcatccagcgaccggaataccgatctccccctgcggaagtatcaggatagtgcccacaaggcacccagtggacccgaaggagtcccaacagggcctggggttttcagctctagttacgggcctctgtcagtcctacagggtgcccggtcccccgacaag

SEQ ID NO: 61604 - DNA, 585 bp, Glycine max
  Peptide Sequence Number=SeqID_153289
atggtggaagaacttgaagagatactaggatgtcctctagggggaaggagaccatacctcttctcagggttccatccctcactagctagaatttcaaaaatagtccaaatctcggcgcaggaattagaccatagaaagcaagtcgaaaatggggtggttggaataccgagaaaatatttggaggcaaaagcaagaatcttcacaggtaaaggcgaatgggccccgttcatagacattctcgcactgttgatcttcggaggagtcctctttccgaatgtggatgggttggtggacctagcagcgatcgacgcttttctcgcttatcatgaccacaaggaaagcccggttgtcgctatgctagccgacctatatgacaccttcgaccgaaggtgtgagaagagcagtacgaggattgtttgttgtactccagctctttatgtatggttggtttcgcacctttttcgtcaagaggtaaggcatgcttgcccgctagaaagtcaccgttcatgcatggagaaaggaggtgcaaattgggaccaactcttagcaaacaaagaaggagcatctgtcaactggttcccttga

SEQ ID NO: 61605 - DNA, 652 bp, Glycine max
  Peptide Sequence Number=SeqID_153290
gcgctgctgcgccacctgcagccgctgcccgccagccgcttcctgcggcgactctagagggctacccacaacttcgccggccgcactgacgcctttttcgccgccatggcccggatccgaccggccgctggcgccggatgagcaggcgggcaaaacgctgcgcatcgcctccatcgacatcggcggcggcaccaccgatctggcgatcacgcactattcgctcgacgacggcgtgggcaacaacatcaaaatcaacccgcgcctgctgttccgcgagggctttaaggtcgccggcgacgatatcctgctggacgccatccagcagtttatcctgcccgccgtgcagcaggcgttcgaagccgccggcgtaagcgccgccccggcgttaatggacaggctattcggcaacgaagcctcgcgtatggacgggcttcgaccctgcgccgcaggccgcgctgcaaatgcccgccgggcgacgcgctgctcgactggccatgaagaatacacccgtgccgacagccgggcggaaagcgtcaggatcgccagcctgggcgattgctgccgcagccccgtcccggcgcaccagtgctggcgtttaactcaacggcgaggtggcgcgacccactactggatagacagcgggagcatttga

SEQ ID NO: 61606 - DNA, 936 bp, Glycine max
  Peptide Sequence Number=SeqID_153291
atgggaagatctggcaaaggtgcttcatgtttaggggactttcagttagtactaaccgtagaagaatttgaagagatattgggatgcccgctaggaggaagaaaaccatatctcttttctggggtctacccctccatggagagaatagccaaggtggtcaaaatatcagcacaagaattggaccgagtaaaacaaaatagaaatggggtggttggaataccaaggaagcacttggaggagaaagcgaaggctttggtagatcaagatgaatgggcattattcattgatgtcctagcgctattggtgttcagagtcgtcctcttcccaaatatggatgggctagtgtacctagcagcaatcaacgccttccttgcttatcaccatagcaaggaaagtctagtcgtggctgttttggtcgatgcctacaacacatttgaccggagatgcgagaagagcggcgcaaggattgtttattacacaccagctctttatgtatggctggtatctcacctctttcgtcatgaaggggcatccgttaattggttcccccgatggaaggaaggaagggtcggggttttgtcctcatgtgaggggttctcaaacttccccttgatgggaatgaggggttgtatcaattataatctcgtccttgccataagacaacttggctatcccatgagaggagcgccgttggaagaaagtatcacgcctttcattgcacggggttttagtgaccccaatgcatggatgtttcaaatagtccgaaaagcatggagtgcggtgcaaagaaaggataaggagcttaggggaagcagcaatgggatcatcagtagctatcataaatggttgaagactagaattcaagagataacttggctcccaaagctaaagatctcaagtgaggaagaggctaaaacccctgaggagagcgaaaag

SEQ ID NO: 61607 - DNA, 93 bp, Glycine max
  Peptide Sequence Number=SeqID_153292
atggatgaaggtgtggaagtaccatatcctgtggaaactggaaataaccatgcccttcggagaagctttgcagcaaatgccactctactctaa

SEQ ID NO: 61608 - DNA, 147 bp, Glycine max
  Peptide Sequence Number=SeqID_153293
atgactggagatgcatcaaagtttacacatatctctcccaagaaaagcgggcatgtaacatatggtgacaacaacaaaggtagaatccttggagttggtaaaatagcctgcttagtgttagtcaattatgtgacaaaggctatctag

SEQ ID NO: 61609 - DNA, 645 bp, Glycine max
  Peptide Sequence Number=SeqID_153294
atggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaggctaagcgtgaatcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaagactctcagacaatggcgttgatgatggagaagcagctgaggaagaagaagatgccgcagaggatacaaatccgatga

SEQ ID NO: 61610 - DNA, 548 bp, Glycine max
  Peptide Sequence Number=SeqID_153295
gcttacacgccctcaccttgggtactatttaccctcaccatttagaggacttacacgtcctcgccttgagaggactacacgtcctcgccttgagaggactacacgtcctcgccatcagagggctgcacgcccttaccttcagaggactacacgtcctcgccttgagagggctacacgccctcaccttgggactacacgtcctcgccttgagaggactacacgtcctcaccatcagagggctgcacgccctcacctccagaggactacatgtcctcgccttgagagggctgcacgccctcaccttgggtactagttaccctcaacgtcagaggactacacgtcctcgccttgagaggactacacgtcctcaccatcagagggctgcacgccctcacctccagaggactacatgtcctcaccttgggactacacgtcctcgccttgagaggactacacgtcctcaccatcagagggctgcacgccctcacctccagaggactacatgtcctcgccttgagagggctgcacgccctcaccttgggtactag

SEQ ID NO: 61611 - DNA, 516 bp, Glycine max
  Peptide Sequence Number=SeqID_153296
atggatctcattgaaaatatggctgcaagtgacattgctattctgagagatagagcccacattcctactaaaaagagcttattggagctaacctcacaagatgcattgttggcacaaaacaagttgctatctaagcaacttgaggcattcactgaaacactaagatgtacaatttgtggtggatctcatgaatctggatgttgtatccctaatgaagagcaagtcacacatgaagtcaattatatggggaaccagcccaggaacaattttaatgcaggtggattttctggattccaacatggacaacaatgcaaccaacaacacggacaatggaggaaccatcctgggaatcaattcaatagagaccatgggggatcatccataaggtcgcaacaacaagggcctagtctctatgatcacaccacgaagctggaagagactctagctcaatttatgcaggtttctatgtctaaccagaagagcacagagtctaccataaagaatctggaggtctaa

SEQ ID NO: 61612 - DNA, 159 bp, Glycine max
  Peptide Sequence Number=SeqID_153297
atggtggatacaccacgtttggagacaataacaaaggaaaaaaatggttgtcttataagtgaagccatatccggtaaagttgtccacatcggtaagagaataagtaatatctacatgttgagtgttgagcatgcatcttttcatgagctaagtttcttg

SEQ ID NO: 61613 - DNA, 249 bp, Glycine max
  Peptide Sequence Number=SeqID_153298
atgactagcattccacaacctgttgctgataatccagtagatcaagttgataatgaaactcctgaaaatgatgaacaaccacctgaacaacatgatccccaagaaaatgttgatgcagcatttgaatctaactacaatattggagctgaaaataatcccaaaatgtttgatcaagtcatgagttgtaaagagtcaaatttacggtatgatgccatgaagggtgagatgaattccatgcagagtaattga

SEQ ID NO: 61614 - DNA, 367 bp, Glycine max
  Peptide Sequence Number=SeqID_153299
ctggtgaatcaggaggagcagtcgcttcatctgatgatgcatcagagatgacaatcagaggtggagatgggggactacttcacactcaggagaagatggtggattcaccactggagattgtgggtcagctggctctggatcaacctgcacaggtgtggcctcaggtggagcagcctcattgggtctctcaccaatggaagttgagcttcaggccaggctacttgctcaagaaaatgctccataggttgtgcatgataataaacagtcctcgaaataagctttgtaacatagggactaaagtttgtgagctttggacatcctgtcctacggttactgacggaggagctggagtggatgatgaagggat

SEQ ID NO: 61615 - DNA, 271 bp, Glycine max
  Peptide Sequence Number=SeqID_153300
atgttagctatcgtcaacaaataccaagaagagctaaatctagccacagcccacgagcataaagtggcggacgagtatgcccgagtgtacgtggaaaaagaggctagaggaagggtgatcgactcgttacatcaagaggcaacaatatggatggaccgatttgctcttactttgaatgggagtcaagaacttccctggttgctggccaaggccaaagcaatggcggacacctactccgcccccgaggagatccacgaacttctcagctatt

SEQ ID NO: 61616 - DNA, 303 bp, Glycine max
  Peptide Sequence Number=SeqID_153301
atgagggttcactgtaatcaagcaagtcggaaacctagcatgaccacagattcacctccactccttatgttcccacaaacccggtcgccaactgtcgcaacctacccttcggcgggagggcgacgcgagactcatgggtgcgtcttccaagaaaggaaaatgcgtggagtcgtcaccaacgtttattcgaggaaaacgtcagaaaaatcggaaagacgtggtctacgaactttaagtatgaaaggttcggggaagatatattttgatttcaatgaaaggtcgtttaaggcgttggaccattaa

SEQ ID NO: 61617 - DNA, 258 bp, Glycine max
  Peptide Sequence Number=SeqID_153302
atgacttttttgcagtctctgccagaagatgctgacatctacggggaaggtgtagatgatgatgtttgtcactgcatgctattgggctttgagtcttataggatagcaaatgagacttcttcgctgtctcgatcagaagacgcaaacatcctcgggaagaggtgcaagtctctgccagaagatgctgacatctacggggaaggtgttgatgatgatgtttgtggctgcttgctattgggctttgagtcatacggatag

SEQ ID NO: 61618 - DNA, 369 bp, Glycine max
  Peptide Sequence Number=SeqID_153303
atgggttctccacctgcctccactccttctcctcctcctcctcctccttctcctccttctcctcctcctcctcctcttcctcctcctcctacttcggacgcatcggcttcgccgtctgccgtgaagcggacacgcaaagcctcatgtctacgatcgttgtccactagaccacctggtgctgagagaccagtggtgcatgttgatcctgctaccgggaaggccgacggtccccacatgaagaaattaagaacatatttggggattgtggcacgtgataaggtggacatcacctacgagaactggaaggaggtccctactgctcagaaggacctgatttgggaggatattcatgtatttctcttttcttag

SEQ ID NO: 61619 - DNA, 387 bp, Glycine max
  Peptide Sequence Number=SeqID_153304
atgccaatctcccccggcaaaagtatcagttggtttgtgtcgtcccgacatggggatcgcacccacaagacgcccagtggacccggaaaagtccaacagggccctggggtttccagctctggttacgggcctctatcagtcctacagggtgctcgtaccccccctagcaaggtcatgccatcccgacatagggatcgcgctcacaagacatccagtggacccgaagaagtccaacagggtcctagggtttccagctctaattacgggcctctgtcatttctatggagtgcccgtcgaccccagcaagttcatcaggcccctattaattgggctttcatcaagaagtactgcgcccccaggcagacgcagggcgagacaccacagtag

SEQ ID NO: 61620 - DNA, 111 bp, Glycine max
  Peptide Sequence Number=SeqID_153305
atgatggataccttagagccctacactggggcaatgaaaggcaccatgcgtgagcctccggcgaacctaggggtagggggagtgacaaaccctgggatttcagtggattga

SEQ ID NO: 61621 - DNA, 1026 bp, Glycine max
  Peptide Sequence Number=SeqID_153306
atgacagcgcagcccgatagctcatccccgctactcagtctcattatcccgatgtttaacgctggtgctgactttaccggctgtatcaatgcattgctggcgcaaaccctgacgtcgctggagatcatcattgttgacgatggctccaccgacggctccggcgagcgcgccgacgcgctggcgcagcagtacccacatatccaggtggttcatcagccgaacggtggcgtgtcgcgtgcgcgcaatgccgggctggctgtggcgcggggtaaatatgtcagctttcccgacgccgacgacaccatggacccggcgatgtaccagacgctggtcgacatggcggagcgcgatcggctggacgctgcgcagtgcaacgccggaaaaagtggtttttcaaggccagccagacaactaagttccgatgattccgcgggatcgcctcaccagcactggcgtattaagcgggccggagtggctcaacaaggcgctgaaaacccggcgttactgcacgtcgtgtggctcggtatctaccgccgtgagctgatcgaacagcttaatctgcagtttgaacccggtctgcatcatcaggacatccccaccgcaagcgcaccggccagcacaatgtcactatcagcgtcattacctgatcgcccgtttgtgcgcatgctggaagatcagcccacctcgcgctatcggttttccaaggtgggaagatttaccgaaaaggtggcgcagctgattgatgcgctggccgctgatgtcgctgtgccgcacgccgaacgtggtgtcgctggcgggccagctctcgctgccgcagctggcggcgctgatgacgccgcacatttatcgctggcgtcgattccgcaccgacacaccgcggctttaagcagatatggcaagcccgattccagcccactttgcaccggaaaatatctagctgcttcagctgcgtcatcatggcgatatgctgctgaccacgcctgccatcaatgcgctgcgccagcgctatccgcaggccaacattga

SEQ ID NO: 61622 - DNA, 384 bp, Glycine max
  misc_feature (83)..(83): n is a, c, g, or t
  Peptide Sequence Number=SeqID_153307
aaactacaaatcctcaccttgaaaggactgcacttcctcgccttcagatggctacatgtcttcgccttcagagaactgcacgntcttgcctttagaggactacacatcctcgcatttagaggactacatgtcctcaccttcggagggctgcacgccctcaccttcagaggactacacgaactcgccttcaaagggctacacgtcctcgctttcagaggactccacgtctgcgccttcacaggacttaagtcccttggtcacccccctgatctcggaggagggcaaactgtgcgagcacaaccagatggaggctatcatgcagccactatgcatactggggcaagttttcacccgtgccgctacaaagagacgagtgcggatcat

SEQ ID NO: 61623 - DNA, 588 bp, Glycine max
  Peptide Sequence Number=SeqID_153308
atggcacgcagagacaaattatggtcattttgcgcccttttatcatccagaggtggcgggtccgatgacatgcggagacaaattatggtcattccgcacaccccttttgccattcagacacagtcgtgtccgatggcacgcagagacaaattatggtcattctgcgcccttttgtcatccagaggtggcgggcccgatgacatgcggagacaaattatggtcattccgcacaccccttttgccattcaggcacagtcgtgtccgatggcacgcagagacaaattatggtcattctgcacccttttgtcatccagaggcggcgggcccgatgacatgcggagacaaattaagacacagtcgtgtccgatggcacgcagagacaaattatggtcattctgcacccttttgtcatccagaggtggcgggcccgatgacatgcggagacaaattatggtcattccagcacatccccttttgccattcaggcacagtcgtgtccgatggcacgcagagacaaattatggtcattctgcgcccttctgtcatccagaggcggcgggcccgatgacatgcggagatccaaattaa

SEQ ID NO: 61624 - DNA, 273 bp, Glycine max
  Peptide Sequence Number=SeqID_153309
atgtacatcaagtatggcccaaaatacatcatgaagcatagccagcaaaacatgttatccaatgaaacaaaaccccccacttattcccaaaacaattccaaagctccaaaattccttaaggttaaggaagcatcaacaagaatcaagccaaggctattgtgcaagcaatcaatggggcaaaacacaccaaatggttatgatgatggctcaaattctcacaaaggtaaacttatcactttcaaattgagctttcaaaactatcatgacatgtag

SEQ ID NO: 61625 - DNA, 261 bp, Glycine max
  Peptide Sequence Number=SeqID_153310
atgagaattgtcgaaactggaaatgaaaggttcattgaaaatggtgaaatcagtgggagtacagttccacgagatatggaaattaaagaagatagagtgcaagtccctttagtttgtgcctctagcagtaaggtgattgctcctttagttgttgttcaaaacaataatgaagaagagcaacacaataataagcccatgatatataatgaacctattgtggaagaaccacaagaagtagcattaaggaggtctcaaagataa

SEQ ID NO: 61626 - DNA, 724 bp, Glycine max
  Peptide Sequence Number=SeqID_153311
agggctacacaccctcgccatcagaggactgcatgtcctcaccttcagagggctacacgccctcgccatcagaggactgcatgtcctcaccttcagagggctacatgccctcgccatcagagaactgcatgtcctcaccttcagagggtcacaccccctcgccatcagaggaccacacgtcctcaccttcagagggctacacgccctcgccatcagaggagtgcatgtcctcaccttcagacggccacacgccctcgccatcagagaaccacacgtcctcaccttcgtagggctacacgccctcacctttagaggaccacacgttctcaccttcagagggctacacgccctcgcctttagaggaccacacgtcctcaccttcagagggctacacgccctcgccatcagaggactgcaggtcctcaccttcagagggctacacgccctcgccatcagaggactgcaggtcctcaccttcagagggctacacgccctcgccatcagaggactgcatgtcctcaccttcagagggccacaggccctcgccatcagaggaccacacgtcctcaccttcgttgggcaacacgccctcacctttagaggaccacacgtcctcaccttcagagggctacacgccctcgccatcagaggaccacacgtcctcaccttcagagggctacacgccctcgccatcagaggactgcatgtcctcaccttcaggggg

SEQ ID NO: 61627 - DNA, 204 bp, Glycine max
  Peptide Sequence Number=SeqID_153312
atgcaactcccgaacctttcacttaaagttcgcagaccacgtcttttctggtttttccgacgttttcctcaaataaacgttggtggcgactccgcgtgtattcctttcttggaagatgcaccagcgagtcacacgtcgccctcctgccgaagggtaggttgcgatagttggcgactccgcgggggactgtttttagagagttag

SEQ ID NO: 61628 - DNA, 228 bp, Glycine max
  Peptide Sequence Number=SeqID_153313
ttttgggacttgagtgttttgtgagccaccttgatgttaccctaacatcaagtgttggacctgagtgtgtagagttgatctctaatgttcagagagcaatctctggttgtaaacggtggctgttagatcttcgaactaacactattttagtggatttcctccctggcttggtagcccccagattcaaatataatctgcatgttctgaagcgtgatgtcgtgacatccg

SEQ ID NO: 61629 - DNA, 324 bp, Glycine max
  Peptide Sequence Number=SeqID_153314
atggatctcattgaaaatatggctgcaagatgtaccatctgtgggggagctcatgaatctagatgttgtatccctattgaagaacaaaccactcatgaagtcaattacatgggaaatcagcccagaaactattttattgcaggaggattttctggattccaacatagccagcaatacaatcaacagcagggacaatggaggaaccaccctggaaatcaattcaatagagatcaaggtggaccatccacaaggccacatcaacaagggcctagtctctatgatcgcacaacgaagctggaagagactttagctcagttcatgcag

SEQ ID NO: 61630 - DNA, 78 bp, Glycine max
  Peptide Sequence Number=SeqID_153315
gatcttgccatggggagaacgattggaattactaaagagcagggctgggttatactacttgtagcatgtggacaataa

SEQ ID NO: 61631 - DNA, 633 bp, Glycine max
  Peptide Sequence Number=SeqID_153316
atgtggaatttcgagagctggatctccatgcatgaaagaaagcaagtgcagacgtttctttctagaatgttccaaccgcatactgttttagatgcagatggttatccgatctatcgtagaagaaacaatggtcacacaattgagaaaaatggtgttataattgataacagagtaactgctgttttgattcatgatgataatgatccaactcacaatggtagcactcaaaatgatgagatcaaagaatatctagattgcagatacatatgtccctatgaatctacttggagaatctttgggtttccaatacatggcagaaatcttgctgttgaaagattgcacttccatcttccaggccaacatagtattgtctacgaagaccatgatgatattgatgatgtattgtctaagccaagtatctctgattcaaagtttatttcatggatgaacaccaaccaaaattctgttgaaggaagaaatattacttatacagaatttgtttctaagtttgtatatagtaagaagaaaagatgttggcaccttaggaagaaaggctacaccattggcagattactatgggtctcgccaattacagacgaattattttacttgaggatgagggggatcctctag

SEQ ID NO: 61632 - DNA, 177 bp, Glycine max
  misc_feature (138)..(138): n is a, c, g, or t
  Peptide Sequence Number=SeqID_153317
atggaaaaagacgtggtctacgaatttcaagtgaaaggttccagagttgtatttacgcacggggaaggggaaaagagggaggtggttgccacccagctcgctcaggcaagctcggttgcttccaccagaaggcaccgncttctgttggaagatcctggaaggcccaagtgggtttga

SEQ ID NO: 61633 - DNA, 759 bp, Glycine max
  misc_feature (47)..(47): n is a, c, g, or t
  Peptide Sequence Number=SeqID_153318
atggtagccagatttcacttaccgtgctacacaattgattcccctgnatgcagccaaagcagttggtatgatttcaataatggaaatatagagtatggcattgattttgagccgttgacgctgacggtgtcaagagacaaaaaggtattgctatcacaggatgctaaaagtaatatccattatgacactaaaaatgtagctcaagctgatgaagatattgctgttctgacggtacataaagctatcagggataataagctatcgttattacgcgatcattgtttagcatatgattatgatgatgtctctgacagtaaatatttcattgtcgatgttcgagaggataaacgctatgctatttgtggtggagacccaaatacttctttacatctttttcgttttaaagtcgataagaaaaattattctttgttaactgatgcaggatctgataacggagtttttcatccagttaaaaatcggctttatcatccggaacgaacatctgtgagtgttattaaaattcggcttgtcggtgttgtggcagttatggttttcggcatgatgtcagccagagcagacgtagtgatgtctgattataatagccctgagaaagtttcatccgtttttagcaacaaagatgtactgctgaagctaaagagcattttgggccctgattacgataccttcagtcaaaactttgatgtgtatggtgaaccgcacctgacatcagcagcggattgtttgtggaaggctggttaa

SEQ ID NO: 61634 - DNA, 363 bp, Glycine max
  Peptide Sequence Number=SeqID_153319
atggataaagttgatatctttgtccctcatcctctcacaaacgcatgtaggcttattcaactttcaccggaatgtgggtgtaagccattggtctgtttgctcaagcaacctgcgctcctgagtgttgacttccaagaccgttcaatcagagattactcatcttgcacgttggtgggggtgccggataacccttcccttgtgttcagaatcctctacaacaagagaccacggtctcttaatcccttttcaaaaataagaagaagagaagaagaggtctctcttaaaagagatagattgtacaatgaagatcaatcaaaaattccttatcgaatatgcaagtggttgaccaaggaatctttttga

SEQ ID NO: 61635 - DNA, 408 bp, Glycine max
  Peptide Sequence Number=SeqID_153320
atgtttactaatatactaacccatattcgtctccactgcaacggacactggcagaaggtggtcatcctgcccaaggaacacctagttgtctggttttgttcattgcataacaggccagacaactaccttaagggaattattaacagtgctttaaaaggtcttgatgatgcttcagagcctaaatcaaaggctcttgctaggtggattgtcgtcaagtgtaatagacaaaaaggaagtactgagtgcggctactatgtcatgcactggatgtcaaccatcattttaggaacttttaggaataattgggaagcgtattttaatgatcctagaccattggagccagagagattaaaggcgttgcgaatccagtgggcacagtattatctccgagttagagatcagacctag

SEQ ID NO: 61636 - DNA, 360 bp, Glycine max
  Peptide Sequence Number=SeqID_153321
atggaggttgaggaaccttggttggcgttatggctaccattgaattatcaagtagataatggagcaagtcagcataggacaccgaaatttgggacaggctttatggttgatttagggatggcctttgtggataactgggtggtgggtaaggagagggaatggcagtcacagcatgggtttctcccttattctcaccctctttatttgccccagtttttcctcattcgtccaagtaggatgattaaatttgcctcttttcagacccgctttgatccttttcccgacgaagaccaaatccgcaaagcttcgaaggtgccacttgagctgtcagatccctccacctttgggtgtattctttga

SEQ ID NO: 61637 - DNA, 162 bp, Glycine max
  Peptide Sequence Number=SeqID_153322
atggcgtttttcctaagctacacgaaactgcagaccaaattgcgagacgatccaacggttaacgaagactgggcagcgtttttactgaggcagcttcatgtagcttcctcaggaagcttcattaagaggcttcctcaagaagcttcctcgtggtttctttga

SEQ ID NO: 61638 - DNA, 282 bp, Glycine max
  Peptide Sequence Number=SeqID_153323
atggttccaacaggtgaggtgtgcgttatgccaggtcagtgtgtcagcgactacatggactggttcttccgcatctcgcatcctttcataacaccagaccaggcatcagatcctctgccagatgatatcccacacgtgccggagccaggagcaccgtcgacatctgcgagacccgctgtggaagagcctagacatgcagtgaagtttgccatgggattgctgagagaggttggagcgtcatctgagcctaagggtggtcacgccaggctcatcgacacatga

SEQ ID NO: 61639 - DNA, 591 bp, Glycine max
  Peptide Sequence Number=SeqID_153324
atgttccaagaggacggtccaaacgtaaagacaaaccctcttgccagtcatgggggacccgcggttaatgcggtggaggagtgcggacctcagaggtcaaagcaaatgaaagatgtggtaacctctaggaggtttatattgaaggcactgcgtgaggcaggcatcattttctttgacgggggcgagggggatacctgcttgatacactcaggggtggcgcacaatgtagaggtatgccctatggcagaggatttactgcaagggataatggatcaaggccggtttgaagttggtggcgcaagcaagggggagcaacatgtgtgcatgcaatcggctgacaaaagcccgatcaagcccaaaccattggtgatcaacttcaccagagatgctgccacccaaaagccccgaggcttccagcctatcccgggtaagaagcctgtccctttcccttacaagagtgacaaggcggtcccatggaagtacgcccctcaaaagcccgacggaaggaaggacgagtccattagagatgacttatcctttgccaaggttactaacatctctggcacgagcattatgacccgttgtgggtga

SEQ ID NO: 61640 - DNA, 480 bp, Glycine max
  Peptide Sequence Number=SeqID_153325
atggccttggggttccagctctggttatgggcctctgttagtcctacagggtgcttgtttcccccagcaaggtcatgccatcatgacatagggatcgcgcccgcaagacacccagtggacccggagaagtccaacagggtcttagggtttctagctctgattacgggcctctgtcagttctacagagtgctcgtcgcccccaataaggtcaggcccctattaataaggctttcatcgagaagtactgcgcccccaggcaggcgcagggcaaggcatcacgacagcgggcaacagacgcaccgccaccacctctggagttcacctcagctcatccacaaaaaggttagagtgttgcctacgacacatggccgaccaataggcgaccaagtccaaagccaaaggcgtccagctcaagacgttaaagaagcgctactaggaggcaacctagtaccttttgaatctatgcttgtttcatcctag

SEQ ID NO: 61641 - DNA, 231 bp, Glycine max
  Peptide Sequence Number=SeqID_153326
atgtctcgggcgtcatcctcctcagcttttgttttaccgaagaacactcagaatttagaggcaatctgtgttggccatcaattcttcacggatgggccccatctctcggtccttctgaagcgactatcttctccaactccgggggatgtcccacatcctcatctgtcataccctaatttcgtccggggacctttgcttgatgacatgcgacctttctttggtccttgtgag

SEQ ID NO: 61642 - DNA, 216 bp, Glycine max
  Peptide Sequence Number=SeqID_153327
atgaaaactctcattcagtgccctgcaatgcagccggcttcttactccagattgagcgacgagaaggaattagccctctgcgtccttcacaagattggtcttcgacaccaacccatcattgcgtgggaaccctatctatatagggcaccttggtatgacctaaggtgtgagctgcatgactgtcatccatccatgactggatgcaaactcacttag

SEQ ID NO: 61643 - DNA, 486 bp, Glycine max
  Peptide Sequence Number=SeqID_153328
atgaccgaccctctcgatgggccgacctcttgttttctcataaaggtggacccttatgtactagtacctatcacctttagaggaccatatgtcctcgccatcagaggactgcacatcctctcctgcagagggctgcacgccctcgcctttagagggctacgcgtcctcattttcagtgtgctccatatccacgccttagaagaatataagggatcgcgcccacaagtcgcccagtgggcccgaagaagtccaacagggccctggggtttccaagctctggaatcgcacccacaaagacaccaagtggacccgaagaagtccaacagggccctggggtttccagctctggttacgggcctctgtagtcctacagggtgcccgtttcccccggcaaggtcacgtcatgacataggtaaggatcacgcctacaagacacccagtggacccgaagaagtccaacagggtcttgaagttttcaagctctaa

SEQ ID NO: 61644 - DNA, 216 bp, Glycine max
  Peptide Sequence Number=SeqID_153329
atggaatggagaaggaagagagagaggagatgccacttcaaggagaagatgagtctagaagaagctcaccaccataggaggtcatggataagagcttggaggaagaagcggaaagtaaaagagtatggaagaaggaaacaacacacaagagtttttatactggttcggcaacaacccgtgcctacctccagtacccaagcgacctgcggtccttga

SEQ ID NO: 61645 - DNA, 1773 bp, Glycine max
  Peptide Sequence Number=SeqID_153330
atgctacacgcccttacctttagaggacttcatgtcctcgccttcaaaggattacacgtcctcaccatcagaggactacacgtcctcgccttcagaaggcttctcgccctcccctttagaggactacacatcctggcctttagacggttgcacgtcctggccttcagagaactacacgtcctcgcctttagaggactacactctctcacgtttaaaggactgcatatcctcgccttgagaggagtacacatcctcagctttagaggactacacgtcctcccctttagagggctacacgccgtcgccttcagaggactacacgtcctcgtctttcgagggctactcgtcctcgcctttagagggctacacgccctcgcattcaggggggctacacgccctcgctttagaggactacacatcatcgccttcagaggactacacgtcctcccctttagaaggcttcatgccctcacctttagaggactacaggtcctcgcctgtagaggactacacgccctggacttcagagggctgcatgccctcttcttcagagggctgcacgccctcacctttagaggactacacgtcctcgccttcagaggactacgggtcctcgccatcagaggactacacggcctcgccttcagagggcttctcgcactccccttcagaggactacacgtcctcgacctaagagtactacatgtcctcaccttcagaaggctacacaccctcaccttaagagggatacatgccacccttataggactaaacgtcctcgccttcagaggactacatgtcctcgccttcagagggctgcatgccctcgccttcagagggctacatgacctcaccataagaggactacacctcctggccttgagagggctgcacgcccatgcctttagaagactacacgccctcacctttagaaggctacacgccctcacctttagagggctacacgccacctttagaggactacacgtcctcgccttcagaggactacatgtcctcgccttcagagggctgcatgccctcgcctttagaggactacatgtccttctcttcaaatggctatacacccttgccttcaaaggacttcacgtcctcctcttcagagggctgcacgccctcgcatttaggggggctacacgccctcgctttagagcactacacatcatcgccttcagaggactacacgtcctccccttgagaaggcttcatgccctcacctttagaggactacacgtcctcgcctttagaggactacatgccctcgacttcagagggctgcacgccctcacctttagaggactacacgtcctcgccttcagaggactacgggtcctcgccgtcagaggactacacggcctcgccttcagagggcttctcgcactccccttcagaggactacacgtcctcgaccgaagagtactacatgtcctcgccttcagaaggctacgcaccctcaccttaaaagggctacatgccacccttagaggactacacgtcctcgccttcagaggactacatgtccttgccttcagagggctacatgccctcaccataagaggactacacctcctggccttgagagggctgcacgcccatgcctttagaagactacacgccctcacctttagaaggctacacgccctcacctttagagggctacacgccacctttagaggactacacgtcctcgccttcagaggactgcatgtcctcgccttcagagggctgcatgccctcgcctttagaggactacat

SEQ ID NO: 61646 - DNA, 312 bp, Glycine max
  Peptide Sequence Number=SeqID_153331
atgagcaaacctgaagaagtttggaaccaatgttggcattggctggttgatgacattgcatatcaacatagcaaatcaacaatgaactccaatgaacgaaaaacaatttacgatagaattatccaagttgtcaacaacaatgaaggtgggatgtttttcctatacggatttggaggcacaggaaaaacattcatatggagaacattaacaagttcattgagagcagagaatcaaattcttattatcgttgcttctagcggaatagcttctctattattaccaggaggcataactgcacatttccagatttaa

SEQ ID NO: 61647 - DNA, 525 bp, Glycine max
  Peptide Sequence Number=SeqID_153332
atgccaatttccccctgtagatgtatcggttgggatcgtgcccacaagacacccagtggatccgaagaagtccaacagggccctgggggtttccagctttggttacgggcctttgtcaatcctacagggcgcccgttcccccaacgaggaatcgcacccacaaagacactcagtggacccggagaagtcaacagggccctggggtttccagctctggttacgggcctctgtagtcctacagggtgcccgtccccccggcaaggtcacgtcatcatagggatcgcgcctgcaagacacccagtggacccgaagaagtccaacagggtcttggagttgtcaagccctaattacgggtctctcaagggcatcaggccccctactaatcgagctttcatcaagaagtactgcatccccaggcaggcgcagggtgaaacaccacagcagcctggggatggccagcagcgggcaacggacgcaccgccatcacctctagagttcacctcagctcatccacaaaaaggttag

SEQ ID NO: 61648 - DNA, 807 bp, Glycine max
  Peptide Sequence Number=SeqID_153333
atgcagacgcccctcagcctgttcctgggagacccgctagtgttagaggagggccaagagtgcgagtatagtcagagaaggaaccgggccgatggatttgaggaggaggtcattgcccagctgctatgcataccgggtcaggatttttcccggaccgctgccgggaggcgggtgtggatcatgcgcaccagcatgaccaccttgactcagatgtggatgacgttgttgctcagcaacgtcctgcccagcgatcataactccgacctccctctgccaaagtgtcagctggtgtacgccatcctgacacggatgagtgtccatgtggctcagttgatcgctgacgccatttatttatttgcaggtatgccaccaaccaggcaccctctagacccagataagtctaatagggccctggggtttccagcgttgatcacgggcctctgccagtcattcggggttcccgtcacacctagtaaggtgattcgaccgccgatcacccgggcctttattgagaagtattgcatgcctagacaagcgcagggtgatgcaccgcaggccgtagacgcaccaccaccacctcgtcaggctgatccagctgggtcatttggcatggagcagtatgtacagcacttggttcgccagcagccggccaaccacaggggggcagaggttgcatggcctggagattggcctgaggcctacgcaggggaggcgcccgtagaggctcccgatgatgcagaggagggccgcatggatgaggagatgacaaatttactcaatttcttgggagggagcggagccacatga

SEQ ID NO: 61649 - DNA, 471 bp, Glycine max
  Peptide Sequence Number=SeqID_153334
atgccaatctccccctgcaaaaggatcgcacccacaaagacacccagtggacccgaaaaagtcaaacagggccctggggtttccagctctggttacgggcctctgtcagtcatacagggtgcccattccccctgcgagggatcgcacccacaaagacacccagtggacccagaaaagtccaacagggccctggggtttccagctctggttatgggcctctatcagtcctatagggtgcccgtacccccccggcaaggttatgtcatcatagacacccagtggacccgaagaagtccaacaggatcttggagttgtcaagctctaattacgggtctctatcagttctacggagtacctgtaacctccagcaagggcatcaggccccctactgatcgagctttcatcaagaagtactgcgtccccaggcaggcgcagggcgaaacaccacagcagcattgggatggccggtag

SEQ ID NO: 61650 - DNA, 421 bp, Glycine max
  Peptide Sequence Number=SeqID_153335
atggtggaacagtcaaagaagcgcaagggttcttcgagtagaagccaacggcactccgaggctcaggatactccaattccttcctccatttcctcctcctcattgttctcatcgaaagaacaacgtacatggtacactaacctcttctcctctcgttctatcattgaccctaagttcatagatatggatttcttttctgatgaaagtttcgaatgcattcaagcatttcagaactcaaatctcattccctttatgtctttaaaattgcctgtgtattttgaattggtaaaagctttttattctaaccttgaaattcaagaaagtaccttgattttagaagtctctgggataaagatggtcattgaccaatccttcttctatgatttgacccaattgtctagcgaaggtataccatttgaag

SEQ ID NO: 61651 - DNA, 540 bp, Glycine max
  Peptide Sequence Number=SeqID_153336
atggtggcgcgtgttatgctcaggaacggatttgagcccggaatgggtctaggcaaggactgcctcgggaatgccgacgtggtcgatatcaagggaaatccatacaagtatggattagggtatgaacccgggatgccggggaggaggaacgtgccgtcgagatttcgggcggatagggtatggcccggccgtattagccagtgtttcaccagcgctggaatggtgtccgaggaggaggtggccgcaatagaagaggagttccctcaagacccaccaagttttgtgcaaccatgccaccccgattcccaagtggggaactggcgcgtgataagccaatcagaagtctataccgctgattccacatatgagggtcaattcgttgaggatcctaataacgagggtttgacaatcgatttcgatcgagatataagccaaacgataaatgaggaagaggaagaggacgtcccgtcaccagagttggagaggttggtcgctcaggaagaacgtgaaatgaagcctcaccaagaagaaccgaattga

SEQ ID NO: 61652 - DNA, 213 bp, Glycine max
  Peptide Sequence Number=SeqID_153337
atggcttgcacccacattcccggatttacacgtgattctcctcaaatatcagccagcctgcatcaattagaccttgcaccttacgcttcagagccctacaatgctcaatggaatgccccggggcttctccttgacaagcacacgttgcgttcgagtcgtattctcggagaaatggaggttgatgaaccttggttggggttatgctaccattga

SEQ ID NO: 61653 - DNA, 375 bp, Glycine max
  Peptide Sequence Number=SeqID_153338
atggataaccatcaacatggaaatcatagtgatccagcacaagccaggataaagaaaaaaggtatcaggcagcacaaagttaattatcaggctcagaatattgattctaatattcctgattcatcagaggatgagagttctgaatcaacacaaggctctgcttcagtttcttcacctgaaaatcaaaactatatgtcctcagttaatgaggctgcaattaatagagaagggtattctgacttggtgaccaactcatgtagtgtagccactgtaatgcaaatatgtggtatgatgaaagaatctcttaatatggaagaactacatatccaagattcaacttatgttgtggaggtggtcagagagggacttccacag

SEQ ID NO: 61654 - DNA, 345 bp, Glycine max
  Peptide Sequence Number=SeqID_153339
gtcgacggtatcgataagcttgatgcagttggtggtatacccctgcaaaacacttgggagggccctcagtatcacccacaaccacaccccccacattccacaacaagtaaaaaccttcatgctatggcggaaatgggaaagttggatcatctagaggaaaggctcagggccattgaaggaggtaaagattatgcctttggtaacctagaagagttgctcctagtacccaatatcatcacccctcccaagttcaaggtgccggactttgacaagtacaaggggactacttgccccaagaaccatctaaagacgtgttgtcatatgcaaaagatgaggaactgttga

SEQ ID NO: 61655 - DNA, 303 bp, Glycine max
  Peptide Sequence Number=SeqID_153340
atggaccctaagagaataaaggtcattcctgagtggcctactccaccaacactactcattgagttggtgaggaactatattctctcatgggaagatggccaggaaagaggtgttgaggaaagaattcctgagtttcaagaacctctggatttgaggtcaaatccttttcaagggggagggaatgatgcaatcctacccataagggcattggatagaagactccaagaagattgggcgagagatgcaagagaaggccctagggttctcatgagccttaggatagattttaggcccatgggctaa

SEQ ID NO: 61656 - DNA, 201 bp, Glycine max
  Peptide Sequence Number=SeqID_153341
atgaatctggggatcccacggtcatgtggctccgcatgccaccagtctcttgggacacgtctcggtgttttcttcaccaaaatgcgaacatgctttagtaaagagacaaaacttccaactgatcagagcaacatatgcttttggatgaaaaacaaagtgtctatcggggaaggagagtatgctgatgaaatcttctcataa

SEQ ID NO: 61657 - DNA, 333 bp, Glycine max
  Peptide Sequence Number=SeqID_153342
atgctttatactggacaattgaagaggcataagtgcaaaataggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 61658 - DNA, 156 bp, Glycine max
  Peptide Sequence Number=SeqID_153343
atgaaccctaagagaataaaggtcattccagagtgccccactccaccaagtgtcgagggaaggagcctagagtatgaagaacctcgggatttgaggtcaaatcctttccaaggtggaggggatgatgcaatcctaccccccaaaaattaccattaa

SEQ ID NO: 61659 - DNA, 563 bp, Glycine max
  Peptide Sequence Number=SeqID_153344
tcaaggtgttccttttgagggcactctagttgatgattggaagcatgtctattctagtcatgatgcctgtaaaatggtctgtaatgaccatgctgatatgaccggcagattgcttgccagctcattcacctttgagtgtcgcatcatgcattatatcctttgtcgagttttgcttccacggtaccgtatgcataaggcattacgggccaatgcacctctttcgtatcctcatcctgtcactttgtttcatcagcatttcaatgttcctttagaggatgaaccttttgttaaggttaaaagatcatttgctattggtgttgttgctattacctccttcggatactggaaggatatggatggccaatgggtgtgtaaacaagacctgccacctcccattcctgatgaacgcacaccctccccaccaccgcatcgcgatacctcctcttccttattaaatgatgttctcactgagctacgggatcttcaggctttcgtcggcgatcgctttgatgcaatggactcacgcatcacgcgtcttgaagacgacatgagcttcattcgac

SEQ ID NO: 61660 - DNA, 105 bp, Glycine max
  Peptide Sequence Number=SeqID_153345
atgtgggacaccttaggggttcccatgaaccctaagagaataaaggtcattcctgagtggcccgctccaccaagtgaagaaaaatttggggcttccaagacttaa

SEQ ID NO: 61661 - DNA, 55 bp, Glycine max
  Peptide Sequence Number=SeqID_153346
atggatagtgtgcctgcatatacatctatcttagttctagcagttaacataaagg

SEQ ID NO: 61662 - DNA, 453 bp, Glycine max
  Peptide Sequence Number=SeqID_153347
atggcagcgcagttgattcatgatcgcgttgtgatggagtgcctagagggtgtttgggagaccctcgaaggcaatgagaggtgccgattccgtggcacaattcgactcactgctacttcattagtacatccggaggaacccgcacgcacacttcagcaacctgtggagtggatactacctacacctactccatatcgactagttgagtcagttcaagtgatagaggtgtcattctctgaagaggatcttgaagaggacccagaggagttacctcctgaacctgctatggatgcccttcacttacctgaggatgatgaagacccactccctgatgttgattctccagaggataatatgtcagcatctgaggcaggctttacagaggagagtggccctggagggacaacgattattcagactgctaggttaactcttttgattttgggtgggtag

SEQ ID NO: 61663 - DNA, 283 bp, Glycine max
  Peptide Sequence Number=SeqID_153348
gtaatccttgtgcgttctaccgtgactgatcttccttcaactggaagtgcgttctacccggacttatcttccttcaccggaagtggcgtctaccctgacttatcttccttcaccggaagtggcgtctaccctgacttatcttccttcaccggaagtggcgtctaccctgacttatcttccttcaccggaagtggcgtcatccagaaactctacagcctgtatcaagtgatccgccccgtaaggttcacatcatctggtatcagagcttcggctcttgatactg

SEQ ID NO: 61664 - DNA, 505 bp, Glycine max
  Peptide Sequence Number=SeqID_153349
atggattgctggggatgtctgactgattgtccttcagaacaacagtttgatgaatgcctaaagaagttcgaaatggcttgcgcaccttggccaattttttcagaccaagggttatttgagcccgaggtgagcatcaaggaagtaatggaaacaatatccaaaagatttaaagaacttgatgtttgtggaaagtttactctgaagactaaactttgggaaattgcataccctgatcagaattcgatgtgtcctcctccaacaaaggttaacacaaaaggggcaccgaagaaagctatgagcaggaacccaaggtcaacaaagcgcgatccatcttactgggagtatgtagatgcctttgaatctatgcaaaatagcaattcatcggtgaggcgtactgcatcatcctctgagcaaccgaatcaaagaacgatgatgcccatgttggaccaatttcagccatttatgcacgacttcattgataagattgttgatgtcaaagctgatg

SEQ ID NO: 61665 - DNA, 123 bp, Glycine max
  Peptide Sequence Number=SeqID_153350
atggcctttgtggataactgggtggtgggtaaggagaaggaatggcagtcacaacatgggtttctgcctcattctcaccctcttcatttggccccagttttctcattcgtccaagcaagatga

SEQ ID NO: 61666 - DNA, 321 bp, Glycine max
  Peptide Sequence Number=SeqID_153351
atgactgaccctctcaatgagtcaatctcttgctttctcataagggtggacccttgggtactagtaccctcaccttcagagggctacatgtcctcaccttcagagggctacatgccctcaccttcaaagggctacacgccctcgcctttagaggactacacgtcctcaccattagaggactacacgtcctcaccttctgagggctacacgcccttaccttcagaggactacacgtcctcacctttagaggactacacatcattgccttcagaggactacatgtcctccccttcagagggctacatgccctcgccttcgtag

SEQ ID NO: 61667 - DNA, 327 bp, Glycine max
  Peptide Sequence Number=SeqID_153352
atgacaccaagccacgcattagatcctctgcctcatggtcacgccctgcagccccgagtcgtccctcaggccccgcagacggatatccctcacgtgccggagccaggagcatcgtcgacatctgcagaggagcctagacatgcagtggtaaaagtttttgatgacattgctaagaggttggagcgccatctgagtctaggggtggtcacgcctggctcatcgacacatgaggtgatcgaagaatgcctcaggttggccaggagtgtgacacaagaccatctagtatatgttaggtctagacgcaggcagcgcacggatcaggcgtag

SEQ ID NO: 61668 - DNA, 350 bp, Glycine max
  Peptide Sequence Number=SeqID_153353
gtatgccacccaccaggcactctctagacccggataagtctaacagggccctagggtttccagcattgatcacgggcctcaaccagtcattcggggttcccgtcacacctagtaaggtgatccgaccgccgatcacccgggccttcattgagaagtattgcacgcctaggcaggcgcagggtgatgcacctcaggccgcaaacgcaccgccaccaccccatcaggttgatcccgctgggtcattaggcatggagcggtatctacagcacttggtttgccagcaggcggccaaccaccgggggcaggtgcagatacatgagtgtctctaccagcttagcctcagtcagtag

SEQ ID NO: 61669 - DNA, 372 bp, Glycine max
  Peptide Sequence Number=SeqID_153354
atgacgaagagtgttggacttaagaagaaagttcttgaagagaaaggtactgatggtaaggaaaatgatgagcaagctgtgaatgaagttgcggaagtaccatatccagtggtaccttccaagaaggagaaggaccatcatttggtgagatttttagatattttcaggaaactggagataaccatgcccttcggagaagaattacagcagatgccactctactccaaattcttgaaggatatgccaattcaacaaaggcctaatatctttcagaggactactaagctggaggagactttgactcagtttatgcagataacaatgtcaaatcatgaaagcactgagtcagcactgaagaaccttgaggtccag

SEQ ID NO: 61670 - DNA, 231 bp, Glycine max
  Peptide Sequence Number=SeqID_153355
atgttgcggaacttcacggattacctaacgatgagtgttaagtacctcgaggcggtcaagcgaaggttgcatgccaccaaacaatggtccccggacgaaattaggaaaatgatgcaatcctacctcgcaagggcattggatagaagactccaagtagattgggccagagatgcaagagaaaaccctaggattctcatgagccttaggatagatttcaggcccatgggctaa

SEQ ID NO: 61671 - DNA, 228 bp, Glycine max
  Peptide Sequence Number=SeqID_153356
atggtggagctcatgaatcaggctgttgtattctcactgaagaatcaacacatgaagttaattatatggggaactagccaaggcagaattttaatgcagcaaaatcagtggaggactcaccttggtaatcaattcaacaaagaccagggtggaccattaaataggccaccacaacaagggcctaacctctatgagaggacaacaaagctggaggagacttttgcttaa

SEQ ID NO: 61672 - DNA, 744 bp, Glycine max
  Peptide Sequence Number=SeqID_153357
atggaggcgggcgtggtgctgcgcaatcagcggttgaaaacgcgtgacggatgggtggtgcagctgcgtcagggcgagcgtgaaggctggggcgagatcgcgccgctgccggaattcagccgggaaacgctggcgcaggccgaacaggccgcgttggactggctgcaggcctggttggcgggcaacgaaccggatgacagcgcgctgccttcggtggcctttgggctcagctgcgcgcaggccgagctggagcagcgcttgccgacgcaggcggatttccgcaaggcgccgctgtgtaccggcgatccggatgagctgttcgagacattgagcgccttgccgggcgagaaagtcgccaaggtgaaggtggggctgtatgaggcggtgcgcgacggcatgatcgtcaacgtgctgctggaggcgctgccggatctgcggctgcggctggacgccaaccgcagctggacccgcgccaaagccgacggcttcgccaaatacgtcaatccggcgtggcgcgatcgcatcgcctttttggaagagccctgcaagacccgtgatgaatcgcgcgatttcgcccgggcaaccggcatcgccatcgcctgggatgagagcgtgcgcgaggcggactttgtggtgcaggccgagccgggcgtggcggccatcgtggtcaagccgacgctggtcggcagcctggcgcgctgccaggcgctggtggcgcaggcacacgcggcggggctgacggcg

SEQ ID NO: 61673 - DNA, 509 bp, Glycine max
  Peptide Sequence Number=SeqID_153358
atgggtgaagtagaggaggtgcaagagcagatgaaggccgacatggaggccatgaaagaacaaatggccacaatgatggaggccatgatgagcttgaagaagataatggaagccaatgcggttaccattgccgctaccagcactgttgctaaggtgaacccgatgcccccatctggcctcaaccaaatgaatcatccaaccttagctatgacacatgaaattccccaccgcaatctagccgacttcgagccttgcctcggatatgccactgaagggcaagcatttggtggtatacccctgcaaaacactttggagggccctcagtatcacccacaactacacctcttgcattccacaacaagtaaaaaccctcatgctatggcagaaatgggaaagttggatcatctaggggaaaagctcagggccattgaaggaggtaaagattatgcctttgctaacctagaagagtacttcctagtacccaatatcatcacccctcctaagtcaag

SEQ ID NO: 61674 - DNA, 440 bp, Glycine max
  Peptide Sequence Number=SeqID_153359
agcttcggtattcaattccgagcgtctcgacatattacgggactcaatcggacatccgagtaaaaagttattgtcgtttgaatttgctcagagcttcgcttcggtattcaatttcgagcgtctcgatatattacgggactcaatcggacatccgagtaaaaagttattgtcgtttgaatttgctcagagcttcgcttcggtattcaatttcgagcgtctcgatatattacgtgactcaatccgacatccgagtaaaaagttattgtcgattgaatttgctcataacttcgagcttcggtattcaatttcgagcgtctcgagatattacgtgactcaatccgacatccgagtcaaaaggtattgtcgtttgaatttgctcagagcttcggtattctatttcgagcgtctcgacatattacgtgactcaatccgacatccga

SEQ ID NO: 61675 - DNA, 354 bp, Glycine max
  Peptide Sequence Number=SeqID_153360
atggaggccatgaaagagcaaatgaccataatgatggaagccatgatgagtatgaaaaggatgatagaggtcaggaagccaagcgttgggaagtacgggcaaccccattttgtgcaggtccagagtaaggattccttcccaccatatggcttgcctcccaactatatgccacccaatgttgcacacactcccattgagaatgtcgataactctgctcccatacccattgagagccaacatccccaatctggtcatgcacaggtctctcaacccataggggagacacatgaagcaccccgggaccacaatctagtcgattccgagcctcatgtaggatatgctactaaggggtag

SEQ ID NO: 61676 - DNA, 375 bp, Glycine max
  Peptide Sequence Number=SeqID_153361
atggatatctctgaagatactgacatccctgtaatattaagaaggccattcatgttgaccgcaagctgcatagttgatatgggaaagagaaagctggagctaggttttgaagatcagaaaattgattttgatttgtttgttaaagacaagcctgctccagaacacaatgtctgcttacaggtaatggaaggaggtcaagaggttctgaaactttgcgctaagtgcatctttggtcatgtgctaagccgagagtctcaagcgcttagcactcaacccttgcatctgaggctgatttggtcagctaagctggccaaggatgatcttagccaacttcaattcgatctaaattcggctaagctacaggctgatcgctaa

SEQ ID NO: 61677 - DNA, 219 bp, Glycine max
  Peptide Sequence Number=SeqID_153362
atgcctataggttggacctcccagaagagaggagctgatattgaggaggaggaactaacagatttgagatcaaatcctcttcaaggagaaggggatggtgcaatcctccctaggaagggacctgtcactagagccatgagcaagaggctccaagaggattgggctagagctgctgaagaaggccctagggttctcacgaacctcagggtagatttctga

SEQ ID NO: 61678 - DNA, 180 bp, Glycine max
  Peptide Sequence Number=SeqID_153363
atgcgtcccataacggctatgcacagtcaaaatgtctttttcaagagattcctctctggagctcgcctgcttaggtacgtcacaggttctcactggctgactatgcccgggttgggttgggattggtcaagcttggttttgggcaatagcaccccacctgacgtccccaaggtctcctga

SEQ ID NO: 61679 - DNA, 461 bp, Glycine max
  Peptide Sequence Number=SeqID_153364
agcttcaacattcaatttcgagcgtctcgatatattacgggactcaatcagaaatccgagtaaaaagttattgtcgtttgaattggctctcagaggttcaacattcaatttcgagggtcccgatatattacgagactcaatcagacatccgagtaaaaagttattgtcgtttgaattggctcagaggttcaacattcaatttcaagcgtctcgatatattacgggactcaatcagacatccgagaaaaaggttattgtcgtttgcattggctcagagcttcaacattcaatttcgagcgtcccgatatattacgagactcaatcagacatccgagtaaaaagttattgtcgtttgaattggctcagaggttcaacattcaatttcgagcgtctcgatatattacgggactcaatcagacatccgagaaaaagttcattgtcgttagaattagcctactcag

SEQ ID NO: 61680 - DNA, 156 bp, Glycine max
  Peptide Sequence Number=SeqID_153365
atggaatttccggaagagtcactcgtcagagcagaggaagggaattcggaactcaatcaccaagttaaccttcccattgtctatgccagcaacaaaggaagagctgtcaccagcagtggagctcttcctccttgttttgtgcgagttaagaggtaa

SEQ ID NO: 61681 - DNA, 513 bp, Glycine max
  Peptide Sequence Number=SeqID_153366
atgaattccgggaaagaacaagatgatgcttcaatgtttagtgatagtcaaagtgttataagtcttgcgaagaatccagtcttccattctagatgcaagcatattcaattaagataccattttatcagggagttgatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 61682 - DNA, 402 bp, Glycine max
  Peptide Sequence Number=SeqID_153367
atgacccacgatcaagagcttttcagagagttggacatttcacaagtatcaaaagttagaatcggaaatggtgatcttatcactgttgaaggaaagggaactgtagccattgaaagttgcacagatgtcaatgacaaggaaatttccagtatcaaaaagagaggtaaaagtttctcatttgatccactgaatgaggagcgagcagcctatccagccactgtaaacagtacagaggcttggccaaaagatgatttcaccagaatgtgcttgatttattttctcaagtctaagtcagaggttgcaggtgtattttggagatttaagcattggattgaaaaacaaagtggctgcatgattcaagctttgaggtctgataatggcaaggagtacacttcagcataa

SEQ ID NO: 61683 - DNA, 378 bp, Glycine max
  Peptide Sequence Number=SeqID_153368
atgactaccaatttgtcggagtctgttaatttcatgttcaaaaacacaagacatttgccggtgtcatcattggttgaggagacctatttcaagaccgcacaactctttgctaatagaggtcgacaaactcaggcaatgatcaactccggctcacagtattctgaagtcgtcttcgatgcaatcaatagtgaatatgaaggagatcagtggggtcctgatccaaggagaaagaggactgcaaagggtcgtcccgtttcaactcgcattcctactaagatggacgaagacgaaaatgaacgagcaagtagaaaaaaatgtggactttgccggcaacatggtcatagcagaaataattgtcctaatgtatcctcatcttag

SEQ ID NO: 61684 - DNA, 273 bp, Glycine max
  misc_feature (171)..(171): n is a, c, g, or t
  Peptide Sequence Number=SeqID_153369
atggatgattttactgaggatgaggatcaacagttctttgatcacatcaataagcaaagcgatgaccaaaccgatgacgaggaacaatttactctgaccaaagaaggctacacttcgtctgcaagttacatgaaaatggttgtacatggagcttgggcgcatgcaattcanagaggcataacaaatggattatcaagagtatcagaggtcatcacacttgtctcgtgccgatgcttagacaagatcatcgccaactcgacaaacacatcatag

SEQ ID NO: 61685 - DNA, 330 bp, Glycine max
  Peptide Sequence Number=SeqID_153370
atgatgttcttacatatcaagtggtatcaggcattgaatgaatctcctattagacataaccagtcccctaaagttacctcagaagttatggccatcgctgaagatattaatgacatgtcatttatcagtgcacaattagctgaagtcacctcacatacaacagaccttggacgtgatggctgggagaaggctgaaaatgaagggacaagtttaaagaagcaagtccaggcactgactctcagaaattcaacacttgaagatagagtcacctatctagacagtgcagttaaggagtgtgttaggcagctaagacaaacaaggtgtttataa

SEQ ID NO: 61686 - DNA, 93 bp, Glycine max
  Peptide Sequence Number=SeqID_153371
atgtcattaatatcttcagcgatggccacaacttctgaggagattcattcaatgcctgatgctgcaaagacaagaaaactagagttatcataa

SEQ ID NO: 61687 - DNA, 450 bp, Glycine max
  Peptide Sequence Number=SeqID_153372
atggagaggagtatgattaatgctgccagtggtggagctcttggtgatatgacccctgctgaggctaggaatttgattgagaaaatggcttctaactcccaacaattcagtgcaagaaatgatgctattgtccttagaggagtccatgaggtggccacggattcatcttcatctactgaaaataaaaagcttgagggaaaacttgatgccttgcaatctagagtcaatgagaaacctaaagcttatgctgcaaacatttataatagaccccctcagcagaaaaaccaacaacagcagaataattatgatctttcaagcaacagatacaatccaggttggataaatcatccaaatctgagatgggtaagtcctccacaacaacaacagcctgtccctcccttccagaatgttgctggtccaagcaagccatatgttcctcctccaatatag

SEQ ID NO: 61688 - DNA, 47 bp, Glycine max
  Peptide Sequence Number=SeqID_153373
atgcagtatctaggaagtgatcctaggtcgtctcgcaacgagcaatg

SEQ ID NO: 61689 - DNA, 285 bp, Glycine max
  Peptide Sequence Number=SeqID_153374
actaaacgtgactctcatggaaaccttgaacattacaaggctagacttgttactaagggatttactcagaaagatgacattgattataaagagacattttctccgcttgtaggcctaggatcttcttcatcaatggattcctttgcttcttggaagatgaataaaaacgcaatggagaaggaagagagagaggagacgccaattcaaggagaagatgagtctagaagaagctcaccaccatatgaggccatggataagagcttggaggaagaaggagatgaatga

SEQ ID NO: 61690 - DNA, 369 bp, Glycine max
  Peptide Sequence Number=SeqID_153375
atggcggagcgtggccatggaatgaattacatgccacaaacatttgctcagtatccgacacaaatgtatcagtatccttttgaaggtcatcacactgatacttctgcaagcgaacatttgtttggtggtgttgtggaaacacatcctcatttttcatggtcgactatgaccccttcacagcaatatcatggcccaattccaacacctaatgtcccattaggtgttgatttgcgtcacaaattttctgctgaggctgaccaaatagaagcggggagacatcggggcagaagaaatcctgatcgccaagctcgaagatgggatcgaccatgtggcacatcctcacgtcaccacggacatcataatgaatga

SEQ ID NO: 61691 - DNA, 417 bp, Glycine max
  Peptide Sequence Number=SeqID_153376
atgagtcatcgttcatctagagttaatggtgagggtactggtcataaggaccctctatttagaatcttagatgagttgagttccctcaagttatggaaagaaaaactagaaagaaaagaaaaaggaaaagaaaggatagaaataaatcaagatgagagggaacaaataagggaagaagaaagaaggaaaatactaaaagaattaagaaaagaaaaacatgcctcctatagtagtcatgacccttgcaagagcctaagtaaagaacttcgtgactattgtgaaggaaggcataggtcacatcttagacctcactctcataggatagaaaaggaaagaaagtctcaagaggctaacattaacctcccatacttccatgggaaggacaatgtagaggcttacttagattgggaaataagg

SEQ ID NO: 61692 - DNA, 177 bp, Glycine max
  Peptide Sequence Number=SeqID_153377
atgctaaatgcgaggggtatttatcttagcttagacataatatcgaaattcccaatggtgagaatgctcgtaattgggttgcgaacatggtgctcaaatttcacgacgatccaacggaaaaagagagggttttgggagaagagagaagaaacaacattgcgaggtagaggaggctga

SEQ ID NO: 61693 - DNA, 635 bp, Glycine max
  misc_feature (128)..(128): n is a, c, g, or t
  Peptide Sequence Number=SeqID_153378
atatcatgatcacttgaaaaagggagttgatgctgttccgaatgacaggagagctgaatgggaaaagctggattttcagttgtgtgcagtgctatggcaatctgttgaatcggatgttttggagatcnttagatcattcaaaacatgttgctctttttggaagaaagcacaagagatatttgccaacgacattcaaagtaaagctagagcagcagtggaagaactgaagagatttcttgcagcaaaatcgttggaggaagtgaataggaagctggacaagttctacatggtccttatcttgagaagtctacatttagattttgataatgtgcgtgatcaaattcttgcaggtgaccaagtcccgtcaatggactccctcattactagacttcttcgcgtgcctcaagccttgaaagaagaaaatttagctgaaagtgtggaaacatcagctatggttgcatctcgtggaagagaaggaggtcgcaacaatagaggagactgtggtggaaggagtggacctcaggtagctcagaccgaaaaatcagagcctaagttctctgatacagagtatcaggagtatctaaagctgaaatccgagaaatccagcagtcaggcttcatcttcctctgtaccat

SEQ ID NO: 61694 - DNA, 153 bp, Glycine max
  Peptide Sequence Number=SeqID_153379
atggtgacgtattatggatgcaagttaagcatgtttcagaacatgtttggaatggggaagaagaccggaaattacacatcagaggagttgtccctacgtattaaggggaagaagaaatcccagaggaaattattcatttccttcgacaatctg

SEQ ID NO: 61695 - DNA, 346 bp, Glycine max
  Peptide Sequence Number=SeqID_153380
atgcgtgctttgttagggtcattcaacagtggaaactggtctgactctaaagtccttgatagtgcagggctaagttgtcgtgctttcacgaggaatcaatctcccacaagcaatttagttcctctggacttagaaattgaagctacgttgcgaaggaacagggccgagaggagaaggaaacttctgcaagacagaatagttgcatccattcttgaggagaagactcatttctccgacttattatcacctgattcaccgtcatcaagggaatctgccactcaattacctgaagccattaccatggtagaagagcatgaccagaggattacccttgaggattattcaa

SEQ ID NO: 61696 - DNA, 234 bp, Glycine max
  Peptide Sequence Number=SeqID_153381
atgggtaatatcgatttaaagaagcttgcttatcagaatgagcctttcatcatggcaaacaaactaaacaagtgttttatattcaagatccttgtgatgaaaggtgatgatgattcaatcgttgatacttgcgttagtcctttctccacacaaatgccgcctaacgtcaacggagaagaagaagttgacgacgtccatgcaaattgtaatgatcatgatgaaggagaattttaa

SEQ ID NO: 61697 - DNA, 237 bp, Glycine max
  Peptide Sequence Number=SeqID_153382
atggcatcagaatggagaaggaagagagaaagcagacaccacttcaaggagacgatgattctagaagaagctcaccaccataggaggccaaggataagagcttggaggaagaaggagatgactgaagggagaggaagagaagagcacgaaattttgtgctctaaaagagctctgaaatttatggttcagcccactaatccaagatcaattccaagattctccactaagtgtgcttag

SEQ ID NO: 61698 - DNA, 153 bp, Glycine max
  Peptide Sequence Number=SeqID_153383
atgtttgcttacagtcctttcgctaagcgcaagcctcgcgctaagcgcatctctgttcatgcgctaagctgcgagtctcaagcgcttagtgcccaacccttgcatctgaggctgatttggtccactaagctggccaaggttgagctaagctaa

SEQ ID NO: 61699 - DNA, 243 bp, Glycine max
  Peptide Sequence Number=SeqID_153384
atgaagaagattcaaggcctacaagttccacatggagctacatcagttaaggtgtctgatgaagaactagatgatgcaatcctccctaggaaaggaccagtcactagagccatgagcaagaggctccaagaggattgggctatagctgttgaagaaggccctagggttctcatgaacctcaaggtagggtaccctaaaaatataggatatttcagcccttgtattttagggcacctagactag

SEQ ID NO: 61700 - DNA, 423 bp, Glycine max
  Peptide Sequence Number=SeqID_153385
atgaaaagagaaaaacatgtctcctatagtagtcataactcttgcaagagcctaagtgaagaacttcgtgactattatgaaggaaggcatagatcacatcttagacctcactcccataggagagaaaatgaaagaaagcctcaagaggttaacattaaactcccatacttccatgggaaggacaatgaaaaggcttatttagattgggaaataagggtagagcaaaaacttaaaagaaagcctactttaaaatcttatggctatcattcttatccaaagaaagaccaaggtctaggcatcttaggggcagcaccttctaagcccaatgatgataaggggaagacaatagaaaagcaaccccctaaggctagtatgcaagaaaagactagctccataaagtgctttaaatgtcttggaagatga

SEQ ID NO: 61701 - DNA, 781 bp, Glycine max
  Peptide Sequence Number=SeqID_153386
aggactacacatcatcgacttcagagggctacacgtcctcaccttaagagggctgcacgtcctcacctttagagggctgcacaccctcgccttcagaggactgcatgtcctcgcctttaaagggctccaggtcctcgccttcagagggctgcacgccctcgccttcaaaggactgcatgtcctcacctttagtgtgctgcacgtcttcaccttcagagggctacatgccctcgcctttagaggactgcacgtcctcgccttcagaaggctccaggtctttgccttcagagggctgcatgccctcgccttcagaggactacatgtcctcaccttcagagggctacacgccctcgccttcaaaggactgcatgtcctcaccttcagagggctccaggtcttcgccttcagagagctgcacgccctcgccttcagtggactacacgtcctcgccttcagagggctgcacgccctcgccttcagaggactgcacatcctcaccttcagagggctacacgccctcacctttaggggactgcacatcctcgccttcagaggacttcatgtcctcgccttcaaagggcttcatgtccttgccttcagagggctacacatgctcgccttcagagcacggcacgtccttgcctttagagggcaacacgtcctcactttcaaagggctccacatccgctcctttagagaactcaagttcctaggccacccccctgatctcgaaggaaggccaactatgtgggcacaaccagaggaggaggcatgtctctag

SEQ ID NO: 61702 - DNA, 363 bp, Glycine max
  Peptide Sequence Number=SeqID_153387
atctgctgcagttgatttgattcccattgatttggagattaatgccatctgtagaaagcgtaattcagagagaatcagaaattttttgcaagatttagaagcagcagcaacttcagaagaagaacctcgatcttctgaggcatcttctagttttcctgttgcaaggcattctcatatagaacctattgaagatacaatcatggctgaagagccaagaagagtaaccttggaggattactcaaatccgtatgcacacctagccacttacattgaaatatgcaatactattaggctagctggtgtgcctgaagatgcaatccgattgagcttgttttcattctcactatctggagaagctaagag

SEQ ID NO: 61703 - DNA, 252 bp, Glycine max
  Peptide Sequence Number=SeqID_153388
atgtcaagattcataagcgattctcctcaaatttcaaccagcctgcatcaattagaccttgcaccttatgctttagggtcctacaatgctcaatggaatgcctcggggcccctccatgataagcacatgtcccattcgagtcgtatcctcagaaaaatggaggttgaggaaccttggctggggttatggaaaccattgaactatccagtagatataggagcaagtcagcataggacaccgaaattggggtga

SEQ ID NO: 61704 - DNA, 370 bp, Glycine max
  Peptide Sequence Number=SeqID_153389
atggtactggctgagggagagtacttgcccgtttactccagatactgtaggatgcccactgatatcagagagattgaggctgctttgtgtatacccggtcaagggtttgttttaaatgctgaaggccatcctaggaagatcatcaggaaagatctggcaactcttgctcgggtttggagtgttctctcatactccaacctggctccgacttcccacacctcggatttgacaatggatagagctaggttaatctttggcctagtctctcagctggacatgaatgtaggagctctcatatctggccagatcacatctatggcccagtctaactcctctagacttggattccctgctcttatcacagctctat

SEQ ID NO: 61705 - DNA, 546 bp, Glycine max
  Peptide Sequence Number=SeqID_153390
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagaaatggagtagtcggagtaccaaggaagtgtttggaggaaaagggcaaaggccttggcaaaatcaaggcgaatgggcttcttttattgacatcttggcgcttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtaaaaagagtgatgcaagaattgtttgttgtgcactggctctctaa

SEQ ID NO: 61706 - DNA, 228 bp, Glycine max
  Peptide Sequence Number=SeqID_153391
atgacagtggaaggagaaggaagagataggagacgccacttcaaggagaagatgagtctagaagaagctcaccaccatatgaggtcatggataagagcttggaggaagaaggagatgaatgaagggagaggaagagaagagcacgaaattttgtgctctaaaagagctttgaaatctgaacccactaatccaagatcaattccaagattctccactaagtgtgcttag

SEQ ID NO: 61707 - DNA, 300 bp, Glycine max
  Peptide Sequence Number=SeqID_153392
atggtagcggaatggagaaggaagagagagaggagacgccacttcaaggagaagatgagtctagaagaagctcaccaccataggaggccatggataagagcttggaggaagaaggagatgaatgaacggagagggagagaagagcacgaaattttgtgctctaaaagagctctgaaatctgaagattgcatcaggaggccaatggcatattgtggcattgtcacaattcacgatgtggcgggcattatggcggagacaaaacagcagctaaggttttacagtcaggatttttttggctga

SEQ ID NO: 61708 - DNA, 264 bp, Glycine max
  Peptide Sequence Number=SeqID_153393
atgggaagggctacttatgctgccaggtctctccaccgttgtgcgtattctttaaagctgagtgcgatcgggagtgtcgcaacctacccttcggcgggagggcgacgcgtgactcgcaggatgcgtgttccacgaaaggaatacgcgcggagtcaccaccaacgtttatttgaggaaaacgtcggaaaaaccggaaaagacgcgatctacgaacttttaagtgaaaggttcgggagttgtatttacgcacggggaaggtattag

SEQ ID NO: 61709 - DNA, 456 bp, Glycine max
  Peptide Sequence Number=SeqID_153394
atggtcatatcttttaactcgcatgtccgattcaggcgcatagcgtatcgagacgctagaaatctaacaacggaagctctcgagaaattcaaatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 61710 - DNA, 111 bp, Glycine max
  misc_feature (62)..(62): n is a, c, g, or t
  Peptide Sequence Number=SeqID_153395
atgtgcagcgccaccgattacaaagttaaatcaatcggaggtggttgcgacgtggaaatcancatattggcaatgatgatcttagacttttccgtcgcaaattggatttga

SEQ ID NO: 61711 - DNA, 312 bp, Glycine max
  Peptide Sequence Number=SeqID_153396
atgacccatgctgtcaaggaccatcgagggaaatgggccccgaactacgaagggccttttgttgtgaagagggctttttccggaggagccctggggcaggatcgccttgggctaccttttggagtgaagacaaaacatgaacggcagaaaccagtcaaggtgcttaaggatgaacgcaaccggggatggggtcacgaccgaccgatcgttacccttctctgtgcgaaacaagcagggaatgtcgctgcaaggcagccccgtatcctttgtattttgcagctttcttttactatttgtttgggaaaagagtaa

SEQ ID NO: 61712 - DNA, 246 bp, Glycine max
  Peptide Sequence Number=SeqID_153397
atggcagccccgaactttcaaaaagggccatcccacggatttcgagtttgcagccctagggttctttttccggagcttttgattccatctggtgcttgtctcaccaacagaggccaggatcatcttgagctaccttctggggtggggaccaaacatgggcagcagaaaccaatcaaggtacttaggaatggatgcaagtggggatggggtcacgaccgactgatcgttgccctttccctgcgctaa

SEQ ID NO: 61713 - DNA, 217 bp, Glycine max
  Peptide Sequence Number=SeqID_153398
gctaccgtcccttgtgacggacgtgtggggtgctaataccttccccgcgcgtaaatacaactcccgagcctttcacttaaaagttcgtagatcgcgtcttttccggtttttccaacgttttcctcaaataaacgttggtggcgactccgcgcgtattcctttcgtggaacacgcatcccgcgaaaaaacgttgtcgctcttcccgcccccagggtag

SEQ ID NO: 61714 - DNA, 243 bp, Glycine max
  Peptide Sequence Number=SeqID_153399
atggaaaaatccgacaagaggaatctcaaagaaaagaaagaaaataaaggatacatcacttgggaagataatgttataaattcttcaagtgattcagagaataaaatcataagtctgggtatcatgatgaaagactatgaaaatggaaaagagcaaagtcgatacagtgatagtaatttctccaaacacatggcatgcatcaaagtttattcatatttctccccaagaaaagtggatatgtga

SEQ ID NO: 61715 - DNA, 879 bp, Glycine max
  Peptide Sequence Number=SeqID_153400
atggttggtactaattggaagtctccgaatgtgaagcacctcaaaggattcagcaattctgctcaaagatgcgaaaagagtagcgcacggatcatctgttgtttgcccgccctctgtgtttggttggtttcgcacttgttccaacaagacacaagacatccatgtccgctcctgagccatcgctcgtgtactgaaaagaggagaatagattgggaccagcttttggccggaataggaggtagaacaatcagttggttcccccgatggaaggaaggaaaagaaggagtccttttctcatgtggaggatacccaaacattccgctggtaggaacgaggggttgtattaactacaatcccgcgctagctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcacgaacttagaggcattcgtaatggcatcattggtggctaccatgaatggctgaaattaaaagtcgtcagcgaagagagttttgaagcaccggaagaggacgaagaagtccaagctctcaaaagcgagttaggaaaggcgaaattagccgaggagaagttcaagttggccgcaacacacattcggaaggagtgtgccgggttacgggaagagaatgcaattaccgcaagagccttgaacaagagaccaagagggctcgcaaggaagagtatggccggaacaaatttcgcggagctctatggggtagcaataatgaactcaagttgcgaagggaagaaagggaccagtcgcgagcacatagcatggttctga

SEQ ID NO: 61716 - DNA, 196 bp, Glycine max
  Peptide Sequence Number=SeqID_153401
tgatttacttaaagcaacattgttggctatgcgtcttggaagggtgttaggcaaagtaatcgatgaacgacaaagcacttttgttggtgggagattcatgcttgatggggtgatggtggctaatgaagttgtaactgagaacaagaaagggtacatctcttatgaatcagttcaagtggagggtacatccacttag

SEQ ID NO: 61717 - DNA, 702 bp, Glycine max
  Peptide Sequence Number=SeqID_153402
atggcacaacctccaccttgtgagaggactctaagggaaatggttgcacctgatttcacctacgaaagcttgtgcatccaataccctgatgaggatgtcccatatgttcttaaaactagactgatccatttgcttccaaagtttcatggccttgcaggacacagccatcaggaaggatatctcagatggcctcccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctagccttgaatcagaaatctgtacctgtcgcaagggtttgtggtttgtgctcctctgttgaccaccatacagacctttgcccttccatgcagcaacctgaagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacaacagcctgctccttccttccaaaatgctgctggcccaagcagaccatacattcctccaccaatccaacaacagcaacaaccccagaaacagccaacg

SEQ ID NO: 61718 - DNA, 606 bp, Glycine max
  Peptide Sequence Number=SeqID_153403
atggccccgaggaagcttgcctcaaagaggtccaggaaggataaggcggccgaaggaactagttccgctcccgagtatgacagtcaccgctttaggagcgctgtacatcagcagcgcttcgaagccatcaagggatggtcatttctccgggagcgacgcatccagctcagggacgacgagtatactgatttccaggaggagataggtcgccggcagtgggcatcactagttacccccatggccaaatttgatccagacatagtcctcgaattttatgccaatgcttggccaacagaagagggcgtgcgtgacatgaggtcctgggtgaggggtcagtggatcccgtttgatgcagatgctatcggccagctcttgggatatccgttggtgctggaacagggccaggagtgcgagtatagccagaggaggaaccggtctgatgggttcgatgaggaggccatcgcccagttgctatgtataccgggtgcaggattttgcccgaactgttgcagggaagcgagtgcgaattatgcgcaccaacatgaccaccctgactcagatatggatgactttgctgctcagcaacatcctgcccaccgaccataa

SEQ ID NO: 61719 - DNA, 388 bp, Glycine max
  Peptide Sequence Number=SeqID_153404
ggaaagctgctgctacaggtgctgtgtccaaggatgctttgattgctgaactcaaggacacatgcaaggtgctggaagcaaccatcaaagccaccacagagaagaaaatggagctggaacgcctgatcaaaagactctcagacagtggcattaatgatggagaagcagctgaggaagaagaagaagctgaggaagaagaagaagcagctgaggaagaagaagaagcagctgaggaagaagaagtgcagcagaggatacagaatcagatgatgatgattctgatgctaccccatgaccatcagacctttatttttgctgttattcttactaggaactgcttcacagcagtaggagcatggagacagggggagcagaaagctgatgtcac

SEQ ID NO: 61720 - DNA, 292 bp, Glycine max
  Peptide Sequence Number=SeqID_153405
ggatcgcgttcacaagatacccagcagacccggagaagtccaacagggtcctggggtttccagctctgattacgggcctttgttagttctacggagtgtctatcgcccccaacaaggcaggcatagggcgaaacaccacaacagccaagggatggccggcaaagggcaacagacgcaccgccgccacctccagagcccctcagctcatctacaaaggctggagcgttgcctacgacccgtagtcgaccagcaggcgaccaagtccaaagccaaaggtaagcaaaagtactag

SEQ ID NO: 61721 - DNA, 447 bp, Glycine max
  Peptide Sequence Number=SeqID_153406
atgggtgaagtagaggaggtgcaagagcagatgaaagctgataaggaggccacgaaagagcaaatggccacaatgatggaggccatgatgagcatgaagaatataatggaagccaatgcggttacagttgccgttaccaacactgttgctaaggtgaacctgatgcccccatctgacctcaaccaaatgaatcatccaacctcagatacggtaggcaaagatttgggaagtacagatggccccatgatgtgcaaattcaaaatgagcacgccttcccgccatatggcttgcctcccaactatacaccacccaatctggcgtacactcccaatgagaatgtcaataactccactcccatactcattgagagctgacaaccccaaactgatcatgcacatgtctctcaaccgattggggaggcacatgaaatgccccaccaaaatttag

SEQ ID NO: 61722 - DNA, 693 bp, Glycine max
  Peptide Sequence Number=SeqID_153407
atggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtgttagattctcccctgctgtgatcaacaaatatctgggcagacctactaatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcagcatcccaatatgttaaactacactgactctgtgataaagagagaatctcctctatccctgcattacaaattgtttgaggggacacatgtcccagacattgtctcgacatcagggaaagctgctgcttcaggtgctgtgtccaaggatgccttgattgcaaactcaaggacacatgcaaggtgctggaagcaaccatcaaagccaccacagagaagaaaatggagctggaacgcctga

SEQ ID NO: 61723 - DNA, 519 bp, Glycine max
  Peptide Sequence Number=SeqID_153408
tttctgtgggagccttacacaacaactgttttgttgatgttgcctcacatttgtttgattggtagtgtggcgtggtgcgcagtggtgccactcatttatttccatgttgtagagtggcaccaacccgatagagtgttgcaacaatttggaatgcaacaacctattccggagtctccttcgcaaccacagaatatccatgggctaacgttgaaaggcaaacaagatgaaaattggttccaactgttggccccaatgatcagtcagtggaataatcgagctgactttagggtcgacatttatcctcgacaggagggcctattgagttttaactcagattacatgggtgaagttgccgagacattgcagtatatggtgtcaccacaagggcgtaacacatgggcagtggatgatctcatgccttatgtggagaagttgatgattttatccgaagagcaagagaggatcactgagcctgtggcacatggtgcagcatcagagcgtcgatttccgccactatag

SEQ ID NO: 61724 - DNA, 459 bp, Glycine max
  Peptide Sequence Number=SeqID_153409
atgggaacaaatcaaaccaaaagaagattctatcaagtcaagattaagggcctagatgtcaccagtcttaaggagttggggcggttgatgggacctctccaaatgcaagccttccgcaaggcgtacggaaagattttaaatttgaccataccagagatattcacggaagccgttgtatcactcacccaatactatgaccagcctttgagatgcttcacgtttggagacttccaattagtactgactgttgaagaatttgaggagattctaggatgtcctcttgggggaagaaaaccgtatcttttctccgggtttcttccctccttgagcaagattgcaattgtggtcagggattcgacaagagagttggatcgtgtaaagcaaactcgaaacggcgtagtgggcctaccacggaagtacttagaaggcaaggcaagggataaggcaaatcaagagtag

SEQ ID NO: 61725 - DNA, 636 bp, Glycine max
  Peptide Sequence Number=SeqID_153410
atgggtgaagcagaggaggtgcaagagaagatgaaggccgaaatggaggccatgaaagagcaaatggccacaatgatggaggccataataagcatgaaaaagataagggaagtcgatatggttgcagttgccgctacgaacgctgttgctaaggtgaacccgacgtccccatccggcatcaaccaaatgtatcatccaacctcaaatatgataggcaaagatttgggaagtacggatgaccctatgatgtgcaaattcaaaacgagcacgccttcccatcatatggcttgtctcccaactatacaccacccaatgtggcatacactctcaatgaaaatctcaataactccactccgatactcattgagaaccaataacctcatcaggcacatatctctcaaaccatgggggagacacatgaaattccccaccacaatttatctgacttcgagccttggctcggatatgccactgaagggcaagctagttggtggtataccctttgaaaacactttggagggccctcagtatcatccacaaccacaaccctcacgttccacagtggttaaaaaccctcataactatggcagaaatgggaaagctggatcatctagaggaaaggctcagggccattga

SEQ ID NO: 61726 - DNA, 423 bp, Glycine max
  Peptide Sequence Number=SeqID_153411
atgattatgaggggccaagacatttatagtagccaagatgagcctactacttcaccttcctctagtgaaagtgaagaagcaaaaggggaagaatctagtgaagaaatctacccccaagaagatggacaaccattagtggttaaagagaagtgtaaggaggtaagtgtctcctccaagaggttagctaagaaggaaactcattttacgataaagacaaacattaaagaaactttccctcttagacaacctccacattttctcttttgtaaaaagacacttgctagcattgccatacctcttgggcttgagtttattcctcaagtaaagaaattgttggatgagggtttggttcacaagagcttaaatccttgtgctttgttggtgcccaaaataggaataatcaacataaaaatacagaaaaag

SEQ ID NO: 61727 - DNA, 207 bp, Glycine max
  Peptide Sequence Number=SeqID_153412
atgactcactataatccttaccctcggaagcaaaaaaggaaagaaggaaaatttccaatcaaagagaaagcaaaaagaaaagaaaggaaattcccaatcaaaaagtgggagaaagcaaaaagaaaagaaaggaaattcccaatcaaagagtgggagaaagaaaaaagaaaagaaagaaaattcccaaccaaagaatgggagaagtaa

SEQ ID NO: 61728 - DNA, 303 bp, Glycine max
  Peptide Sequence Number=SeqID_153413
atgaatttttacaatcttcccactaccactccagccttatgcaccataatatctccctttctagtaaacataataccaagtgacggtggtgagcatgcaactgggacatcttttcaaatggattcgccatcctttcttgcaacccaggatgagaggaggcatgcccggtcaatgctgggacctgctgagcacaacgatgaagaaacagtggttacaaagaccagtgacaccgaagaggacatagtcgagatggattatgctcaaccccatcggaaaccacccattcacaatgaaaagccttaa

SEQ ID NO: 61729 - DNA, 1503 bp, Glycine max
  Peptide Sequence Number=SeqID_153414
atggaagtgcatgagaatggtgggtctcctaggcagagccagagcctctcagagttgcagattgtgactatgatgagcgtgccacccctcaagatgaccgaaccacgagcagttcgcaaagttttggtgagtgaggacaacacaagggccattcatggatgctaccaagtagttatgtattatgagaatttgaaggagaaggagcatggttggtgtctggctggtttgattgtggagtcactagccagggttctgttggatcaccctctactcgctggtcgtcttcaaagaagggaagacaccggtttcgaaattgtggccaatgattctggcattcgactcttggaggcatgctatccgaccaccttgtcacactttcttcacttgaatgaagaacaacaccaccttgtgttctggaaggaaattgatacccagtatcctcagttttctcccctgttttatgtgaccaacttcgaatgtggaggatactcgattggcattagttgcagccttctattggcagaggtttttctggtggaaaatttcctcggaaaatgggctgaaatacacatgaacatgtcaccccaacatgaagaaattcagacaccgatatttcaccaccctcgtttgaaaaatccagagtctctcccacccgatataataagccgcactcaaaggcaaaacggggttcaaagcatggtgttcacaatcactaccgaagatgcaaactttagcatggaactgtggagggaattggccatgctttgcgttaaggaagcagaacaaaaactaagcacaaatttgggttcggagttttctttggtcgtgaaagagtcttcggaggtggccaaggtagaaagttgctcaatgaatggatggagtgtggagggaatgagggtgaagcatgagatgagtgcaagcaggtgggaagagtttggagtgtatgaggtagcattttttgagggaaacaaacctgtgcaagtttcttgctggattgactcggtgagtgatggctatgctatggtagttccactcccctacctcaagcacaaaaatgcatgtgcaatacctatgttgaatcaagtaatgagtgccaccagaggtgccaccgatgcattttctggtgttagcaggcatgtcaacacttctttgaggaagttgggagctaataatgttgaagtgggtgttggatgtggagttgtcggtgcatttccacaatccttgcaaagtgctgtaagcacagtcaatactaaccaaagttctgctggaagcatgatgcagttggcaactaaatcaactgatcaagtatctcaaggtcagccagagcctcaacctgtgcaaattggttctgattttgaaaataatccattaagaggcactgcagttggctctgcatttggcagcagaactgagaaggttattagcaactttctgcaaaatccactattgaagggagaaggaggaggacttgatgaagcagtatgcactgattctcataaataa

SEQ ID NO: 61730 - DNA, 894 bp, Glycine max
  Peptide Sequence Number=SeqID_153415
atgcaaactgcacgtcagaagttacggttgatggttgctaaggcgttcatagttgaaagatcgatcgaaaggggaaaagtgaaagggaagaacgtgaaagtgaatgataaagtaactacctacgctagattgctaatggaaactgtggaaaaacaatttgctgatttcattactattggtgttgtgaatggagctgccacagtctactttagctatataggctatgactcggcttcaaccttggcagaggagatcaaagatccttttaagagcctgcctattggaattatgggttcaattctcataaccaccatactttattgcttaatggctctatctttggcatccattgctctattcactgagcttggcatcataatcgagttggtcaacatccgcacgctcttggtgttctacttggtagccaatgctctgatataccgtcgatatgtgatcactagccacaccccacctattcacactctcttgttccaatttctcttttcacttggtgctctaggcttctccctttcatggaaattcaatcagcaacagtggggtctcccactctttggtgggctcatgatcaccatcacagctttttaccaccacaaggtgcctcatcatacccatgctgatgatgctgattggtgtgtgccattcatgccctggccacctgccctctccatctttctcaacgttttcctcatcaccactctaaagctcctctctttccaaaggtttgctatgtgggcatgtttcattaccctcttctatgtcctctatggtgttcactccacttaccaagcagaagaagaaactgaaatagggtctaatcaactgaattcaagctcatccaacctacaaactaaggtagaagttcaagtgctatag

SEQ ID NO: 61731 - DNA, 1434 bp, Glycine max
  Peptide Sequence Number=SeqID_153416
atggagctgaaatccttaacttccaattctgtatgcacttcggagtttgtccatgtgggaagaacaagaacaggaacctattcctctttgctctcaaatttcaggagcgttagagtctctagacaactcaactgtttcggtgggttatttcgaaggaacaacgaagcctcgaataaaatttacttggctgataaagctgtcatcagttcagttggcccacataatcttgcggcagaaacgagttttcatcatattaatggcacaaatggctcaacttctagtttgtgttccagaaatctgagagtacttgatgcctttgatgatgtgtatgagggggttgttattgattcagaccggttaccagacaacccttctaccttcgcagctaatttgcgtttttctctttctcattggaaaaagatggggaagaaggggatttggcttagattgccatcagagcaatctgattttgttccaatagctattaaggaaggctttcgataccaccacgcagagccaggatatgtgatgttaacatactggattcctgaaggaccttgcatgcttccagccaatgcatcacatcaagtaggagttgggggatttgtcatcaatgacagcagtgagtcagaggagctatatgccggagccattagagaagtgaaggaagaaactggaattgatactgaatttgttgaagtcatagcattcaggcatgcacgtaatgtggcatttgagaagtcagatttgttcttcatctgcatgttaagacccctgtcagctgagatcattgttgatgatcctgaaatagaagctgcaaagtggatgcctctagttgagtttgtagagcaaccacttatccaagaagattctatgttcaagaagatcatagatatctgtattgcttgtctcgagaagctgcatgacattgaatatggctttggagcacatgaatatccaagtagtggtgtgtttgaggtggaacctagaagctgccctggcttcatctttcgacgatcagtgttgttgggcagcactgatatgtctaactcagaatttcgagctttcatagagcacttgtctgcaaaatatcatggagacacttatcatcttattgccaaaaactgcaaccattttacggatgaagtttgccagcatctaacaggaagtcctatacctggatgggtaaatcggatggctcgtgtaggttctttctgcaattgtcttctgccagaaagcctccaggttgctgcagttagacatctccctgaacgtcttgcatttgatgatgatgatggatcagcatctgatggtctttctgcatccctggagggtgaagaggatgagtccaatcaccatttactaactggaccaaatggtgatgttgcctttctaaaggagaaaccagttaggctggcgcgggagcacctatga

SEQ ID NO: 61732 - DNA, 2214 bp, Glycine max
  Peptide Sequence Number=SeqID_153417
atgccttgcttgagtaaccttgctattttgttggattttggtttaaattgtttatctgaagaatgtagtgcttataatagggtgtggcttccttttgataggtacgatgcagtaacttacttgaaatatttggatacactgagagtgtcagagagttttcggtcagtttggatatttgctgaggcaagctataagatatttgactatgcaaagaagcgtgtttttcatcttgtgagagcagatggtgtgaaatttaacgagtcaagtaagagtgtcaaaaacaaaaagagaagaactaagggtgatgacaaagacattgaagaagcagttgatggcacttcatcatctagttcaaatgctggcttaattttggaggaagttttggaagaagcaccaaagtggaaggtcttacgtaatgttcttgaggaagtagaagaggaaagacaaaagcaaggtatgttgagggaagaagtattggctgaaggtgaagacactaacaatggcattgtattagtggcatgtaaagatgaaagatcgtgcttgcaacttgaagaatgcatcaccaacggtccaaaaaaggtcatgcatgaggaatggaagaagtatttactaaacaaagtacagctgcgtgacatagtgaataagaaaaagaagcctaaggatcccaaacccaaaggttttgggattcttgatggagttactcccataaaacctgttcagagtgcagaaaccaccagcattagtaagcaagagcatgatgcgcttttggcagcagcatcaaaactgcggaatattgctgaaaatgatcatgttggtgaagatacccctcagcctgattctggtggacagggtcgtgctaaaagaaagaggaaagtggggattagaaatgaccctgtcattcttgatggttctggagttcagaacaataataaagcgcaatcaacaagtgataaaattggaatgtctgattcaaaaaataaaatcgatgaagatgagactaatcctatcagtgcaggtagattttgtgaaaccatgcagggtgagacatctgtggaaaatatagttcttcgaaggcatactaatcctgatgctgcagctagaaatgggaaatcactaccaccagtgtatttttatgccctagaaagtgatcagcctatactggatatattaaagccgtctatagtcattgtttaccatccagatatgacctttgttagggaaattgaagtctacaaagctgagaatccctcaaaaaggttgaaagtatattttattttctatgaagattcaagtgaggttcagaagtttgaagcaagtatacgtagagagaatggagcatttgaatctttaattaggcaaaaatctttgatgatgattccagttgaccagagtgggcattctttaggattgaattctactttagagtcagatttaaatactcctcaaaacttcgtaaccagaaaagcaggtgggagaaaggaagctgagaaagaaatgcaggttattgtggacatgcgggagttcatgagcagccttccaaatgttcttcatcaaaagggaatgaacatcattccagtgaccctagaagttggtgactatattctatcaccattaatttgtgtggaaagaaaaagtattcaagatctctttatgagcttcacatcaggtcgtctataccaccaggtggagacaatggtacgatattacagaatacctgtactcttgatcgagttttcacaggataagagcttttcattccagtctgctagtgatattggtgatgatgtgacaccaaatagcattatatcaaagttgtctttgcttgctctacacttcccccgactacgaataatctggtctcgaagtttgcatgctactgccgaaatatttgcttcactgaaggcaaatcaagacgagccagatgaaacaaaagcaatcagagtgggtgtcccttcggaagaaggaattgtggaaaatgatgtgaggtttcattgctgtcacagggctgaaaattacaatacatccgctgtggagtttctaagacgatgtccaggtgttacagactcaaactacagggccataatggatggctgtaagagcttggcagaacttgcacttcttcctgtagagaagttagcggaattaatgggtggtcataaagctgctaggactcttagagattttctagatgctaaatacccaactttgttgtga

SEQ ID NO: 61733 - DNA, 330 bp, Glycine max
  Peptide Sequence Number=SeqID_153418
atgggcattcctcggggacatttagaaagccgtttaggattagctcattcacacattatacttacactttcacacaccttcgaatggggccctatacctgaaccttggtctttgtgcccccacctccagaaatccatgatgatgtcgtttgcatcgatgccgacaccacagcccgcaaagtgcaccttggatctcctcattggggagaagaaagtccctcaaagattgaagaagagagttcgcatcaaagatggtgaagaagggttcgcagttgtcattgatgaaaaagagagaaaagacatgcaaaataggggaaagagagaagcgtga

SEQ ID NO: 61734 - DNA, 264 bp, Glycine max
  Peptide Sequence Number=SeqID_153419
atggtaaacaaatcccgaaaagggcatcgaaaccatttaaaaaagaaaacgacgaaagaatctgggaaaaagttaagggcatgggtgacgttggggaactggagtgagaagcaaggttcagggaaaaagcggaaccgtgggtttcggtttcggagcgggaaaaaaagagtagcgatgcacgtacaattggacagttcgctggtttcacatttctcactcccactcaaggcgcgtgcgtcccaacacttctgtgtcttctcataa

SEQ ID NO: 61735 - DNA, 1392 bp, Glycine max
  Peptide Sequence Number=SeqID_153420
atggagatggccttgagggcgtcggagaattcccttgcaaatggtgacttagggttcacgttgtgtagcagagagagagaacagagaaggttgcataagaatacagctcctatttctggtctatctgaaacctcatcagatcatgaggatactgaaccggaacaggataatcatggtatgattgatgtagggattgctgaaagattgtttgtaactggtgttcttgatgagttaaagatttgcttcagttatagttatcagtctgatcagagcttaatgaaggttcttttaaatgaagaaaaacgtttgtttgaatttcgggcaataggtgttcaggtggaggtttctatcagagacaataacattttcgttggcactatcttgaaatctttggaaatagaagacttagtttgcggtagtcaaagatggtctcagccttgttttttggcaagatcttatattgggacggcagatgaaaatttgttattctataataccatgacaagagatgttgaaagtggtgggttaatccctactgaaactgatgataagttttatgaggcgcccgagactttagcagacagtgttgattatcctatgcaatctcctggaggtacatcagaatacccatctagttcgcccagcaagatccaatttaattattcatctctggaactcccaaagtttagtcgcattactggacttctacctagtgacactccttctattaggaaggagcttgaactcaatgacacattggagagttttgtcaaagctcaaataattatctatgaccagaattctgctcagtataagaatatagacaagcaggtgatagtgactctggctaccttgacatttttttgtcgtagaccaacaatcctagccattatggaatttatgaattctattaatatcgaggataagaaccttgcaacttctagtgatagctcttcaacagcagccagaatgataaatgatatatcaagagatgtagatgatctacaagctactgctattgaggaacatgctgttaagggcttgtttggaaaagggaaatccagagttatgttcaacctgacattaaaaatggctcaggcccaaatccttttgatgaaggaaaatgaaacaaagcttgcttgtttgtctcaagagagtttgcttacagacatcaaggtgttcccttcctcttttagtattaaagcagcattggggaatctaaaaataagtgatgatagcctacctagtagtcatttatattactgggcatgcgatatgagaaatccggggggcagatcttttgtggagctgctaaaagccaataaaaactaccctctactgatacaaaaaaccctgtctaatatggctggaccagtgattaaaatgcagtga

SEQ ID NO: 61736 - DNA, 2286 bp, Glycine max
  Peptide Sequence Number=SeqID_153421
atggtcacatttgatgtttgtatttcttttaaggttccatggagtaggcttggtcaagatccagtcttagtatatttggatcgcattttcttactagctgaacctgcaactcaagttgagggatgcagtgaggatgctgtccaagaagctaagaaaagcctaatacaggagatggaattgaaactgtgggagaagtcacaacagttaaagtcagaaatgcaccatccatgcacccaaggttctgcagaactgctcaatttctggacttatttgaaatggttcaactacacaaaaccggattccaaatctctagttgatgtgggactaaacaccacacttgaggctacaattaaggtagcctccaaagaggctgtaattaaggctggcaccatcattggaaatttgaagctttcaatttctaatattcacatcagatatgaggatggtgagagcaatccagggcacccatttgcagctggagttatgttggacaaactcttggctgtgacagtcgatgattctgggaaggagacttttattactggaggcgcactagatcgcattcaaaagtctgttgaacttgatcgacttgcagtttatttagattcagatattataccatggcatgttaacaaagcatgggaagatttgcttccttcagagtggtttcaggggaaattagtgtgtttctgtgcattgtctaggcggtttgatgggagtttgcttttgcttgtggattgtacttattggctaggtgtcagagtgttcttttatcccgatcctgtaaaagatggggggtgggagatatttaaatttggcaccaaagatgggaagccagctgataatttgttaagaaagcactcgtaccttctgcaaccggtgactgggaaagcaaagtactccaagctgctgccaactgaagttgctgatagcaaacaacctttacagaaggctatggtgaatttggatgatgttacaattagcatatctaaggatggatatggtgatatcatgaaattagcagacaactttgctgcatttaatcaacgtctaaagtatgctcattatcgtccactggtgccagtaaaagctgattccaggtcttggtggaagtatgcgtacaaagctgtatctgaccagataaagaaggcaagcctaacagagttggttgtctatgtctcgaaaagggctatgtatgaaggggcttaccagaaagatcccactagatgggttctcatgcaatgggttgccctttacgatagggcaagccttgacacagtggtaaggttgctgtcttgtgacacggaggtcaagggttcaaatcggagaaacagcctctccacttgcaatggtgaagctgtgtatatctaccctccccagatcccactagatggtggaaaaatgtcatgggagcaagttttaagatatgcaagcttgcggaagagatatatttctctctatgcttcactactcaaatcggaccccactcaggtgacaattagtggcaacaaagagattgaagatcttgatcgtgaacttgatattgaacttatactacaatggagaatgttgtctcacaagctgctggaaaaatcggcagagtcaaatcataacatgaggaaacagaaagcacagaaatcttggtggtcatttggatggaccagtcaatcttctaaagaggaaagtgaggaatttaatttcagtgaagaggactggaaccagttaaataaaataataggatataaggagggtgatgatgggcaattggctgtaaatagcaaggctgatgttattcatactttcctggaagttcacatgaatcataatgcttcaaagcttattggggaaaccaaagagtccgttgctgaattatcatgtgaagacctcagttgctcaataattctttatccagaaacaaaggtctttgacattaagttgggctcatataagttatcctcaccaaaaggtctccttgcagagagtgcaacttcctatgactcattagtcggtgtcttccattacaaaccttttgatgacaaggtggactggaggatggttgccaaagcttctccatgttacatgacttttggacagtacatgaaggacagcatagatcaaattgtgaaattctttgaaagtaatactgctgtaagtcagaccatagcactagaaactgcagctgctgtgcagaataagtgctctatagattctgaacttgaagagtacatcatgaaattgacgagttctctggtgcacccgattactcaaatgatggtggacctataa

SEQ ID NO: 61737 - DNA, 741 bp, Glycine max
  Peptide Sequence Number=SeqID_153422
atggagaccagtgtgacgctcgttggagatgaggcaggcatcgtgcgcgggaacttcatgtgccaaggtcctatgtggggcgtgggttacatgaattgcactacaccatttggcttgactgaaaacctaacttttaggtatttgaaacttcatttgggtgctgatgcaatagctcttgctcatttaacattgagccatatagtgtattacctcaagattttgacaagttttacagtggctgctgaggtcctgacacaacctcctcctttacctggtcttcggactggttatgagaccataggcggattcacatcatttagcaacgatgatgaagactatgaaggttatgattttagtctttttggtgagctttcagaagtgcgcattgtctatttgaatcgatttgtgcaggaggttgttggttattttatgggtcttgttccagacagcccaaaaagtgtcgtaaaagtaacagatcaagtgacaaatacagagaagtggttttcagctagtgaaattgaaggatctcctgctcttgacattgttcatataactgtgaagaacacatttcagtggattggtggaagtaaaagtgaaatcaatgcagtgcacttggaaactttgacagtccagggaaaggatcttgacgtgttccctgccttgtgtgctcactatgatgttgaagacatcaacttaaatgttggaactggatcaaacataggtgaaagcttaattcaggat

SEQ ID NO: 61738 - DNA, 1323 bp, Glycine max
  Peptide Sequence Number=SeqID_153423
atggcagacttaccagggtatcttcatgcctgtttgaacacagggaagcttgcctccttggcaattttggtgtctggaggaatcgtcttgcaaattttggcatgtgccttgtataataactggtggccgatgctgagtgtgttaacgtatgtgcttcttccaatgcctttgctgttctttgcggggtctgatgattctatattttctgaatctgataatagctgggtaaattttactaagttcttgactggagcctcaactgtgggaggcattgccattccaagcatattaaagcatgctggggttatcggttggggagcctttgcaatggaactctcttcctactttgtgtttggaatggccgtaatatgttacctttggatgagtggtgatgatgattacaaccacgcgaaactggggggcgttggactgaacggcggggaggatctcccagcggcagggctcgaggtcttcggagacggggcaatagccggcgagcgtgaccttgtcgttggaggcggccacggagccaaactcgaaaatcgagacggtggtgttcgagggccggggaacctccacggcgccgttcatccctggggcctcagtgagggatctctatttgtgctcgttaacagctgggggattgatgattatgatggtaggttgcgaagaggtgttgttaggatgtactctgggtttggtcttatggactctgcatgcaatgtgtttgaagctcaagagttgtttgatatgatacccattcagaacaaggttgtgtcgacttgcatgattgctggctatcttagtgctggccaagtattgaaggcttggaatttgtttaatgacatgcctggtagtgatagggattccattgcatggactgagatgatttatgggtatgtgcagaatgatcttattgccaaagccttctgcttgtttgttgagatgatggctcatggggcggcaattacatggtatgcaattgaagacgtgtatgaagatgatttgattcttgagaactctctaattgcaatgcatgcaaaatgcggggagatagacgatgcatgtaggatagtctctaacatgacttaccgggacaaaatttcttggaacaccatgatcatgggcctttccgatcatgggagggccaacgaagctttaaaagagtatgaaactatgcttgaatttggaatttacccagatggccttacattccttggtgtcctgacagcatgtgcccatgtgagtcttgttgataaagggtgggagactgggagttattgcttgccatggttaatgcttatgctattcaacctggtttag

SEQ ID NO: 61739 - DNA, 3327 bp, Glycine max
  Peptide Sequence Number=SeqID_153424
atggttcgggctaaacacaaggaagtctgcctacacaaagatagtccgttgggagaaacaattcttgaatgctacaattgtggatgtcgtaatgtgtttcttcttggatttatttctgcaaagacggaaagtgtagtcgtccttctttgtcgtgaaccttgcttgagtgttaatgccttgaaggacatgaattgggaccttagtcaatggtgccccttgattgatgataggtgtttcttgcagtggcttgtcaagatcccatctgaacaggagcagttaagggctcgccaaataagtgcacagcaaataaataaggtggaagagttgtggaagacaaatcctgatgcttcttttgaggaccttgagaagcctggtgtagatgatgaacctcagtccgtggctttgaaatatgaagatgcatatcagtatcaaaatgtatttgctcctcttattaagcttgaagccgattatgataagatgatgaaggaatcacaaagcaaggacaatgtcactatccgatgggatattggtcttaataagaagcgtgttgcatactttgtatttccaaaggaagataacgagttgcggcttgtgcctggtgatgaattacgattgcgttattctggtgatgctgctcatcctgcatggcagtcagtgggtcacgtgaacagtaccagaggtactgaagagatcagatacaagacacctaagattaagctaactgcacaagaggaggttgcactggagcttcgtgctaatcagggggttccagttgatgttaaccatggtttcagtgttgattttgtctggaaaagtacaagttttgataggatgcagggagctatgaaaacctttgctgtggatgagacaagtgttagtgggtatatttaccatcacttattgggtcatgaagttgaggttcaaatggtgcgtaatgccctgcctcgtcgctttggtgcacccgggcttccagagctgaatgcatctcaagtttttgctgtcaagagtgtgcttcagaggcctattagtttgattcaaggaccacctggaactggtaagaccgtaacatctgcagcacttgtatatcacatggccaagcaaggccaggggcaggttttggtttgtgctcccagtaatgtagctgtggaccagctagctgaaaagataagtgctactggattaaaggttgtgaggctttgcgcaaagtcaagggaagctgtgagttctcccgttgagcatttaactctccactatcaggttcgacatcttgacacatcagacaagagcgaacttcataagttacaacagctgaaggatgaacaaggcgaactttccagcagtgatgagaaaaaatacaaagcacttaagcgagcaacagaaagggagatttctcagagtgctgatgtgatctgctgtacatgtgttggtgctggagatcctcggcttgcaaattttaggttccgtcaggtacttattgatgagtccactcaagcaactgaacccgagtgccttatacccttggttcttggagcaaagcagcttggtccagttattatgtgcaagaaagcagcccgtgctgggttagcacagtcactttttgaacgccttgttctacttggtgtcaaaccaattaggttgcaggttcagtatcgtatgcatccatgcctttcagaatttccctcaaacagcttctatgaaggcaccctgcaaaatggagtcactgttaatgaaagacaatcttccggaattgattttccttggccagtgccaaaccgtcccatgtttttttatgttcagatgggacaagaagagataagtgctagtggaacatcttatttaaataggactgaggctgcaaatgttgaaaagattgtaactactttcttaaaaagtggtgtggttccaagtcagattggtgtgataacaccttatgaggggcaaagggcttatattgtgaactatatgtcaagaaatggtgctctcaggcagcagctttacaaggagattgagctgctacatgagttttattcttttcaggttgctagtgttgattcctttcaaggaagggagaaagactacatcattctgtcttgtgttagaagtaatgaacatcagggcattggattcctgaatgatcctaggaggctcaacgttgctttgacacgagcaagatatggcattgttattttgggaaaccctaaagttttgagcaagcagcctctatggaatagtttattgactcactacaaggagcatgagtgcttagttgaagggcctttaaataacttgaagcaaagtatggttcagttccagaaacccaagaagatttacaatgaacgaaggcttttttatgggggtggacctggaattgcatctaatgataattttggtaacgttggatctggtgctggcacaagttcagatcggaggagcagtcgaggaaggggatcttatatacctcctggtccaccaaatggaactcataagcctggagtgcatcctgctggatatcctcctgtgccaagggttcccttgcctcattttcatggtggtccccaatctcaaccatatgccattccatctcgtggggctgttcatggacctgttggggcagttcctcatgttccatctccagggagtcgaggttttggggctgggagaggtaattctggtgctcctccaattggcaatcatctacctcatcaacaaggcacccaacagcctattggatctacatttaacttccctgctctagagaatcccaacagccagccatctgttggtggtccattatcccaacctgggtttgccaacaatatgcatgttcaaggggctggccaatcatttcgtgatcaattttctatgcctggaatgtcccaggacttcttgggcgatgacttcaaaagccagggatctcatgttccgtataatgtcactgatttctctacgcaggcttctcaaagtggatatgctgttgattatgctacacaaggagcacaaggtggattcccagggaattttcttaaccagaattctcaagctggatattctcgctttggttctggaaacgactttatgtcacaggactacatgggccatggatcacaaggccttttcactcaggtggggttcagtgatcccttgcaagatgatgcaacacagagccatttcagtgtggcaaatgccaaccctcttcagtcccagatgaattctctttactcccaaccttttgctcactacaacacacagccgcttaacatgcaggctacccaacagcagcctcaggctcagaactcccaaaatcagaaaatccactataacgtttga

SEQ ID NO: 61740 - DNA, 891 bp, Glycine max
  Peptide Sequence Number=SeqID_153425
atgacggtttcttctgagaattgcgtctctagccgcagaggggctggcatacatatgcatgcgatatggtttgcattgttagacataaaaactgttatgtgccttcgcccaacagtttatgattttaaaacagttagcttatggcaagaagttaaatttcaggataagggaagccagagttctctcactagacttgctccacttgaagcagtgctctttgatatagatggaactctttgtgattctgatccactccattactatgccttccgcgaaatgcttctagagattggttttaatgaaggtgttcctataacagaggaattttttattgagactgttgctggcaaacacaatgatgatatagcctcggttctctttcctggtgatctggaacgaggtttaaagtttgttgatgataaggaagccatgttccggagattggccgcagagcaagtgaagcctttgaatggccttgataaagtgaggaaatggattgaaaatcatgggctgaagagagctgcagttaccaatgctccaagggcaaatgcagaactcatgatctcaatacttggtctctcagatttctttgatgctgttattattggtggtgaatgtgaacgtgccaagcctcatccagacccctacctgaaaggtcttgaagctctgaaggcatcaaaagatcacacatttgtatttgaggattctgtttcagggatcaaagctggagttgcagctgggatgcctgttattggtatagctactcgtaacccggaaaatttattgatggaagcaaaacctgcctttctgattaaggattatgaggatccaaaattgtgggctgctttggaagaacttgacaaggctggtgcatttagtttgaattactag

SEQ ID NO: 61741 - DNA, 1662 bp, Glycine max
  Peptide Sequence Number=SeqID_153426
atggcatcagtgttcttgggtgatcagtctgtgggaaaaccagcatcatcactcgcttcatggacacagctggacaggaaagatttagaagtcttattccaagctacattagggactcatctgttgctgtacgtcatcgcatatgatgttgcaagccgtcaaactttcctaaacacatcaaggtggattgaagaggtgcgcattgagagaggcagtgatgctattattgttcatgttgggaacaaaactgaccttgtcaataagaggcaagtctctacagaggaaggggaagctaagtctcgtgaactgaacgtcatgtttattgaagctagtgccaaagctgggtttaatataaaggccctctttcgaaaaattgctgctgcattacctggaatggaaacactatcctccacaaaacaagaagatatggtcgacgtggacctaagatcttttggtggttatcaatctcaacctcagtccggcggatccgcgacaaccgctcccttaaactgctccgcaacaaggctagtcgtcgcgctggaggacaaggctactgtgattaaacatacggaagcttttactcagaggtgtatatctagatggtccgttacactctacgctcgttactctgatattcctcagaacaagtctaagcttgctcctttgcagagaagaatggtggaccagtgtaaaatgtttgcaaaagcaggtgatggaggtaatggttgttctatcttgcgcaagggaagatctgatgaaatgtggatgctgtgcaacggaggttatgacaatgctactttggtgtctgtgtttaacgtaggtggcaatggggggagaggtggtgatgtgattctgttaaccgcgtgtgtatcgattggcactgtacttcatctcgttaatggtgatattccatctgttgtcaaaactcaatcctcaacagatgtagacccttgggatattcccggagcacttgttgatgatgttcctgaccctagcaatggttctacctccagtgttacaaatgaagaaacagatgttaagaaatctgaaaaatcaagacaagttgcatcaacagatgtattttctcaactttccacttctaatggagctcctgaatttggaacagaggatataggagagaaacaagagatactatacaatgttgctgagttaacagaagaaggtcaacaaattgtcattgctcatggaggagagggtggtctgggcaatgtgtcttgttccaaagattcaaggaagcctgtgactgttcaggaccctgacactttgtcggctaatgctggtaaaagcactttacttggggctatatcaagggctaagcctgctgttggtgactatgccttcactactcttaggccaaatttggggaatctagactatgatgatctctcaataactgtggctgatattcctggacttataaaaggtgcacaccaaaatcatggactcggacatgcatttctgggcaacacaaaatgcacaaagggaattccaccatgggaacagctgagaaacttaattctagagctagagtaccatcaggacggtttatccaatcggccatccttgatagttgcaaataagactgatgaggaagggatagcagatcttaaagctggtcttaaagatgctcgtcaatgctga

SEQ ID NO: 61742 - DNA, 1002 bp, Glycine max
  Peptide Sequence Number=SeqID_153427
atggcatgtaggggatgctgggaatgccttttgaagctttttaacttcatattgaccctcactggtcttgccattgtgggctatggaatctatctttttgttgaattctctaaagcttcagatgatgacaacatgccggcaatttctcctgtaagcgatgattcttctctgattcaacttggccggcctgtgcttatggccgtgtctctatccaacgacttttttgataacttgccccgtgcttgtgagattgtcaaggtgaaacttttggaatggttggtcaatagactgtggacttgtggttatgaaagaattggagcttcaaaagctgtgtgtgcatatatatatgcattaatcgtactaataaaaggaattgttattaagttccttaagccaataaagtattcaattttggtggcattattgatcttggtagagctgggatgtgcagcctttatattctttgacaaaaactggaaagaacaaataccaactgacaaaactggagagtttgatgcgatatatggatttctgattgagaattggaatatcatgaaatgggttgctcttggaattgttatctttgaggcccttcttttcctgttagcccttattgttagggctgcaaataggccagcagattatgatagtgatgaggagttcattaatccaaggcagcaagtacaacagccattgctcaacagactaccagcaggcccagcaacagggataccggttgctggaacaattgaccagcgtccaagcagaaatgatgcatggagtacacggatgagggagaagtatgggcttgatacttcagaatttacatacaacccatctgagtctaacaggttccaacaattagggggagtgagtagtgaagtcgttgatgcccccatattgttgcttcaaagccaatgtcttctttggcccatgttttgcccgtggtcattactcgcttgttgggaaaactatgatttagtccttaaaggttctgattga

SEQ ID NO: 61743 - DNA, 1146 bp, Glycine max
  Peptide Sequence Number=SeqID_153428
atggacacaggcagcgacctcgtgtggttcccatgcgctcccttcgaatgcattctctgcgaaggcaaattcaacgccacgaagcctcttaacatcacgcgctcccaccgcgtctcgtgccagtcccctgcatgttccacagcacactcctccgtctcctcccacgacctctgcgcaatcgcacgttgtcctttggacaacattgaaacctccgattgctcttctgccacgtgtcctcccttctactatgcttacggcgacggaagcttcatcgcgcacctccaccgcgatacactctccatgtctcagctttttcttaagaacttcaccttcggctgcgcccacactgcgctcgccgaacccaccggcgtcgcaggtttcggtcggggattactgtccctccctgcgcaacttgcgaccttatctccgaacctcggtaaccgtttctcttattgcttggtctctcactctttcgacaaagaacgagttcgcaaaccgagtccactcattctcggccactacgatgattattccagcgagcgtgttgagtttgtttacacctccatgcttcggaatccgaagcattcttatttctactgcgtcggactcaccggaatctctgtagggaagaggactattctggccccggaaatgctacggagggtggaccgcagaggggacggaggcgtggttgttgacagcggaaccactttcacgatgctgccggcgagtttgtataactcggttgttgctgagttcgaccggcgagtcgggcgagttcacaagcgcgcgagtgaggtggaggaaaaaactggcctcgggccgtgttattttttggaggggttggtggaggtgcccacggtgacgtggcattttctggggaataattccaatgtgatgctgcctaggatgaattatttttacgagttcttggacggtgaggatgaggctaggaggaaggtgggctgtctgatgctaatgaacggtggtgatgacactgaactgagcggtgggcccggggccatacttgggaactatcaacagcaaggatttgaggtcgtgtatgacttggaaaaccagcgcgtgggttttgctaagaggcaatgcgcgtcgctttgggatagtctcaaccgtgacaaaaactag

SEQ ID NO: 61744 - DNA, 282 bp, Glycine max
  Peptide Sequence Number=SeqID_153429
atgtggaaatggatgacaagtgaaaagcttgcaggactaaatctgaactctttacgtggatttgaggtcatagacaagataaagtttttgctggaagaggaatgtcctatcactgtttcatgtgctgacatccttgccatggctgctcgtgatgcagttgaattgagaggaggaccaagatgggaagtcttgctaggaaggaaggattctctggagtcaagtttcggtggagctaacattcattcctgctccaaattcatcttcagaggttttcatagataa

SEQ ID NO: 61745 - DNA, 303 bp, Glycine max
  Peptide Sequence Number=SeqID_153430
atggatgttgtcaaattgatgttcagcacttatgttgctcctctaacgagtaatgaagaaggatgtactttatctgaatttatgcattactatgactgtgggtgttcatcacctcatcgtcgacttctttacgttgagaaaaacatcacgcgggcaatgattgaccccaattttgaggttgaacgaagccaatttcatcgcgtcagaatcgatgtcagcgatggaatagaggtcgacatggctttcgatggtggtaggcagtttgaagggaagacgagaaagacaaaatcatgggatgggtag

SEQ ID NO: 61746 - DNA, 381 bp, Glycine max
  Peptide Sequence Number=SeqID_153431
atgttacccgacatcgtcccggtagaggcgattgatgagaacgtctccgcggaggttcaagaagtatatagcggaagcagccaccggcatatccgatccagtgtatcaaattccaaattctccgacgaagaagcttacagaagaagaagaataaatacaggatacggtagctccgcagcagatctgtggcttcgaggaggaggaggagcaaacaaacgtcgtcgacggagaagagaagaaggagcgcgacaaaatgaagaaatgttggagaatgacgagtcagcgtttttggcacaccgcacaccaatacggcaacaccccaaccccgttcagcaatgcactttgacggcacgtgcgtctctcgtgaatgttttttactga

SEQ ID NO: 61747 - DNA, 1650 bp, Glycine max
  Peptide Sequence Number=SeqID_153432
atggaagacaaaaagaaggatcaggaacgcggtttcgtttgtaatcaagaatctcagacaaattatgaacctcagaacaacctacagaatggacagccaaatgtgtctgttggtcctattgccaaaattagtagtcctccaccttcacgtgacaacacgccatactcaaatcaacaacaacagcctccaattgttccatggccctacactcctcaaaatgccacaatgcacttccccacccaagcatcaccacctggtgccttaaatcaatggccgcagtttgcttattcgcagttatttgcacagtcagcatcacccttttggcaacctcaaccgccaggagcaaatgcccctaaattctttcagcccttcactgatactggctttcgaggaggaccttcctcaacaatacagacaccacttcccaatatgtgttacaattacacatttcctggctttccaaattcttggaatccatcttcttacatggctcagctgtaccaaatgcagcatccttatgttttcagttttcctggtgcacctaacttttcttcagcaactcctaaggtgcctgattgcttagcttccggagagcattcttctcaaaaaggaattatgagaccaccttcaaaactttctcagaagcatcaacaactttgggaagctcagtcagcggagaatgttaagctgtggagtgtgataaataaattgcaagctgaagtttctgatcacaaggatcggctgaagaagcttgaagaagaagtatcctcattcaaaaaggaagcagaagtgctcactaacaaagttattgggacaatcccgatattaacagagcaaccaacaaagagagggagggctaagcggtcattggccttggtggatgcatcatatgagtctcatctcccagctggtggtaaaaagcctgcactaagtaactctctgtatcagagtaaatcaccctttggagctgttaaatcatccatttttgaaaaagttatccttaaaaaagtggaaaataaagaaataactacccgttccaatactaaaatggtgcagcatgaaagcaatgttaaagatgtgggtcctctagagtcgacctgcaacacccagattaatcatagcaacccaattatgtccgcatgtcaaggccaagttcatcaggaatatctaggaatccaaacatgtggaattggagtaagtgttaattctggaaaggatgaagacttgaaagtagtcaactctgaaccatcacaaccagataaagtgttgaataatagtagcatggttgtttcagctaagtatgctggaaatactggtaatgggaattttgggttgacttctggcataccttctcaagacactccaaaggatgtgctagatgtagctcgtggaagtttcatccaacaaggaggaaacataactcctggatggagtttgagttttgcaaatgaagaggatgctttagaagatgtggaagatgctatggaagaatcagcaaaagatgaaaatgaagtaatgggggatgacactagccccgctgctgtagaaattggtgtaacaaaagacctaggtggtggttggttgccccatgatgatgctatggcaactagtccaaaagccaaagctatgtctccccttaacgactggtaa

SEQ ID NO: 61748 - DNA, 2034 bp, Glycine max
  Peptide Sequence Number=SeqID_153433
atggcgactcctataactcctgattccgcaacacttgcttcgagagatccatggaagcgtcttaaacaacctgccttcgatgataattccattcagcgcaaagataaggctgcgcttatatatgatcaactacatcatatgggctgcctcatcttcgagagaaagctattggctttcaagtatgagcaagttaaggcttcgattgattcatctgagtttatgcataagcatgattcggccatgaatttatctgcattaattgaagcaaggaaacgggaagaaagcttgaagatggcaataggaatcaatgaagcgtgcatagctagtcttgagaaggccttgcatgagatgcgtactgaatgtgctgaaacaaaggtttcagctgagagtaaagtttctgaagcacaccaattgatagatgaagcgcagaaaaaatctactgaggctgaggcaaagctgcgtgctgcggaatcctttcaggcagaagcttgtggatattatagtgttgcagacaggaagcttcgggatgttgaagctcgtgaagatgaactcaggcggcaaatcaaatctttcaaatcagagtatgtgtttaaatatttctttggagaataccgtgcattgctttatacacggaatgctaaagatgagttaacagttgatgctgccataccacacttaagcaacacactaggtgttactttgcagtttcatattctcgttgctcagccagagagaggaccccacctttttagtagatctcaggaattagatagtcttcaaaaagagttggaggacacaaaaacaaatactaataaggaacacggagccctttgtgatgagaaaaccaatttgaagttgatggaggccaccctaacaataagagaggaggcactaagtaaacgggaatctgagctgaacaagaaagaacaggaattgcttgatttgcaagtgaaacttgctagtcgagaatctgatgaaactcagaaagttaaagctgttcaggaagctgaacttggagcaagaaagactaattttgaagctgaactacaaattcagctcaaattggttgagaatgaaattgagatgaagagatgggcttgggaattgaaggaagtagatcttacacaacgagaggagaaactccaggaaagggagcatgagttggaaattctgtcaaggacactgggtgagaaggagaaggatttggtggatatgtcaagtgcgcttaaagaaaaagatcaaagcctgagagcttctgaaaaggaattagagttaaataaagttcttttgcaaaaggataaagaagagataaacaaaacaaagttagatgtacagatgtctttggtttcattggaaaataatttaaggcaatttgacaatgcgaaggagagacacgaagccttgaaaagtgaaacaaatgacttgtcagttttggaagtgaaactaaaggaagaaattgatgttgtacgatctcaaaagttggagatagtagcggaggcagataagctggaagcagagaaagcaaagtttgaagctcagtgggagcttcttgatgaaaagaaagaagagctgcggaaagaagcagaatacatagcagaggaaaaaaaggcagtttcggctttcattaagaaggagcgtgacaagctaagacaagagaaagagaatatgcgtgatcagtacaaacgagacttggagtcgctaacctgtgaacgagaagagttcatgaacaagatggcacatgaacatgatgactggtttggcaagatgcagcaagagcgtgcaaatttcttgagggacgttgagatgcagaacaggaatatgaatatccttattgacaagaggcgtgaagaaatagaaagttatttgaaggaaagagaaaaatcttttgaagaagaaaagaacaatcaactagaatatattaatgctcttaaggaaaaagtagcaaaagagtacaaacaggtttcctttgaaatgagaagacttgaagttgaacgaccagagataagttcggactgcgaacagagaaataagtaa

SEQ ID NO: 61749 - DNA, 138 bp, Glycine max
  Peptide Sequence Number=SeqID_153434
agggagaaaaatcctggggacattggagaagtctcaccatttccaccagttgccaatgataaaaaaaattatgctgccctaccagtgaagcctcagttccctgccgataagagacaacctgccaggaactcaaactga

SEQ ID NO: 61750 - DNA, 4272 bp, Glycine max
  Peptide Sequence Number=SeqID_153435
atggcttcgaatcctccattccccatggaggatcagacggatgaggatttctttgataaacttgttgaggatgatatggagcctgttaagtctggccatgatgaagggtatgattccgatgaggctaaagcatttgcaaatctgggaatcaatgatgttgatgctgctgcatttgagaattctaatgctgctgagagtggtgttgaagtcaaaggggaattcagtaatgtggaatccgatgtaggacttgaacaggaggggaatttgatgcccgtggtgagttcagttgggtttgatggtaaggtggatccccgtgaggatgggattgggatgggatccgaagtcacgtccgcttcagcttcagctgtaggcacgagcgatacagctggtagttctgggattaaggaggtgggttggaattcttttcatgctgatttgaatggaggcggcggtttgggatcatattctgactttttcagtgacttgggagatcagtctggggattttacggggaatgtgtatgataatttaagtagtgaggtgaagcctgatagtgcagttcaaaatgatggcttaaatgcctcgggtaattatgtgcaatatcacgagggtcaaggttatgatggatctttagaaaaccgctcaaactggcaaggtgatggattaaatgcttcagttaatcatgtacaatatcaagaagatcaagcttatgttgcatcttcagaagaacacacaaatggacaggatctgagtagtagtcagtattgggaggatctttatcctggctggaagtatgaccacaagaccgggcaatggtatcaaatagatggcaatagtgcaacagcaactactcagcaaagctctgaagccaatacagctgcagattggactgccgcatctgatagggaaacagagatctcttacatgcagcaaactgctcaatctgttgttggaactttagctgaaaccggtacaactgaaaatgtgtctagctggagtcaggtttcagaagggaatcatgggtatccagagcatatggtttttgatcctcagtatcctggttggtattatgacacaattgcccaagaatggcgttcattggaaacttacaattcaaccatccagtcttctggtcatggacatgaaaatgggaatgcttctgccaatacattctcacccaatgatcatagtttgtatagtgaatacagccaagctgataattatggacaacagggctttgataatcaggctgtagatggcagctggagtggtttgtatggcactaaccataagcagggttttgacatgtacacaactgggtctgccacaacacgaggggatagtataacttctggtggcaaccaacagattaatcattcttatggttcaagtatttctgtgaacgaacatcaacaaaatacttctagttcttttggatccgttgcattgtacaatagagtaaaccatgatcgtggtttggctaatggaacttttgaaccacaaagctttggccctactggggacactgttcaacagtttaattattcaaccacaaagtttagtgaacaaaaagttttttcaaatgattttactgaaaatcaaaaaccctttagttattctccacaatcaattcagggtggacatcagtattcacatgcccctcatgttgggagatcatcagctggacgtccttctcatgctttggtaacttttggatttgggggaaaactcatcataatgaaagatcctaatcttttgagctcatcatatggaagccagaattctgtacaaggttctgtttctgtgttgaacttgattgaagttgtcatgggaaatatggattctttgagcatcggagataacaccagtaattatttccatgctctgagccagcaatcattcccaggtccgttggttggcgggagtgttggaagtaaggaactgtacaaatggttagatgagaggattgcacactgcgaatcacctgacatggattataagaaaggtgaaaggttgagactccttctttccttgcttaaaatcggttgtcaacattatggaaagctacgttctccatttggcacggacaccatactaaaagaatatgatactcctgaatcagcagttgcaaaactttttgcatctgccaagacgagtggcactcaatatgggatgccaagccactgcttgcaaaatttgccttctgaaggacaaattagggcaatggctcttgaggttcaaaatcttcttgtctctggcaaaaaaaaggaggctttacagtgtgcacaagaaggacaattgtggggacctgcacttgttcttgcttcacaacttggtgaacagttctatgttgatacagtgaagcaaatggcacttcgccagctagttgcaggatcacctttgcgcacattatgccttctaattgctgggcaacaagctgaaatattctctactgatacctcaattagtgggcatcctggtgcttctgatatgtctcagcagtctccacaggttggatccgatggtatgcttgatgattgggaggagaatctggctgtaataactgcaaacagaaccaaaagtgatgaacttgtaattattcacctaggtgattgcttgtggaaggaaagaagtgagattactgccgcacacatctgctatttagttgctgaagcaaacttcgagtcatactcagatagtgcaagactctgtttaattggagcagatcactggaaatgtcctcgaacttatgctagtccagaggctatccagaggaccgagttatatgaatattcaaaggtggttggaaactctcagtttactttgcatccatttcagccatataagcttatatatgcatttatgctagctgaagtggggaaggttccagactcattgaagtactgccaagcactactgaaatccttgaaaactggccgtgctccagaagtagaatcgtggaagcaattagcactatctcttgaggagaggattagaattcaccaacagggtggatatgctgcaaatttagctcctgcaaaattagttggcaaattgctcaacttttttgatagtactgcacatcgagttgttggtggtttaccaccacctgctcctttgccatcacaaggaactattcatggaagtgaacaacaataccaaaatatggcacccagagtatcctctagccaatcaacaatgtcattggctccatctgcttcgatggaaccaataagtgagtggacagctgacaataatagaatggcaaagcctaatagaagtgtttctgagccagatattggtagaatcccaagacaggaaacaacatcacctgatgcacaaggaaaagcacaggcatcagggggtacatctcgcttttcccgatttggttttggctcacaacttttgcaaaagaccgtagggctagtcttgaaacctcgctctggtcgacaggctaaattgggtgagaaaaacaagttctattatgatgagaagctgaagagatgggtggaggaaggtgctgaagttccagctgaagaagcttctgctctgccaccgcctccaacaactgctgctttccagaatggttcaactgaatacaactcgagatttgcattgaagactgaaagttcacctcctattgagggctctaacataagaactgctagccctgaacttagtccagggatgccaccaataccacccagcgcaaatcaattcttggcccggggtcggttgggtgttaggtcaaggtatgttgacaccttcaaccaaggtggtggaacctctgcaaacttgtttcagtccccttctgttccttctgtgaaaccggctcttgctgccaatgcgaagttttttgttcctactcctgcaccatcgtcaaatgagcaggcaatggatgctatagcagaaggcaagcaagaagacagtgcaacaaatgaatatccttcaacatctgccacaaatgactggtcataccgatccccaaaacatgtatcatcaacagccatacaaaggtttccaagtatgggtaacatctcaaagcagggagcaacagaaggaagtaactctcatttacctcattcacgccgaacagcttcatggagtgggagttttaatgattcatttacccctcaaaaaatgggcaatatgaagcctttaggggaagctttgggcatgcccctgtcaagatattcacctgatgaatcttcaatgcataaacctgtcaaaagtagcagttatggagaagatcttcacgaggttgaactttga

SEQ ID NO: 61751 - DNA, 1404 bp, Glycine max
  Peptide Sequence Number=SeqID_153436
atgggtcgcaatgcagcagcagcggcagcttctctgagatggtcaacgacgttgctcttgttgttattgggcctagtagtagggaccaaagcgacgtcgtacaggaggaacgcgtacgcgacgatgatgtacgttgggacgcccagggactacgaattctacgttgccgttcgcgtccttctaaaatctctctccaaacttaacgtcgaagccgatctcgtcgtcattgcttccgtcgacgtccctctccgtgaagaggaagatggtgcaaaagtggtaagggtggaaaacatggacaacccttacaagcgtcaagataattttgacaagagatttaaattatctttgaacaaactctatgcgtggagcttagtggactatgacagggttgtcatgctggatgctgacaatctcttccttcaaaacacagatgagttatttcaatgtggacaattctgtgcggtctttatcaatccctgcgtcttccataccggcctcttcgtcttgcagccatcaatggtcgtgttcaaggacatggttcgtgaattacagaatgggagagaaaatccagatggtgcagaccagggttttatagctagctacttccccgagttgcttgataagccaatgtttcatccaccttcaaatggcaccaaggttgatggaacatataggcttcctttaggttatcaaatggatgcttcttactactatcttaaacttcgctggagcgtaccctgtggaccaaatagtgtgatcacattcccaggggcaccatggttgaagccatggtattggtggtcatggcctgttctgccattaggcctccagtggcatgaacaacgccgtcaaactttagggtatggtgctgaattggctgtgatacttatccaatctgcaatatatgtgggagtaatagcaatgacgcgtttggcaaggccaagcttctcaaagctatgttataggcgctctgataagagcatcacccttgttcataacagcctcaaattagtagctttgtggtgcatccttgctgcttacgtaacaccattctttatcattcctcacacggttcaccctcttctgggttggatcctgtatttgcttgctacttttgcactttgctcaattgcaatcaatatctttatgctaccaatgttaccagttttggtaccatggcttggaattgttggggtccttatggtcatggcatttccttggtatcctgatggggtagtgagagcactgtttgtctttgcttatgccttctgctctgcaccatttttgtgggcctctatggtgaggatagttcaaggtcttcagttatctctagaaagggaagcttttctgccagcaagattgggagagtcttcgccaaattcatggtttaacaagttatattga

SEQ ID NO: 61752 - DNA, 761 bp, Glycine max
  Peptide Sequence Number=SeqID_153437
atgactgtcataccaacttcaactaccgccttccatggctgtcattccagcccaaaccaccacaatccacaacacccaccaaaccaccttgaactttctcccgctagcatggaccgcctcgaagtcgccttggccaaacttaccctcagtcaactcaacctcgtcgttgccatcgacaccttagccaccaccatcgacaaccttcttcagcgactaagccctcgcaatgccactccacatttttcatcgcccgtccctgtgcaggcactagccaccatcatatcgactctgctcatgtcaactctgcggctcatcccaacttcgccgcccatgccgtcactgtcgcccatgccgactccatcacctatgccgactccgttgcccatgccaccttcgccgtccatgccgcatccgcttcccatgctgactgtgccttcatgtcctgcacccgtgcaatcattccttccaccattgtcgagtccgcttcctatgcctgttcttcatctgcccaatcttggtctcgtttgcaccaccatttccttcaacaagttctttagcattgttcctctttatgggactaccatggccgcatacaagctccaatcagttgcctttgcattatgctcaagagctaaattgggtgcaattcatcagaatagaccttgggatcccggcatcacttttggaagccatgcgttgaaccccaacaccttgaggacaaggtgtttttgcaagggtcgtgaaatgatagagagacagag

SEQ ID NO: 61753 - DNA, 513 bp, Glycine max
  Peptide Sequence Number=SeqID_153438
atggaagcttattattccggttcttaccctgcgtcgaccaagcctatttctctgcttcacaccgtgcggaaggtacaagcaaaaccgtggaagaaggcggcagtggcgccaccggcaccgacaccgatcagagtgtacaaggtggacgctatcaacttccgtgaccttgttcagcagcttaccggtgcacccgagttcaagccagctgatcaggaacaacatcaacttttcccaagtgtcgcacctattgctgccacctttgtagatacgccccaaaagccaatgttgtcgagcaaagacaatattgcagcatcatcgacagtgtcctcggccactaattggtaccagggggcaaaatctgaaccattggaaatgaatttatcatcaccctcttcttataactggttttttgtccctcctatcagccaaggaaacatgaccagcttggaaccggggaggcttttgtccacagtttgtttcatttggacttcggagcgtacaccagctatctag

SEQ ID NO: 61754 - DNA, 423 bp, Glycine max
  Peptide Sequence Number=SeqID_153439
atggacaaggcagaggcaattcctgctctgataccaaatgagttgaaacctgtggaaacagctttgatcgacgacgggtctcgttttgacattatttcaggcaatttggacgattacgacaatgcctccacgagcggcaacgaagaacatgactcccagacgacggagaagctcacgagggctcaacgaaagaaaatccgtaagaagaagctgaaggaagaagcgatacatcgcggaaaattaattgggccattgttgcctctcacccccactcaagttccagaggatgctccaactgttcgatcaaatgctcctgaagaaggtgatgaagatgtgggggcttgtgctaaatccgtgaaagtgaagcaccggaggatggcaaaaaggctcgccaaagaaaagcaaaatgcctctatttcgtag

SEQ ID NO: 61755 - DNA, 1371 bp, Glycine max
  Peptide Sequence Number=SeqID_153440
atggataccacgttgtttagagtagtgagtagtttccaacatcaccaagctgatcaagatcatcaatccctcaacaactccaccacaagcagcagctctcgatcctccagacaagagcaaaactatccctacccacaagaacacgacgaagaatgcttcaactttttcatggatgatgaagacttatcctcgtcttcttccaagcactactatccctatcaaccccaccctccctccactaccgaccattccttctcccccactcccggcgtcgacgttgtcttccccttcgagttctcctccggaaagtgggcccaggacatcctcctcgaaaccgcacgtgccgttgccgacaagaacaccacccgccttcaacaactcatgtggatgctaaacgagctcagctccccctacggcgacaccgaccagaaactagcctcgtacttcctccaagccttcttcagccgcatcacccaagccggggaccgaacctacaaaaccttagcttcagcttccgagaaaacatgctcccttcgaatcaacccgcaagacggtgctgaacccaaactacacatagttgacatcagcaacacctattgcacccaatggccaaccctcttcgaagccttggcaactcgaaacgatgacactccgcatctccgtttaacctccgtcgtcaccgccggcgccaccgcgcagaaggtcatgaaggaaatcggagccagaatggagaaattcgccagactcatgggcgtgccctttaaattcaacgtcgttcatcatgtaggtcaactctctgacctcgatttcagtgtgctagatattaaagaagacgaggcgttggcgattaactgtgttaacaccttgcattcgatcgccgccgtggggaaccaccgtgacgcggttatatcttcgttgaggaggttgaaaccgaggatcgtgacggtggtggaggaggaggctgatttggacattggattggaagggtttgagttcgtgaaagggtttgaagagtgtttgaggtggtttagggtttactttgaggccttggacgagagttttccgcggacgagcaacgagcgtttgatgcttgagagggcggcggggagggcggtggtggacctggtggcgtgttctccggcggattccgtagagaggcgggagaaggcggcgcggtgggcgaggaggatgcatggaggtggggggttcaatacggtggcgtttagcgaagaggtatgcgatgatgtgagggcgttgttgaggaggtatagggaagggtgggcaatgacacagtgctccgacgccggaatattcctgacgtggaaggagcagccggtggtgtgggccagtgcatggagggccttgacgtag

SEQ ID NO: 61756 - DNA, 2511 bp, Glycine max
  Peptide Sequence Number=SeqID_153441
atggtggaaggagaatttggcgggaagagagtccttaatttctcagagtcacccattcctgctgtcaaggtcgctcaccctgaagaagaaggtggacgtgcacagggtctgcgtgcttcgcgaggcgttcgctctgttcgatttcgacgacgagagcatcgaggatttgaagctgttgttggttcggtgcttgatttcacccttgtatttgaagacggagcatgggaggcggtttctggcgtttgtgtttgggctgagcgatcagcttgggaaggaatttctggcgatgattcggtcgcagatttcgttcgggaggaagtcgatgctggaggcttatggggatattctgtttcgggtgaattgattgaggctgccatacacgctggttccggagtttttgcttggtatattaggagggtttttggaacttttattaaccagaggaccaccgatggggttgagaaaatgctttatcgactcgctgagcctgtcatatttagctctctacaggttgcaaactcaaatgttcgtcaaaatgctttgcatctacttctggacatgttcccccttgaagatcctgatgccacaaaagaggagaaagatacattgcttgataagcagttctttttattagaaaggctacttacagatgattgtctggaagtgagaataattgctgttgagggttcttgtcgcatccttcatctgttttgggaagttattccttcaccaatcataacaaaggtgatgacaaaaatatttgatgatatgtctcatgatggatgcaatgagcacctaatgcttgacaaggttctcgcaatacgagttgctgcagtggcggaactagatgtgctattgtctgcacttgctagtgatcaacctcctgtagctcagaagataacaaaattacttataccttcgtactttccctcaaaaatacccattgaggaggcatgtaatcgctgcattacacttttgaaaagggctccaatggctggcgcaagattttgccaggttgctatcttggaaggagcatttaaatctcatcttatggaactggtcaaagtatttctgagttggattttggcacccgataagctagatgcaaatcagattgagggtttcctttttgctactagctatgtttgtgatagcttggcttgtgagccatgctatataaatgctctcaaagagttacttgatggagagaaaatgaaaggtttactaactgtggcatctaaaggccaagcccaatcttctttattcaacattgtctccattgtctgtccagatgatgttgctggacttcttgaatggataggtgttgttacaaactgcagcggtttacctgaggatgttgatcaacaaactaaaatcaggtctgcgcacaagttgttgctttcactgggcggttttgatgacttgattgaagccttaacagccttcttgcataaggctgcctatcgttgccacattaaatttggtgcagacatgccatctcagtctgttggggtggcatggcaagttagagatttacttctgcatgaagattccagaaaagctattttgaaatctcagagtttagagatgtggtttgtttctcttaagttgatttctgatgtcagcactgtgcattgtgggcaccatgaatacatggatgtatctcctgttttggcatatattgcccttgctctccaaatgactgttgataatgtagacagaagtagcatacagaacggtgatacaaagaggaagaaaactaagattgattcttctacattgttgtcagagaatatcttggagctgacaatagagcatgtgctcaactgcttagaaaaactatttggagcagatgacatcatgaaaaatcatgatgcggattcatcaaaaatactcaatgtgatactcaccgactcctgtgaatcctcaataactctaccaaaagcttttgctcttgccaataacttgcttgatttaatcatttcaattgaatcatgtatgcgctctgggtatgcagtgcgtattgttgcagccgcaaagacttggcttcctgatgtgcttctggcattgggatctacaagtatcctaaaacacactgactgtggtgaggaacattcaactgcatctgaacaaatgaagttgcattttccaaaatggcccttgattttagccaagactgagctctttgaagtaaataaagctgaagatgatgaatcttctcaaccagaaaaattctcagcattcaccaagcttatggaaatgctgattatattactgaaaaaaattcccagtataatggatgcagtcggtgtaattttcatggtttcttcagtaattgggctagaacagaaggactttgggatggcattaggactcttgtggatagagagggaaattgcagaagaaaatgatgatgagctggagaaattaacctatgcaaaggagttgattgaacctctttggatgtatcatctgtatgaaactggaagggtttccttggctgatgactag

SEQ ID NO: 61757 - DNA, 1524 bp, Glycine max
  Peptide Sequence Number=SeqID_153442
atggagagagcagctaccatgggtcgatggaggataagcaattcgtgcgttcgtttcgcgaggcctggccttacttgtgggcctatcgtggatatagctttccttaatcacctaggaatccgctttgttcttgttccggggacacatgtgcagatagacaagcttctgaatgagagagggtgccagcctatgtatgttggtagatataggataactgatgatgaatctctggaagctgccatggaagcagctgggggcataagattgatgatagaagcaaaactttctcctggaccttccatatgcaacattcgccgtcatggtgacaatagtcgatggcacgaagttggtgtcagtgttgccagtggtaactttcttgcagccaagagaagaggggtggtcaatggaattgattttgggtcaactggggaagttaaaaaagtagacgtaactcgcatgcgtgagagacttgatggtggctgtgtagttgtattaaccaacttgggctattccagctctggagaagtattaaattgcaagggcaaatacagagaacttaatggtacagacttttcagcggagtatgtgaatcagaataccactagtgttaccaatggcacctatgaagttgccactgcttgtgccttggctataggggcagacaagctaatatgcataatagatggtccaatacttgatgagagtggacacctaattcgtttcttgcctcttcaagaagcagacatgctaattcgtaaacgggctaagcaaagtgatgcagctgctaactatgtgaaagctgttgacgaagaaggtttcaactctcttgagtgtaacaattttaatggaacagtcaaatcaccacctattggatgttttacagaatggcataatgcaaccttccataatggtgttggttttgagaatggaaatggcttagggtccggtgagcaaggttttgctattggaggtcaagagcggctaagtcgaatgaatggctacctggaaggaaaaaacttgagggcgagccctggtgcagcggctgcgtacaacatccctcctccataccttcgcatagcgaagagcctctgggcaatggggtacgaaggtggtgttcaaagagttcacttgctggatggaactattagtggagttttgttgttggaattgtttaaaagagatgggatgggaacaatggtggctagtgacctttacgaaggcactcggacagcagaggtaaaagatatttctggaataaaacaacttattcatcctttggaggcatctggcatattggttaagcggactgatgaagagctgttaaaaacattggattcattcgttgttgtggaaagagaaggtcacataattgcttgtgctgccatttttcctcactttgaggagaagtgtggagaggttgcttgtattgcagtatctcctgattgtcgtggccaaggacagggtgacaaattgcttggtatgctattgcctctgtggttggtgattcttgtgcttgatgggtag

SEQ ID NO: 61758 - DNA, 636 bp, Glycine max
  Peptide Sequence Number=SeqID_153443
atgggattgtgggaagcttttctcaattggcttcgcagcctttttttcaagcaggaaatggagttatctctaataggacttcagaatgctgggaagacttcccttgtaaatgtagttgctaccggtggatatagtgaggacatgattccaactgtgggattcaatatgaggaaagtgacaaaagggaatgttacaataaagttatgggatcttggagggcaacctaggttccgcagcatgtgggaacgttactgtcgtgccgtttctgctattgtcaaggaagtgagtaggttacagcttcttgaatctttaagcagacttgattatccttcaaaggtgagttgtgcggaccacagttatgttgttgatgctgccgatccagataaccttagcatatcaagaagtgagcttcatgatttgctgagcaaaccatcattgggtggcatccctctgttggtattggggaacaagattgacaaagcgggggctctgtctaaacaagcattgactgaccaaatggatttgaagtcaattactgacagggaagtttgctgcttcatgatctcgtgcaaaaactcgaccaacatcgactctgttattgactggcttgtaaagcattccaaatcaaagagctga

SEQ ID NO: 61759 - DNA, 234 bp, Glycine max
  Peptide Sequence Number=SeqID_153444
atgaagatacctgcgacactcgacgagacaaagaacgtgtttccagatttttgtcctcgtcttatttatcactcaaatgtgacaaaagaatttttgtccaatgagaaaaagcaagtatattttccagctcatgtctggcagagaagaatttatcagatggggaagctcttcaaccttgagtgtgggcttataaaagaatctccaccactgcttcagtctccatgtgaaccatga

SEQ ID NO: 61760 - DNA, 744 bp, Glycine max
  Peptide Sequence Number=SeqID_153445
atgggaactgctatgccaaacattgccccaggtcttatcttcatcatcgcatggatttctgggttagagaaagtcaacttaagcaacaagtatagcaaagtaaaaatattgggaacattgctttgtgtgttgggcgctctcacaatgagcataatgcaaagcatttctgatcctgaaaccgtgaaaaatgccacagtcgaattaacaccgccactaccatctggtcttgcctttgacatacagaagatactcggttgcctctatctcgtggttgcagtcttcattttgtcaagcaacgttgtcctgcaggcttttgctcttggagattttcctgcacccatgtccttgggtgcaataacgtccttgattggggcgttcttgactgcaatttttcagtttctcgaagacaacgaaatgaattggctacttgtgaggtctggagacttggttggcttttttattctggcaggagctgtgagtggaatatgcctgagcttcaatgggtgggcattgaagaagaaagggccagtgtatgtctccatgtttaacccaattggtacagtttgctctgttgttttctcagcagttaccctagaagacactattagtattggaagtcttgcaggcatgtttctcatgttcactgggctctacttggttctttgggccaaaggaaaagaaggacacgcaggtggagatggcttagagtgtgagtgtgatgcagagacgcctcttttatcttaa

SEQ ID NO: 61761 - DNA, 120 bp, Glycine max
  Peptide Sequence Number=SeqID_153446
atggaaaggaaagcaagtgtagcgcaaatggctttattaattttgatgcaatgctgcgtctcgccgcatttggcatggaccccatcaagcaatgaggtacataacatgttcaacggttaa

SEQ ID NO: 61762 - DNA, 1626 bp, Glycine max
  Peptide Sequence Number=SeqID_153447
atggtttatctcgccgtcgctggtgccggatacagctcagtcgtcggaatcaataatcggaggccagaatttttcatatcaattataccaaacggcgccattccaacgctctatttcgtcgcatctctgtgtcggtgctgcagagaacatggcttcagtagcgcttccgaatccgcttggacagattttcccgtagagaacgcgtatgagctgttaggagtgtccgagaccagctcctttgacgagattaaagcgtcgtttcgaaaattggccaaagagactcacccggacctagctgagtcaaagaacgattccactgcgtctcgacgatttgtacaaattctggctgcctatgagattctttcagattctcaaaagagagcccattatgacatgtacctgttgtctcagaaaaaacttatgcaaaggcatcctggacagggttcaaaattgcaaatttacaaatcacaggctactgcgttcaaggagatggaagttgttgaatggttaaaatggtacagattaactataaataatattttggcagaaaagaagatggtagttggaactggctattttgatgtatttgagagagatttttattcagctatttatgcagcatactatggtcctgaaattcagtccatggagcttcttcctgactgctttgaggctgaggagaggtcctcttatgaaactcctgaggttttgcacttagtttcaggacgtgatcttttcggaatggtttgcctagctaacaaggttccagagatatcaattactaacaatgagaagttaacatcttttagatccttccattcaggcctgtgtcaatctataacagatttgaacgtccacaagaatgcaaaaagatcagatgattttgaaactcaccgaggtcacagctctaaaacttcaagtattgtatcagatgcatatagacatctagaattgcacatctctggaagagtgattgctacagcatctagggccctacccagatgctgttctgatgagatgcagacagaagatactgaagatcatattcatgtgttccttaatttatatgaagatcccaaacatatcagcagtgatttttggaaagattaccttgcaaatggtgcagttggaagaagaattcacttgggaaccatatctggacttgggagcagtccagatgaaggttcttgctatgtctacaatgacaagggtacaaagacccatgtgattatgaagcatagaacattgatggtgaagcatatgcattggtatgaagtgagtgagaaagtttcagtttgtgaatgtagatgcactagagcacgcttaccaccaagcaaattttggctatttgagcctcgttgtggcttccatgacatagggggttggtacgttgaaacatatggcaaagataagaatggtcgtacaatgccatcacaaaggttctgggatggcttggactatagtgagcaagctgacagaagacttcatccagcaatgtatctgtttgctcttgcatatcggacacttgatcttgaatatgccaaagcaagcaagaaatcatttaggaatgttgttggagcacaaatgttccgaattcttcattggtgcaagaaacttgttcaatag

SEQ ID NO: 61763 - DNA, 3285 bp, Glycine max
  Peptide Sequence Number=SeqID_153448
atgcctcctgaacagacccaacaacctctgttatcggaggagcaagaagagacagcctacgattcctcggagaaggtggtggtggtcggaatcgacgaccacgacggcgacgtggaggcgccgccgttctcatggcggaagctgtggctcttcactgggcccgggtttctcatgagcatcgcgtttttggatcccgggaatctcgagggggatcttcagtccggtgccattgctgggtactcgctcttgtggctcctcatgtgggccacggctatgggccttatcatccagcttctctcggctcggctcggcgtggctacgggaaggcacttagccgaactctgcagagaagagtatcccacatgggctaggattgttctgtggttgatgactgagattgctcttattggcgctgacatacaagaggttattgggagcgctattgctatcaggattcttagtaacggcgtcgttccactctgggctggtgtcaactacggtgtgaggaaactggaagcgtttttcgctgttctgattggtgtaatggctctctcatttgcctggatgtttggtgaagccaagcccaatggtgttgatgttcttgttggtattttggttcctaaacttagctccagaactatacagcaagctgttggagttgtgggttgcattattatgcctcacaatgtgtacttgcattctgcgcttgttcaatcaaggcaggttgatcccagcaagaaaggccgtgttcaggaagctcttaattactactccatagagtccaccattgcccttatagtgtcctttgtcattaatatatttgtcacaactgtgtttgctaagggcttttatggtactgaaatagcaaatagcattggtcttgtaaatgcagggcagtaccttcaagagaagtatgggggtggactattcccaatcctgtatatatggggtatcgggttattagcagctggccagagtagcacaattactggtacatatgctggacaatttatcatggggggttttctgaatttaaggttgaagaagtggataagggcattaattacacgaagttttgcaatcatcccaaccataatagttgctcttatatttgatacctcagaggaatcgttagatgttctgaatgaatggcttaatgttctccagtcagttcaaatcccctttgcactcattcccttgctttgcttggtgtccaaagaacagataatgggcagtttcagaattggccctgtcctcaaggtatattatctcctttatctgaattttggccacactgttccggtctcgtttcgatctgcgccaccgctcagaccagttagactcatggcgtcgctatggactcaactcatatccacggtgtccttaattctatcccttgcgcggtgggttgctgtctccggtgactccggcaacgtgttactctttccaagtcgtcatcacgagggttctcgccctgccatgattctcccccttcatcactctgttcccgaatcttccctctctcactttaatcctcgtcgtcatcttcagggatcccagtcagaacaccatcccaacgctcgcatgagactcttcgacgatctccttcgaaacggtaggtattatacgacgaggctttggatcggtactcctccgcagaggtttgctcttattgttgatacggggagcactgtcacctatgttccgtgctctacttgcaaacactgtggtagccaccaggatccaaagtttcggccagaagcttcagaaacctatcaacctgttaaatgcacatggcagtgcaactgtgatgatgacaggaagcagtgcacatatgagagacggtatgctgaaatgagtactagcagtggggtccttggtgaggatgttgtatcctttggaaatcagagtgagctttccccccaacgtgctatttttggctgtgaaaatgatgagactggtgatatttataatcaacgtgctgatggcatcatgggtttgggccgtggagatctaagtatcatggaccaactggttgagaaaaaggtgataagtgatgcgttctcactgtgctatggtggaatgggtgttggtgggggtgctatggttcttggtggcatatctcccccagctgacatggtctttacacattcagatcctgttcgaagtccatattacaatattgatttgaaggagatacatgttgcggggaagcgactgcatttaaacccaaaggtttttgatgggaaacatggaactgtcttggatagtggcacaacttatgcatacctaccagaatctgcatttcttgcatttaaacacgctattatgaaggaaactcactctttgaagcgaataagcggtccagatccacattataatgatatatgtttttctggtgcagaaattaatgtctctcaactctctaaaagctttccggtggttgaaatggtatttggaaatggtcacaagttgtcactgtctcctgaaaattacttgtttcggcattcaaaagtgcgaggtgcgtattgtctaggggttttctcaaatggcaatgatccaactactcttttaggaggcattgttgttcgtaacactcttgtaatgtatgatcgtgagcattcaaaaattggtttctggaaaactaattgttctgagttatgggaaagactacatgtctcaaatgccccaccacccttgatgcctcctaaatctgaaggaacaaatttaaccaaagcatttaagccctctgttgctccatctccatcacagtataatttacagctaggtgaactccaaattgctcaactaatagttgtaatttcatttaacatcagctacatggatataaagccttacatcacagaattgactggactcattgctcatgaattagatgttaatacttcacaggttcacttaatgaatttttcttctcttggaaatggttctctctctagatgggtcataacaccaaggccatatgctgatttcttttctaatgctactgcaatgagtatgattgcccgactttctgaacatcgtatgcaacttcctaactcattcggaagttacaagttacttgagtggaatgctgagcctccactgaaacggacttggtggcagcaatattatttggttgtggctttagctgtttcgcttacattggttctaggaatatcagccttaggaatattcttaatttggaaaaaaagacagcaagctgagcactcatacaagccagttgatgtagctgttcaagagcaggaacttcagccattatga

SEQ ID NO: 61764 - DNA, 270 bp, Glycine max
  Peptide Sequence Number=SeqID_153449
atggaggaacgatttggagtggttctcgcggcggagagcaacgaccgagagagagatccgcagcgccacaccgtgtttttggggtttaggcagcgtgtgaggaaaaagctaaaccctagtgtggttattgtcagagcacccagcccacattggactggactgtggcccaggcatattgttcaaactgcaaaggcccttttggacaccatgtgtttaattacacggactttctttctgcaccccatacatctcagcttacacccactttaa

SEQ ID NO: 61765 - DNA, 555 bp, Glycine max
  Peptide Sequence Number=SeqID_153450
atggtggaacagttggcggtggcgaagccgagccggccgagcgacgaggtgcaagtgaggatcgctaatgagatcagagccgaattcgatgccttggaaccaaagcgacccatcaaacccaacagaagcgaacccgacgccgttttgcaacacccccccgacgcctccgtcaataatatacctgagcttcacaagtttcgatcccttcaatctcgctctcatgtctctaaccactctctccctctcaactatttcgctataatttcatcggcggggattgtggatgcacatgatgagtttgtggagacgcagtactataaagaattggcagcgattgacaaacagcatcacacgacagggagtgggttcataaaggcggtgagagaaggaggggaaggtggatatgagattcatgttaatgctgctgaaacccaacccagaggctataaaagcaaccctgccaccaacgactgggttcctaactctgaggaatatcaggttttcgtctcgtccaagccaaataggaggagagtacttgatgatattgctaggtga

SEQ ID NO: 61766 - DNA, 906 bp, Glycine max
  Peptide Sequence Number=SeqID_153451
atgctcttagcagcatcctacggcgaccattggcgcaatctgcgactcgagatcctctccactcaccgcctcaacttctttttggaaatccgaaacgacgagacactcaagctactccgaaacctggctatggcttctaataataaaaaagacttaacaaaagtggagttcaggtctatgctcgaggatctgacgtttaacattatcatgagaatggtgtgcgttaaacgctattacggcgaggaaaacgaagggaccatcgctgaggaggctaacaagtttagagacatcatgaatgagatggcgcagttcggtttgggatcgaacctcggagatttcgtaccggtttttgagatggttagatttgggtggtggccgcaagaagctacgaaaaactggggagaagaggacgcgttgtttcaagggctcattaacgagcatcggaataagaacgaaaattcaaatactaccatgccccatttctcctcggaagattgcacggtgagaggttttggcgtggcacgtaacacgatattatttgtgaatgcgtggactattcatggggacccagagttgaggactgacccaaagtgttttaagcctgagaggcatggctccaagaactttgggattgactttagtttcgttgattcaatgcttttgagtggaaaaggattgacgaggaagaagttgacttggctgaaggacggggaacttcccaagttaatgatggtgatggccggtgacgagcacactcatatggtgactgcaactgtggttatagtagtgacaacgatgatgacgaaggtcatggacaatggtggtggtgtcaacggtgatgcggtcgtagtgttggaggtggtaacaattgatgacaatgatggtaatagtgtaaaatcatggtga

SEQ ID NO: 61767 - DNA, 1008 bp, Glycine max
  Peptide Sequence Number=SeqID_153452
atgcctcgcccacattctccttctttcctcctctgtcaagaacactactctttcactttccaacaacattctcaaactctctccaacacccaaccttctcctttgacttttcccgacaacctccaacacgacctccttctctctctactctccaaacagcgcgccacgcattccactctctcccctcgccaccacgttgtacgtttgatttctaaactctccaacttccacggcttctctcctctcaccaccgttctcgccgttaactacttcgacaggttcgtcgccaccctaaggtttcagagcgaactaaaaccatggatgactcaactgaccgcagttgcttgcgtctctctcgccgccaaagtggaggagacacgagtgccacttctttcggacttccaagtggaggaatcgaaattcttgtttgaagcaaagactatacagagaatggaactccttgtgttgtccactctcgaatggaaaatgaaccccgtcaccccaatttctttctttcaacactttctcacaagccttggtttaaagcgccatttgcattcggagtctctccgtaggtgccaacgtcttcttctctctgtcattgcagattcaagggttatgagttatcttccttctacagtggctgctgctataatgatccacgttatcaaagagattgagccgttgaatgctacggagtaccgaaatcagctacttggtttacttaaaactagtgaggaacaagtggatgagtgctacaaacttatgttgagactattagtttgcagcaaaggcattcacaatcttaggcgcaagcgtttgtctgaacctagtagcccagatggggtcattgatgcatctttcagttgtgacagttcaaatgattcgtggacagttgcatcaccttcagtggggccactgattaagaggagaaaacctcaggaccagcagatgccgctgcctccggtgaatcgagtggccattgatgttctaaaaactcctcgttaa

SEQ ID NO: 61768 - DNA, 992 bp, Glycine max
  Peptide Sequence Number=SeqID_153453
atggctgcctactactcacagccccaaccgtcgggccttctcccttaccagtactaccaacagccgcctccgccacctcctccgccgatgatggcggtagtgccaccgccccccggcgcggttgtcccgccggcgcaccacctgcatccgccttacgtggctcagcatcagcagcaagcggtgttcggttcctacggtgctcctcaatcctccacccacgaggttcgcactctcttcgtcgctggcctccccgaagacgtaaaaccccgcgaaatctacaacctcttccgcgaatttcccggttacgagtcctcgcatcttcggagtccctctaattcgtcgcagccttttgctttcgctgtgttcgcgagtcagaagtcagcaatcttggcaatgcatgctctgaatggactggtgtttgatctcgaaaagggttccactctttatattgatcttgcaaaatcaaactctagatctaaacgcacaaggatagatgatgagagggttggcgcggataagaaagctagaggccttacaccatcatggtccactcctgattctgttcactattgttgtgttatcgtctattctgttgcttggagcattcacatgccaggaatgggtaatcctgctttcaacacgaacacgtttggttatccatctgcacaaagtcttgggaatgctgatgggagtgccatgagtgacagtctatttgcgaatctgaagaagtcttcaacaccttacattcctcaaaactcaaccccatgtgcaactttatttgtagctaatctggggccgtcttgtaatgaacaagagctaatccaagtgttttctagataccccggattcttgaaactgaagatgcagagcacgtatggagctccagttgcatttgttgatttccaggatgttggtagctcaactgacgctctaaatagtctgcaaggcacaattcttcactcctcacaatctggcgagggaatgcgtttgga

SEQ ID NO: 61769 - DNA, 849 bp, Glycine max
  Peptide Sequence Number=SeqID_153454
gagggtgttgaggctccggccgaagaagttccaacaaaggctgcttcttctaggagttcatctaaaagatcaagagctgcagaagttcataatttgtcagagaagcggagaaggggtaggatcaacgagaaaatgaaggctttgcaaaacctaattccaaattctaacaagacagataaggcttcaatgctcgatgaagctattgaataccttaaacagcttcagctacaagtacagatgctgtcaatgagaaatgggttgagtttgcatcctatgtgctttcctgaaggcttgcagcctctgcagttgtctcagatgggtatggaattaagtgaaagaaacaggtttacctctttaaacatgtcagctactctgcctctgcaccaagacaacaatcccttgcactatgcatccaatctacctaacaaacacaatctcccaaatcagccatctgtgccctatcctccatacattgacaacccagaaacttctttcggtctggaaccccgaatccaaacggatatgaaacctcttcaacacaaaggaggatcttctgagccaatacgaggggaagacattttgcagcaccagcaatcaagtggtatccattcagatgccaatacattaggtggttctcaagttgtcaaagaattcgaatcaggcacgagactatcattcccttttgacacgcaagcatgtgaacccaaagacaacagcaactcttcgcaaccatgcattggcggaagagatcattcaggagtgatcataagaaatagtgagaccaacattgttggtagaagggagaaagtggtcagtggcaactcgaagaccgaaaagtcagatttttga

SEQ ID NO: 61770 - DNA, 1179 bp, Glycine max
  Peptide Sequence Number=SeqID_153455
atgcgacgctggactcagctgccaaacatgtcctgccaatggaaatacccgaccaagatgttcgcggacacaacctttgagccccacctccaaggcttagcgtttaaccggtattcatggctgacgactcataactcttatgctctggcgggggcgagatcggccaccgggtctgtcattgtggcccctatgaaccaagaagacaaagttgatgaacaactcaaaaacggagttagaggatttatgttggatatgtatgattttcaaaacgacatctggttgtgccactccttccaaagcaaatgtttcaacttcactgcatttcaacctgccataaacgtgcttaaagacatgcggacatttctagatggaaatccatcagaaattatcacgatcttcattgaggactatgtcacagctcctcagggcctaacaaaggtcttgagagattcagggctgagcaagtacatgttcccagtgtctcgcatgcccaagaatggtgaagattggccaaccgtcgatgacatggttcagaagaatcagcgcctagtcgtcttcacttccaaatcagccaaggaagcttctgagggcattgcttatcagtggacatacgtagtagaaaaccaatatggagatgatggcatgaaagctggttcttgtccaagccgtgcagaatcacccgcaatgaacacaaagtctagatcattggttctggtcaactactttcattctgctccaaatcgatctcaggcctgcgctgacaattcggctccactacttgacatgatgaagacttgtcacgaagcagccggcaaccgttgggccaatttcattgctgttgattattaccagaggagtgatggcggaggagcaccactagccgttgatgaagcaaatggtcatctcacttgcgggtgtgacaacattgcctattgcaagaaataccatgattactacttactactgcgtttttaccactgtaaggaaaacgctaagtctggcacatgtgatgtccctcccatttctccacctccacctgctacagaaaccccctccaccggaaaccagcagacccaaaataacaatcacacaaacaatgcttatattggtagaacggccaagttgatgcaatcggttgttggaattttggctacgacgactttcttggcatggttatag

SEQ ID NO: 61771 - DNA, 729 bp, Glycine max
  Peptide Sequence Number=SeqID_153456
atggacgtggacatactgaaaacttccacgagtgacaacatcagcatggacatgatgatgacgatgatgcaaatggaaaagttccctgaattttgtgaacctttttataacaacaacaacaacactagtactgctcctctctacccagaaaacgagctcttaataaactccaccaccactctacccgtgttctccaacgttattaacaacccaaacgttataactccaccaccatcttcctctaattttattcaacaacaacccatgacaccccatcttgaacccaacttggagaagaggaattctgtggcggctatgagggagatgattttccgcgtagcagtgatgcaacctattcatatagaccctgaatccatcaagccaccgaagagaaggaacgtgaagatttcaaaagatccgcagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcagacgctggaacaagcaggggcaagtagacccttgaatgttgttggcttccctactactgcgtccaacgccaataataataatagttattctggttttgtgaagagttgtcagccttatccaatgctgggttctgcagcttctaaacaattgcttagttga

SEQ ID NO: 61772 - DNA, 828 bp, Glycine max
  Peptide Sequence Number=SeqID_153457
atgccagattttcaagaaaagcccacaacccaagtcttggttgttttggacaagcatgaggaccgcgatacttacgtggtggctttccgaggaacggaaccctttgatgcagatgcatggtgcactgaccttgacatctcatggtacgggattcccggcattggaaaaatgcatggtggcttcatgaaagccttagggctacagaaaaatgtggggtggcctaaggagattcaaagggatgaaaatcttcccccctttgcctactatgttattagggacattctaagaaaaggtttaagtgaaaatcctaatgcaaagttgattattacgggtcatagtttgggtggggcactcgcaattctctaccctacgatcgtgttcttgcatgatgagaagttgctgatggagaggttggaagggatctacacttttgggcaaccaagagttggagatgaagcatatgcacaatttgtttattgcaatgatatagttccgaggttgccctatgataacgacttgctcttcaagcactttgggatctgccttttctttaacaggcgctatgaactcaggattctcgaagaagagcctaataagaattatttctcgccatggtgtgtgatacccatgatgttcaatgctgttttggaactaataaggagctttaccattgcgttcaagaatggacctcactatagagaaggatggtttctttttggcttcaggttgtttggtttgctgattcctggcttacctgctcatggtccacaagattatattaattccactcttctgggatcaattgaaaaacattttaaagcagattga

SEQ ID NO: 61773 - DNA, 410 bp, Glycine max
  Peptide Sequence Number=SeqID_153458
atgggttggctggctgggtacgagtacgattcaacttgtgtctttcgtgaaaggcaagacagtgaagcttcaagtttcaacattctcctggagtgggaatggaatggaacatctgtagtgttgacttttcacgcggaggctggcatgcatcaatcgtcattagctacaagtgagcgtgtctggaaaacgttagatgaagtcacttgtagcagggaaaacaaattgagaaagaaactacgaatccacggatttatggacgacacctctccgaaaggcgcgttcgccgtaaaggcgacacgtggcagcacttgggacgcgccctgcgtacgtagcgctgctgcagcaggcgcgtcgggtcgtgttgggtacccaggcgcgacgggtcgtgctggggacccaggcgcgaccca

SEQ ID NO: 61774 - DNA, 1305 bp, Glycine max
  Peptide Sequence Number=SeqID_153459
atggaaaatccatcttctcccgaagctccggctccaaaatatgagaatctgattacggttctcagcattgatggtggtggtatccgaggaatcattcccggcgttattcttgattaccttgagtctcaacttcaggagttagacggtgaggatgcaaggcttgcagattattttgatgtaattgctgggacaagtacagggggactcgttgcttccatgttagcagctccaaatccaaaggccaacaatcgccctttatttgctgccaatgaaatagtgccattttacctcgaaaactctccacaaatcttcccccagaaaagggggggaatattcgctccgttggtaaacatagggaaagctttgacaggacctaagtacgacgggaagcatttccatgagttgataagaaacaagttagggggcacaaagttgcaccaaaccttgacgaacgttgttattccaacttttgacgtcaagatacttcaacctaccatcttttcctcgtatcagatggcgaaggagccaacgttagatgtactactgtcagatatttgcatagccacttcggccgctccaacatttttgccggctcattattttacaaaacaagatgaacaaggaaaagtgataaaagaattcaaccttattgatggcagtgtggctgctaataatccgactttatgtgcaattagagaagtgacaaagcaactgataaggaagggaaatgggggaattagtatcaaccctttggagtatagtcgttttcttgttctctcaatagggactggatcaaacaagagtgagcacaaatacaacgctaagatggtgtcaaaatggggaattttaacctggttattcaactctggatcaactcccattttggattgttttagcgaagcaagctttgatatggttgactaccacaactgtgtggtttttagtgcgcttcaatctgaagacaactacctccgcattcaagacaatacattaaagggggatttagcatctgtggatgtagctactaaagagaatttggataatctggtcaaagtgggccagcagttactgaagaatacagttacgcgggtgaatctagatacgggtctctatgaaccagttccagataaaggcaccaatgtttgcaaaattactttcggaggcaagaaaggggagaaagtccaactcacaatgacaagaagatgggaagtaaatgatcgccagctgaatgaagaaaataattgttgccgatattcaaacttaaattctattgatagtataaacattatttccattgttgcctaa

SEQ ID NO: 61775 - DNA, 1080 bp, Glycine max
  Peptide Sequence Number=SeqID_153460
atgggtgagtttcactttcataatgtatttgacaaagacggtaatgcacaagtgcaagtgggcgcaaattctagagcacacaggcgctctaacagtgcttctgacaggaacctgaaattctcaaggggtagagttttccatcctatacagaaagacaagcatgaatctcttgcttcaccaccttcagtgagggcttctaggttctcaagtccgttacatgacaacctcaccggtaacaagaaaactttttcaaatcctagagcatccttggaaaaagatgttgaacagctacagctacgcatacagcacgaaaaatctatgcgtattctgctcgagagagcaatgggccgtgcctcaagtactttatcacctggacacagacactttgcagctcagacaaaagatttaattgctgaaattgagttacttgaagaagaagttacaagccgtgagcaacatgtgcttgccatgtacagaagtatttttgaaaattgtgtcagctggccaccttctgaacaaaattctggtgtggcttcaccagctcatccaaggtatgaatccaggaagcatccaagtataatttcaagtgctttctgttcatcaaaaaagtttcccttgcgacccttgcaagctttgatttcgaataatgacttgaagaatagaatttttggatcaagttatgctcctttatcatgtggcaagggcgaagtttattttggaaagacttgtcctgattccaccaaggttaatgagaagttttccacaaaggagaaaactccagtattgcgaactttaaaatatcatctaaaccagtgcccaaacaggctttctgaggagatggtgaagtgtatggcaactgtatattgctggctccgtagtgcaacctctgtaaatagtgaaaaaagtagatcacctttattatcaaggtcatccactcatgctgcacagacaagacatggtgttggggaggatcaagactgttcttgcaaatcagtagtggagatatcttggatagctacacgtaaacgtcattcttctcatgcttcttacgccattgacaacttcaggttggctctttaa

SEQ ID NO: 61776 - DNA, 6342 bp, Glycine max
  Peptide Sequence Number=SeqID_153461
atggattatgatgacaatgattttcaaaaccagaatctccatttagctggtgaagggagtgccaaatttcctccagtattaaggccatatgctctcccgaagtttgattttgatgaaagccttcaagcaaatttaagatttgatagtttagtagaaactgaagtttttcttggcattgaaagtaacgaagataaccagtggattgacgcattctcccgagggggtagtggcatagagttcagttcaactgcagccgagtcttgctctatatcaaggcatggcaatgtttggtctgaggcaacttcctcagaatctgttgaaatgcttttaaaatctgttgggcaggaggactatattcctagacaaacagttattcaggaatcagatgcctgtgatgaactggcctgcttagctaagcaaatggacaccaatccaaaatttgatgataaaaatgaatttagaagtagtgtttcagatttacatccacctggtggtatccatactggtttttctggattgaaagaggatgtaggaatggagaagcctcatggtggagtctcccaaggtcatgaaggggaatcatccattgatggaacttcaagtaaccccaaactaagtgatatctgcagaaatattgacttgcctgtgtctgaggggagtctgactcttgataccaatgacaaaaataacaatacaaaccaaagagaagttgagactgttgatgatgactcacatcatggcaaaactcaagatgattcatctgcagtgcaaactaatattgctgaatcatctataaaaaatatgggtgatgacaagagagatcctttacaagcacaaacttataatcaagatttggaatcttctctgatggataaagaagctgttgtggacacacaaactctggatcgagacatggttgggagtgatgcacatcatctggataaacccctttgttcaatccccacagaagaaaatttggaagggggtgtagttgaaggtcttgagactgggttaagtagtttagagggttccttaacaatggaatctgttgctgcttctggctcgccgaaagttgaaaaaaccagtgaagatatgtgtttcagtgctctgtctcagaacaatgtaagtgaagatgtaatgttgcttaacgatgtggaaatggatgaccagtctgcaccaaatacatgtgtattgccaaaatcttcaagtaaagatgattctatctcggaggggcaagcagttgaggttagtaatttaaattgtgaaaattgtccaaatatgcaccagaatgtggatgtcatagagaagacgacacatggcggcagcagtgttactaaggaagatgagctattgaacactggtgatcatgtggatacagtgattttgtcaagcaagtcagagacatctatgcctactgcagaagaaagtaacatttccactattaatgaaggaaatagtgacaatatggtaggaagtttttcaagtagcagtgcgacggccttttcaacaaaatcttccattttgggtgagtctactcaaatatgtgtaaacaatgaacctgacagacagaatgaccatgaaaaatgtgatctagatgtctctgtcaatgatcaggatgaactaatgaacactggtgatcatgtggatacagttatattgtcgaacaagtcagaggcatctatatttacttctgaggaaaataacatttcctccatccgtgaaggaaacagtggcaaaaaggtagaaggttttcctagtggcagtgtgaaggatttttcaacaaaatcttccattttgggcaagtctactcaaatatgtgcaaacaatgaatctgacagacagaatgaccaggaaaaatgcgatcaagttgtctctgtcaatgatcaggagcatgaaaaggttccttctgattctagccagaagcattgtgatgtcgataagggtgttgtttcatcatctattagtgaaggtagcatggaaatcaagttgacaacttccacagtatcaatccatgtcacacctatcaataattctgtttcacaagttgtttcggaaaataatagtttgacatcacatgagataatagacattccaccttctagcaaagttgtttccactcatgaagttactagtcacaatgaatttcaagggataactcctgttggaaattcttctgccgaggaaaagggagaatctacagcaaaagctgaggaagcaggcacatctaccctcgttggatgttctgagcaggaaactgcttcttgtcctgtcccaggaactgaaaaacatcattcttctgatacttctaggcaattgttacatgacagcgattgcctgcataatgtagggactagtgctgtaaagattggtgaacctcaaggaacagcaaatgataaagttattcaggaatctgcaaaagagactggtatgcctcaagttctatgtgcatcatccaagaaacagagtgacgttgtcacagtttctttagttaaggatgacaagaagactgtgcaggagaatcctaacgagtcttcctcagaaaaaataggaggtggaagccattccctaactgaaaaggaaaataatcaagttgaggcttcacctactcagaacccccaagtttctgaagatctaaaggagaataatacatctaaagatgaaagaaggtcaactcctgaggtaaattcagtgaatgatttgtccaaaaagggtgctacagctgatgttggcaagatgcaaccaattcctgttactgaaaccgtcaaaacatcattggctgtggaggagggatctccttcaacttctgggcgaggtccctcaaaaatcaaatctgttggagatgtagcacatggtgcttctaaagctacacctgagcgcaaaactagacgagcatctaataggagtgctggaaaggaatcttctagaagaggaagtcatgcaaaggacactacactggctagacagactgatagaggtgataaatcaaccaaagtttccctgagcccatctcctggttttcagatgatgcagtcaaacgaggtgcagcagtttgggcatattgactcaaatagtacaaagtcatttgctgttgtaaatacttcaacatctagccttccagatttgaacacttctgcttctccacctattttgtttcatcagcctttcacagatcagcagcaagtacaattacgtgcacagatcttcgtatatggagctttgattcaaggcacagtaccggatgaggcttatatgatatcagcttttggaggatcagatggtggaaggagcctttgggagaatgcttggcgtacctgcatggaaaggcaacatggtcaaaaatctcatcctgctaacccagaaacacctctgcaatcaagatctgttgctagaacctctgatttgccacataagcaaagtgctgctcaaggaaaaggtatctcttcgccacttggtcgaaccagcagcaaggctactccaccaattgtaaaccccttaatacctctttcatctccactttggagtctatcaactctaggtctaggtagtgattccctgcaatctagtgccattgcaagaggttctgtcgtggattatccacaggcaattactccattacatccttatcaaactactcctgtgaggaattttcttggacataacacaccttggatgtcccaaaccccccttcgagggccatggattgcttctccaactcctgtaactgacaatagcccccagatttctgcatcacctgcctcagatacaattaagctaggatcagtcaaaggatctctgcctccttcctctggcataaagaatgttacttctggtgtctctacttccagtacaggtttgcaaagtatctttacaggaactgcctctctgcttgatgcaaacaacgtgacagtatcacctgctcaacacaattcagatccaaagcccaaaaaaagaaaaaaagttgtggtctctgaggatctaggccagagggctttgcaatcactggctcctggtgttggtagccatacatctactcctgttgcagttgtggcccctgttgggaatgtgccaataactactattgaaaaatcagttttgtctgtatctcctcttgctgatcaatccaaaaatgatcggaatgttgagaagaggattatgtcagatgagtctcttatgaaagttaaagaggctagggtacatgcagaggaagcttctgctctctctgctgctgcagtgaatcatagcctagagttatggaatcagttggataaacataaaaattctgggttgatgcctgatattgaggctaaactagcttctgcagcagttgcagttgcagctgctgcaaccattgcaaaggcagcagctgcagctgccaatgttgcctcaaatgctgctcttcaagcaaaactaatggctgatgaagcattgctttcatctggttatgataattccagccaaagtaatcaaatttctctttctgaggggaccaataacttgggaaaagctacccctgcttccatcttgaaaggtgctaatggaatcaatagtcctggttctatcattgttgctgccaaggaagctgttaaaaggagagtggaagctgcttcagctgccaccaaaagagctgaaaatatggatgccattgtgagggctgctgagctggcagcagaagctgtatctcaagcaggaaaaattgtaactatgggtgatcctttgcctataagtcagttggtagaagctggcccagagggatgtttgaaagcaacccgagagtcttctcagcaagttggattattcaaagacattaacagagatatggtgaacaataatgtgagagatattcctgaaacttcttatacacataacagagacattttatctggtggcatttctgctcctattaagatcaatgaaaagaattcaagaggagcaaagggacacaaggttgtttctgatttagtcaagcctattgacgtggttcctggatctgagcctgaaattcaggctcctccttttactgttagtaatggatctgaaaatctggtggaaagtagcatcaaggagggcttactcgtagaggttttcaaagatgaggaagggttcaaagctgcctggttctcagccaatattttgactttgaaggataataaagcttatgtaggctacacttcacttgtagctgctgaagggccattaaaagaatgggtttcacttgaatgtgatggagacaaaccccctagaatacgtgctgctcgtcctcttaatactttacaatatgaaggaacaagaaagagacgtagagctgctatgggagattatgcatggtctgttggggatagagttgatgcatggatacaagaaagctggcaggaaggagtcataacagagaagaataaaaaagatgaaacaacatttactgttcactttcctgctagtggagaaacgttggttgttagagcttggcatctccgtccatcccttatctggaaggatggaaaatggattgaatcttacaaagtggggacaaatgacagttctacccatgagggtgatacaccaaatgaaaaacgacctaaattgggtagtcatgtggtagatgtaaaagggaaagacaagatgtcaaaaggcattggtgctgtggagtcggcaaaacctgatgagatgacattacttaatttggctgaaaacgataaagtgtttaacattggtaagagcagcaagaatggaaataaatttgatgcacacagaatggtgaggactggacttcaaaaagaaggatcaaaagtaatttttggtgttcctaaacctgggaagaaaaggaaatttatggaagtaagcaagcattacgtggcccatgaaaacagtaagatcggtgatagaaatgattcagttaaacttacaaatttcttgatgcctccaagttccggacccagaggatggaaaaatagttccaaaaatgatgccaaagagaaacatggagccgactccaagcccaagacaagccatacagaaaggattaaggattcttcaaatctcttcaagaatgctgcttccaagagtgaaagtaaggtggagagagcaccccactctgcaagtgatggagcaacaggaccatttttgttttcatcgctggcaacttcggtggatgctcatcccactaaaagggcatcctcatcaagagcaagtaaagggaaacttgcgcctgcacgtgttaaatcaggtaaagttgagatggaaaaggctttaaacgacaatcccatgaaatcagcatccgacatggttgagccccggagatccaatcgcaggatccagccaacatcaagagtaagtttctataactga

SEQ ID NO: 61777 - DNA, 3861 bp, Glycine max
  Peptide Sequence Number=SeqID_153462
atggtatgggtattgctgcacaaaacattcacttgttatgtggttctgtcgtgcatcttattctggcttgctggatatggactgtgctctttgaacgggatacaaaacccaccagattatgaaggttgtgcatcttttgagagaagttatgatttgggttcttcagacgccactgttagtgactctagtttaggctatgggtttccctctccccataacagttatgaaaacgtctgtccgaaaagtcactcgttctgctttccatcaatattgtctggattttctcataaagagaaaattgtaaaggaagcttctccaggagaatctggcagtcaatacagcagtccattttgtacagaattacctcaacatggcaggcaaacaagtaacaaaagttggtcatctgaacatggtgtttttaggttacttaatggaggggttgtctggtgttctttgaacaccagagaggaagtggatgacgtaccacctcttcaaaccgaggttggtcgtaaagatgatatttcttcttgtggaggctcttcacttaagcagaagacaacaagtttttggtcaacgaactctgaggtttccaaatcaaattcttttgatggttctgtctcacccgacgtaaggattggccctactatactggactggggacaaaaatacttgtattcttcatcatcagcttttttaactgtgacaaatacatgcaatgatagtatattaaacctctatgagccattcagcacagacttacagttctacccttgtaacttcagtgacatttccctaagacctggtgaatcagctttaatttgttttgtttacttccctagaagtctgggcttgtcatcaggtagccttattttgcagacaagttccggtggattcatagtagaagctaaaggatatgctactgagtctccttttggaattcagcccttatcaggtatgcaaatttctcctggtggaaggttgagcaagaatttttcattgttcaatccctttgacgagaccctttatgtggaagaaataactgcctggatatcaatttcttcagggaataattctgttgaaattgaagcaatttgtaggagaaacgattttcaggttgttgatacttggctcttcccaactatcaaggatcgattggttgtgaatagtggccagtttggttcactgattgtagcaatcaggccccataggaattgggatatagctccacatggctctgaaactctcatggagatggatattctggttggatttgagggaaaaatctttggtgcattttgtttgcatttactgaggcactcacaagacacatctgatactattatggttcctattgaagctgaagtagatagtcattctgctcatgatactgttggtatatttatttcagcaactcttgagggtctagccatgtgtgatagtggtgaaattgctatcgctatctctcttaggaatgatgccccatatgttttaagttttgttaaagtcatagaggtttctgacaccaaacttttccgtataaagttcaaagaaggtttactgcttttccccggtactgtgactcaagttggcattgtttactgtagtcaccggcacttggatttacatgactttgtgcctaaagtctccaccttgcgagagaactgcaaactgctgattcttactaatgactcaactagttccttgattgagattccatgtgaggacattttatatatttgttttgaacatcaaaggaaaaggcattcatctgatcaagtagaaggcaagtccaaagatacccaatttgacaataggaaaacagggcatatggtcagaagcatgcaattgcagccaaatgtcaaggctttagagacaagagatgtagatgaaatggttctggcaaactggaagtctcaaggaaccatgggtagcatgtcagtgcttaaagaccgtgagatgttattttcaatgattcaggttggaagttatgtctctaagtggatcactgtaaagaatcccagtcaacattcagttgtgatgcagcttatcttaaattcaggagaaataattaatgagtgtaggggtttagatgatttattacacccttcttcatctagtaacttggttctagatgaaggtgctactccaaaaaagtatggattctcagtgccagagaatgcactaacagaggcttatgtgcaccctcatgatcatgtaactttggggccaataattttttatccatctgatcgatgtgggtggagtggttccgcattgataagaaacaatctttcaggtgttgagtggatacctttaaagggttatggagggttgctttctctagttttgcgcgagaggtctgagcatgttgacagtgtagattttgatcttaaaatgcccaagacactcaacttttctcttccatataccttacttcacatgaaagagataacttctacctgttcacaacatttagtgaaagagttatatgccaaaaacactggagatttgccattggaggttaaaagtatcagagtttctgggagagagtgtgggttggatggttttaagattctttcttgtaagggttttgctcttgagcctggggaatcaactaaacttctgatatcatatcaaactgatttttctgcagctgtggtgcatcgagatcttgaaatcatcttggccactggcatttttctgttacccatgaaagcaagtttccctaatgatatgctaagtagctgcaagagatccatgtattggatgcgactgaagaaatcccttcttggatttgttcttgttgcatccttaatatttctgatattttgtttcatatttcctcaaaccactgcattgggcttcttggatttctcttacaagagtgatgataacttggttcacaccaccttaaaaagtgctgagaaaacccctatgctacatcatgaccagggaaagagtaagctctctatatctagtgagatgaatcatctaatggaggcctctagtggcaaatattcctatggtcaaggcaatccatctgaacgggaaatatctcagcatttgacacaaaaatctgaaaatcatgaacagactaatcatgcatgggatattcaaagtgaaagaaaattgtcatcctcagcagttcagtgctctgacccaatgaaagcatctcagttgggttatctcacggtcaaaactggtaaagaaaagggtagaagaaaaaagaggaagagtcttggtgccaaattagcggcactgtctgaagtttcaagcagtcaaagtgggaattctacaccctcatctcctttatcccctactccctctgctacacctaaatgtaactggccaacttccccggatgtggagcaaccccccgaggctcctagtccaatgacacaggtggctgcccaacattctgccaatgatcaagcttctgccactgctgctgagtcaaatatattgaagcctgtttttacacaaagatgcagtaatagtaagtcttctcaagtaccacattcagcttcaagaagtgctactagtttacctgttcagatgccttctgctacttctcccattcctgccatcacttttccatctcgattgggatcaaaatctactgttgacttccatgctcgagctcctggatcccaacttcacaaccaaacagctgttcaagcacgagagacaggacttgcaaatgagtatacatatgatatttggggtgaccatttttctggacttcacttgttagttccaaaaaatgttgcttccatgaagtctagtcccgtggaaaataatttcgacagcttttttgtaagagggccacaaacccttgtgacaaattctcaagaaggctaa

SEQ ID NO: 61778 - DNA, 2631 bp, Glycine max
  Peptide Sequence Number=SeqID_153463
atggcagatctgttcagtggaggtgccgtgggggcagtgatgggggagttgctgaaaggggcaattgcgaccataaacaaaggtcgagacttcggacccaccctcgagagcaacatagaaaccttaaactctctggctcctcaagtggaggagatgaagcgttacaacaagatgttggatcgccccatagaggagatagcgaggttggagtctcaaatgcaagctggcgaagagctggttcgcaagtgctccaaattcggtcgctggagaatgctctctttcccttattaccagagcaagcttaagagcaacgacgcgaatttgaagaggcacttttcggtcaacgttccggcggagaacaagagggacttgatggaggtggtggccagtgtgagacagattctggaaattctatccaagaaggaggatttcaggcactcgttccatttaaggggtctaagtggggctccccaagaacctgagtgcgtgggaatggatgtgcctttgagcaagttgaggattgacttgctcaaggatggtgtttctgttcttgtcttgactggtttggggggatcggggaaaagcacgcttgctaagaagatctgttgggaccctcaagtcaaaggaaagtttgagggaaacatcttctttgtcaccgtctcaaaaacaccaaacttgaagtacattgtagagacactgtttgaacactgtggttgtccggtgcctaagtttcaaagtgacgaagatgcaatcaaccgactgggagttctgctgaggcttgttgggaaaaatccaatattgttggtcttggatgatgtttggcctagctcagaagcccttgttgagaagtttaaaatagacatacctgattacaagatcttggtgacttcaagggtttcatttccaagatttggcacaccatgccaattggataaacttgatcatgatcatgcggtcgcccttttctgtcactttgcacagctgaatggcaagagctcatacatgcctgatgaaaaacttgtcgacgagattgtgagaggttgcaagggttcaccgttggcgcttaaggtcactgcaggatcactctgtcagcagccttatgaggtgtggcaaaatatgaaggatcgtttgcaaagtcaatccattctgctggagtctagtagttctgatttgctttttcgtcttcaacaaagtttggatatattggaggataagttcaaaatcaacgaaaaggtgtgcttcatggatctgggactatttcctgaagaccaaaggattcctgttgctgcccttattgatatgtgggcagaactgcataaccttgatgaaaatggtaggaatgcaatgaccatcatccatgatttaaccatcaggaatttgattaatgtcatagtcacaaggaaagtagcaaaggatgcagacatgtactacaataaccactttgttatgctgcatgatctccttagagagctatcaatctgtcaaagcaaagagaaaccatttgaacagagggaaagactgattattgacttaaatggagataatcgtcctgaatggtggataggacaggatgagcaaggagtcattggccggatgtcctcattcttcctcagaatgttgtatagacagaaacagctaagagttgctgcacgcatattgtctatttcaactggtgacacatactttggggggggaatcgcaactgttttgaaaatgtatggactaataagaaatactcctgcgatgtgccatacttcatcttccattattgatgtcaaatacgttgcttctgcagatgaaacatttacttcagattggtgtgacatgctacctgatgaagctgaggttctggttttaaatctcaactctagccagtactcattaccagagttcacagaaaagatgagtaaacttagagttctgttagtcacaaattatggtttccatcgttcagaattaaacaagtttgagctacttggttctttatttaacttgaaaagaattagattggaaaaggtttcagtcccttccttgtgcatattgaagaatctgcaaaaattgtcccttcatatgtgtaatacaaggcaggcttttgaaaactgttctatccaaatctcagatgcaatgccaaatcttgtggagatgagcattgactattgtaatgatctggttaaattgcctgatgggatgagtaacatcaccccgttgaagaagcttagtatcactaactgtcacaggctatctacactgccacaagatattgcaaagctcgagaatttggaagttctaaggttatgttcttgctctggtttggtagagatgccagattctgttaaagggctttacaagctaagttgtcttgacatctcagattgtgtaagtctgtccagattaccagacgacattggtgagttgaagaagcttgagaagctctacttgaagggttgctcaaaactgagtgaatttccgtactctgtcgttaattttggaaatttagagcatgaaatatatgtgatctgtgacgaagaaatagctgccttgtgggaaaacttccccaccatgcccaagttgaagatagagatatctacaatggagattaacttgaattggcttccaggagttcattcctga

SEQ ID NO: 61779 - DNA, 819 bp, Glycine max
  Peptide Sequence Number=SeqID_153464
atggaagtgccacgaatgctacaaggtttccacgtctcctcagaatcctacacgtgtaagtcagacacagagtcaccctgttggctatcaccgaaacaccactatatatttgaaaatgtaagtggctttgcttccaaacacttgaacatcatctacatttcatcacaatcttcctcaatcatgtcttcagaaacaaaagcagaaacacaaactttgaccaccccctcttactcctcagatgttgacaatggtatagtgaaggatgtagtcctatggagaagaaagaaaataaatataagcgttcttgttgcggcaacagcggcatgggtgttgatggaagtgtttgaattcaacttcctcactctcatatcatgggtggccatactcggtcttgcttcaatattcctctatgccaatatgcttagacttttgggcaaggaaccaccgaacttgttggggttggaagtgagtgaaaaaacaacaacgagaatagcacacacagttcgagcatggattgaagaaggaataaggtggttgttccttgtgggcgcagagaaagagtggcccgtgtttgtgggggctgtggctggattgttatcactatcttatttaggaagttgcatggacctcctaacactagtttatatgggtacgttagtgggaatggcagttccattaacttatgtgaagaacgaggacaagattaagaggtttgtggagtggttgagggagaaacacaagagatattatcagattattgacgagaagaccattcagaagattaaaagcagaatcgtaaaggagaagaaaacagagtaa

SEQ ID NO: 61780 - DNA, 1668 bp, Glycine max
  Peptide Sequence Number=SeqID_153465
atgaagaaaatgcagctactacacacgttagcgagtgaaaaaccaccacaagaaaagagagagggagtaaggaagagagaaagcggcacagacccaagtgggttaagtgtgcaagcagaagatgcgtataagtattacacatggacggtgacttatggaactatttctccattgggtagtccccagcaggttattcttatcaatggtcagtttcctgggcctagacttgacttggtgactaatgagaatgtaattctcaaccttatcaacaagctggacgagccatttttactcacttggaacggtattaaacaaaggaagaattcatggcaagatggagttttgggaaccaactgtcccattcctccaaactcaaattacacatacaagtttcaggccaaggatcagattggtacatatacatactttccatcaactcaactgcataaagcagctggagggtttggagcactgaatgtttatcatagatctgtcatcccaatcccttatccaaaccctgatggagattttactttactcgttggtgattggtacaaaaccaaccacaagacgctaaggcaaactttagaatctggaaaacctcttgcatttcctgatggcctccttattaatggtcaggctcattcaaccttcactggtaacccggggaaaacctatatgttcagaatctcaaatgtaggcttttcaacctcaattaacttcagaattcagggtcacaccctaaaattagttgaggttgaaggatcacacactgttcagaacctttacgattcacttgatgtccatgttggccaatcggttgctgtgttagtaaccttaaaccagcctccaaaggactactatattgttgcctcaacaagatttacagagacacctctcactacaactgctgtactacactatgcaaactctttttcctctgcattgggacccgtgcctgctccccctgttgataaatatgactttgactggtccatgaagcaagctagaacctacagatggaatctgacagcaaatgctgctaggcctaacccacaagggtcattccattatgggaagattactcctacaaaagtaattaagttggccaattcagcacctttgatcaatggaaagctccgttatgctgttaacagtgtctcctatgttaaccctgacacccctctcaagcttgctgattacttcaacattcccggaatcttcagtgtgaatttactccaaaactctccctcaaatggtccaggatacataggcacctcagtgttgcaaacttctctccatgattttattgaggttattttccagaacaacgaaaacaccatgcaatcttggcatcttgatggttatgatttttgggtcattggtcatggtttcggccagtggacagatgccagcaggaaaacatataatctagtggatgccctgactagacacactacacaggtgtatccaaaatcctggactactatattggtgtctttggataaccaaggcatgtggaacttgaggtctgcaatatgggaaaggcaatatcttgggcaacagttctatctcagagtgtgggatgcacagaaaagccttgctaatgaatatgacattcccaacaatgttctgctttgcggcaaagctgttgggcatcacccttag

SEQ ID NO: 61781 - DNA, 1125 bp, Glycine max
  Peptide Sequence Number=SeqID_153466
atgcccgctctcagaaagcgaaatcgattgtcggagttcgatgccatatccaaccacgacacacctcatgaacagaagaagaatatgtctgagtacgagctgtcgagagagcagagaatccgcgaaaaccgcgagagaatgggaaagctgggaatcttggacctttccctcactctcaagctcaacaacaaaaacaaaagatcctattcctctcacaaaccccaaacccctccttctcttccaaactcctccgtccccgttcgccgctcttccaggttgcagaatgtgactcctgttagttactccgaagttcccccaaagaaagacgagtttaagaaaaatggaagggtggtcattgaacaaggtgccaagccagaggtgtactctgaagaacacgagaagctgttgggaaacaccgacaagccctggacgctcttcgtcgatggtgttggcaaagatgggaaacgaatttatgactccgtccatggcaaaacttgccatcagtgcaggcaaaagactcttggttatcggacaagttgtagccaatgcaacatggtccaggggcagttttgtggagattgcttgtatatgagatatggggagcatgtactcgaagccttgcagaatccaacttggctatgccctgtttgtcgtggaatttgcaactgtagcttatgtcgtcaagcaaaaggatgggccccaactggcactctatataaaaagatatcaacattgggttacaaatcagttgcacactaccttattcaaacccggcgctcagaaatagatgtgaagaaaaatgcagatccttccaacccagtttcagcaaaaaggtcgctacccttctctgatgtggacaagtctcttgaggttaacgagaatcatctggaatcattgaagcctctagctgaatctgaaggtgatgatgctgaggtttcagcaaagagattgcttttctctgataagcaaaatcagcttgaaaaagttgagtgttcagataccccaaaacctcttcagcttgaaaaaaatgagtgttcaggtaccaagaagccacttgcttcttcctccaaacctagctctgacagcattgctggaagacttaggtccaggcttaaaaaaccatga

SEQ ID NO: 61782 - DNA, 1194 bp, Glycine max
  Peptide Sequence Number=SeqID_153467
atgcctgactaccttgagcatgggatagttcagaagcttctcttagttggtggcagtggatctggaacgagcactatttttaagcaggccaagattctgtacaaaagtgtcccattctcagaagatgagcatgaaaatataaagctgaccattcagagtaatgtttatgcctaccttggcatgctgcttgagggacgaactagtccaaaactggatgagaagactgtatattccattggtccaagattgaaagcattctctgattggttactgaaaactatggtgtcgggcaaacttgatgccatctttccagctgctactcgtgaatatgcaccattgattgaggaattatggaatgatgctgccattaaggctacatacgaaaggagaagcgaattagaaatgctgcctagtgttgccagttatttcttagagcgggctgttaaaatattaaggacagattatgaaccctcagatttagacatcctttatgctgagggagttacttcatctaatggggtggcttgtgtggagttttcatttccccaatcagcttctgacgaaactgttgacactactgatctacatgattctttggtcaggtatcaactaattagagtgcatgcaagggggctaggagaaaattgcaagtggctagagatgtttgaggatgttgaaatggtcatcttctgtgtttccttgactgactatgatcagttttctgtcgatggcaatggttgtctcactaacaagatgatattaagcagaaagttttttgaaaccattgtcactcatccaacctttgagcaaatggaattcttgttgatattgaacaaatttgatctgtttgaggagaaaatcgaacaagttcctttgaccaagtgtgaatggttctctgatttccatccaataatcagtcgcaatcgtcccaacggcaatagcaacagcattaataataatccctcccttggtcagctggcttcacattacatagcggttaagtttaaaaggctttattcatctcttacaggacgaaagttgtatgtgtcgccggtgaaggggttggagcctggtagtgttgatgcatcacttaaatacgccaaagaaattttgaagtggagtgaagagagaccaaactttagcttgagtgagtactcgatgtatagcactgaggcgagttcattctctcattga

SEQ ID NO: 61783 - DNA, 2298 bp, Glycine max
  Peptide Sequence Number=SeqID_153468
atgaaggcagggagtgccgccaagttgatcgtcgacgctctgcttcagcgcttcctccctctcgcacggcgtcgtatcgaaaccgcgcaagctcaggatgggcaatacctgcgaccatctgatccggcctacgagcaagtgctggattcgcttgctatggtggcgcgccacactcctgttccgctgctggaagccttattgagatggagagagagggttgttagccaggttgaatatccctcactggttgatttgagggggcttcttctggacttagttgctcaactcttaggtgctctatcccgtatcagttctagtgggttaaggctgttgttgttgggtgattctgcttcagttccttttactgttgttcagtttgccatggcttataatacgaagtttagttctgttactgagcggtttttcatggaactcaacacccgtcgaattgatactagcgccgctagaagtgaaacgcttagtatcattaatgggatgcgctacctgaagcttgggggtggattaaatgcttctgcttcttttgttgcaaaagcacaccctataaaccgtcaggctcataaacggaaaagtgagcttcaccatgctctatgcaatatgctttcaaacatcctagcacctcttgcagatgctgggaaaagccagtggccaccttctggtgtagagccagcactaacgttgtggtatgaagctgttggacgtataagagttcagctcatgcattggatggataaacagagcaaacacattgcagttgggtatccattggtaactcttcttttatgtcttggtgatcctcaaatatttcacaacaacttaagtcctcacatggatcaactctacaaacttcttagggaagggtgccaggaggcatatggaagtgtagatgatgtgtgggacatagtggcaaagggattaggaagcatgcccctgtgtaagaatgctaaaaattggggaaaaaatgtggtagctaagaagaatacagaaggtggtgaggctagagttagagtttttgatgggttataccacttcttaggcaccaaaagatttacttgcttgctaaaagttgggaaagaaaatcaagagacttggattaagttacatgcattaaggatggagaaggataagaatcatcgtttcatggctttagattgtcttcatcgagttttaagattttacttgagtgtccatgcggcaaaccaggccccaaatcggatatgggacaacctagacagtgtaacttcacaacttttagcagttctaaggaaaggattgcttactcaggatgttcaacatgataaactggttgaattctgtgtaactatagctgaacataaccttgattttaccatgaaccatatgatactagaattactcaagcaagacaatcctagtgaagcaaaggttattggtcttcgtgcattgcttgccattgtcatgtcgccttcaaatgctgtaaccaaggaaaagtctcaagggtatctattccgttctgtgctaaagtgcatcccaaatctaatagaagaagttgggcgaactgataaaattactgaaataataccacaacatggaataagtattgaccccggtgttcgtgaagaagcagtgcaagtactaaaccgcattgtgaagtacctcccccaccgtcgttttgcagtaatgaagggaatggccaacttcatattaagacttcctgatgaatttcctctgctcatccaaacatcattagggcgcctgttggaactcatgcgcttctggagatcttgtctaatagatgataggatacaacttgaagcagatgtaaaatctctagggcatgaaactgagagattcagaaagtcttccattcaacaatcaggcgaagcaattgagtttcgcgcatcagaaattgatgcagttggcctcatattccttagttccgttgatagtcaaattcggcatacagcattagaattattgcgttgtgttcgtgcattgaggaatgatattcgggatctgaagatgcatgaacaaccaaatcatactttgaaatatgaagctgaaccaatatttattattgatgttctggaagaacatggggatgagattgttcagaactgctattgggactcagggcgaccatttgatttgaaacgagaacctgatgccattcctcctgaagtgacacttcaatctataatatttgagagccctgacaagaacaggtgggctcggtgtcttagtgagctagtcaaatatgctgccgaactttctccaagctcagttcaggaagctaagtaa

SEQ ID NO: 61784 - DNA, 1452 bp, Glycine max
  Peptide Sequence Number=SeqID_153469
atggcggaagaagctcctgcatctgaaacctccgtcacaatgcctcaaccggcggaagtcatcaccgtcgacggaaccctaacctcttccgagaatgacaagagcggaatctccgtcgatgccgccgcgcacggcggtgaaaagacggtgtccaacgctgaaccttccggtagcgatcctcagaagtctctggagttggcgaacgagctgatggaaaaaggaaacaaggcaattaaggagaacgattttggagaagcagctgataacttcagccgtgctctcgaaatcagagtggcacattatggtgaacttgctcctgagtgtgtgcacacatattacaaatatgggtgtgcacttttatacaaggctcaggaggaagctgatcctttagctgatgtgcccaagaaggaggatggatctcaacatggctctaacaaagatggttctgtgaagggttctttgaatgctgaatcttccacagcttctatttcaaacaatgccgggcaggatgtgacttcaaatgaccagggtggagcagtggatgatgggtcaactaagaatgacccggaagaagatgacgaggatagtgatgctgaagacttggcagaagctgatgaagatgagactgacttggacctggcatggaaaatgcttgatattgccagagccattgctgaaaagcaatctgtcaatacaatagaacaggtggacatattatcaacattggcagatgttgcattggaaagagaggattttgaaacttccctctcggattaccagaaggcactaaccatcttggaacaactggttagttctaagcctcaagaagcaattgcttactgccagaaggctacatctgtttgtaaggcacgattacatcgtcttacagatgaagtaaagagttgttcagatttgacatctgcttctgagttagctcaggatttaccagcatgccccaaatctgagtctaataactcaattttggataaacaatcagagattgaaactctcaaaggtctatcaagtgagctggaaaagaagcttgaagatttgcaacagttagtctcgaacccaaagtcaattcttgctgagatcctaggaatagcagctgccaaggtaggcaatgtgaaggaatcatcttcagcaacggtgagttcctcacggttggctactgccaacagcagtggaggttttgactccccaaccatttcaactgcccacaccaatggatctggtggagtcacacaccttggtgtggtgggaagaggagttaagcgagcatcaaatgccactccggcagaaggaagcacaccaaagaaaccggcattagagtctactgaagacaaaggagccatgagtggagccaagggggttggccaaggcccatggccaggacctttccaatcctcagatgtcagaaccttattgtcctgtttggtagagaggaaataa

SEQ ID NO: 61785 - DNA, 1725 bp, Glycine max
  Peptide Sequence Number=SeqID_153470
atgagacgcgtgcttttgattgctgagttgtgtatagagaattacaataggagaaacatgataaataaaagaaaaagagaggaagagaaatggttgaatcctggggggccaagtgatgcaaaaattctcagacccaaatcatcaaaagcatggaactgctgtgaatccttgtcacttatgggggatattaggcttacccgggtagagcaaggtcaaacaaagattagaaatgttccaattgctgtcacccctgaaggattttggtgttgccctactcctgttgggtttcagaaaagcctcaaacctcaaaaccctttgaataaactcaaaccctcttcaccacctccaaagcctagttcccagaaaaaggctgtttcggagagtcagagaaaaacagtgccttccccttcaagattggcggtttcagatgctcaacaatgtaatgatgatccagaaagacctccgactagcacttctgtgcctgcacagagagcacccaaaaaggtggctattgagtttggtgaacctggaacttttgacatgaagctgcttctccttggaaagcagggattttgtgtgaagttaagtgtgcacagggatgttctaatagagaagagtagcttctttgctgataaactttctgaacaatctagtttgtcatgtctccaagttgatgactgtgaggatgttgaaatatatgttgagactgttgggcttatgtactgcaaagaaatgaaacagcagctaatgaagcaaagtgtttctcgcattcttcgaatactcaaggtcgcagaattccttggcttcagctcatgtatccaatcatgtttggagtacttggaggcagtcccttggaatggaaaggaagaagaagaaaaggtgatcgcaaccgtcctacgactccaaggagaaggaatcggggtaaatccggtgctaaaacgagtttctcctgatatttctaatgccccaaaagataccctctcccacattgttgaacttgttctcaaaagcaatgaggagagaggtcgccgagagatgaaatccatagttctaaagctccttagagagaataacagtcttccaagttcttcaggctcagctgacctctgtaatgacatgattaataagtcatgcagaagatgcatggattctttattgtgtctgttcaaccaggtggcagagccaggctttagtgataacaaagaacctgtagtaaaacatatagctcttgaagctgataacttgtcatggttgcttgagattttagttgacaaacaagctgctgaagattttgcactgatgtgggcaaaccagcaggaattggcagcccttcatggaaagcttccgattgtgtttcgttatcatgtcagttgcatttcaggaagactatatgttggcattggaagaggggaggttttgccatcaaagaacacacgccagttcttgttgcagacatggctacagcctctaatcaatgactataactggttgcagcacgggtgcgggtcattcgataggaaacttgtggaggaaggaattggaaggacaattctcaccttgcctttggaggatcagcagagtattttgctttcatgggttggaagtttcttgaaaactggtgatggctgtcccaatcttcagagagcttttgaggtgtggtggcggaggactttcattaggccatatgtggaaggccaaactattaacgtcatgccagatacgtga

SEQ ID NO: 61786 - DNA, 1496 bp, Glycine max
  Peptide Sequence Number=SeqID_153471
ctgaggagctgggattagtggttgttgttgctacttgctggcaagatgatggttttactatgggaatagcaacaccgtcacattcaagaacagtactagaactaaacaccattggttttctcttggatcttgtatcaattcttgcaattctatgtcccaagattttcaacaaggaatcttcagcttcccgaatggggatagaggaggaggaaccggtgtacgagaccgccgggatgttgtcggagatgtttaattttccgcccgcgacggaattgttggagcagcagcacgcgacggcgacgttccgggcggcgaggcaagccggagagtggtacggaaacagacagcaacagcaacagatttcaggcattaatgctgactcagcagcagccatgcaactttttctgatgaaccctcaaacgaggtctccttctcctcctcaaacccacgccactccttcgtcaacgcttcacatgctgcttccaaatccttcttcaaattcttccctccaaggatttactggttcggccgcgggagggtcttttggtcaattcacatgggttcctgagagtgctcatcaacaaggaggcgtggtggaagggcaaggtctttcgttatcgttgtcttcttcgctggaagcagcaaaagccgaggaactgaggatgggggatagtggttttctatattacaatcatcaacaaggtggaggtggaggaggtggttcttcttcttcttccgcggttcagtttcagtacaagaataataacaataaccatcaccaagcattgcatttgcaaggggcgatgggacacgacaacaaccaccagggacatgttgggtttgggtcatcctcgttaggtgtagttaatgttctaagaaattcaaagtatgcgaaggctgcacaagagttgctggaagagttttgcagtgtagggaggggtcagtttaagaagagcaagttcaataggcagaattcaaaccctaattcaaatgccggtggtggtgcttcgccttcatcaaaagatgctcctcctcctcctcctttgtcagccgctgataggattgagcatcagagaaggaaggtggacaggagatacaaccattactgcgagcaaatgcagatggtagtgaactcatttgacctgatgatgggttttggggcggcagtgccgtacacagcactagcgcagaaagcaatgtctcggcatttccggtgtctgaaggaggcgataacagcgcagctgaagcaaagttgtgaggtactaggagagaaagatggagcggggaactcaggaggtttgaccaagggtgagaccccaaggcttaagatgttagaacaaagcctaagacagcagagagccttccaccagatgggcatgatggaacaagaagcttggagaccccagagaggcttgcctgaacgttctgtcaacattttgagagcctggcttttcgagcattttctccacccgtacgtaattccttctattgcttaa

SEQ ID NO: 61787 - DNA, 501 bp, Glycine max
  Peptide Sequence Number=SeqID_153472
atggaagaggaagataaccaagtccataacttgacagaagagaagaaaaaaagtgaaaacgaagaagtgagtgttgagagtaacgataagaagaagaagaagagaagcagtgatgggaagcacccaacgtatcgcgaaatggcggctcgagcccatgatgtcgcggctctcactatcaaaggcacttctgcgttccttaatttccccgaattagcctcacaccttccgcgcccactcaccacttcccctaaggacatccaagccgccgccgccaaagctgctgcactcaactttgaggcccaagtcgaagcccaggcccaggcccagctgagcataccaagttcctcctctgaggttgagttccctgatcttttactggactcaagtcacagtgcaggtgagtttgattactcggcgccgtggctagtagccgaagctgaacatctagacttggcttttcggctcgatgaccctcctttccctgcttgggggtcttactaa

SEQ ID NO: 61788 - DNA, 552 bp, Glycine max
  Peptide Sequence Number=SeqID_153473
atgggaaatggtaatttggagatgagtgtggaggaccagaaagccaccttcaacttgtttgaggtaataaaacatcctagtgatagcaagacctgctttaagctggaggcaactgagccagaagctgaccttgttggacgacacttgaattgtgaatccaacaaccccttccattatcctcttgaggccaaggcaagtgaaggcctgaaccattccagacgctccactagttccacctccagtaatacctcctctagccacctcttctacaatcgacaagccttttttctcctctacctagcaggagcatctagtccagatgatgcagagcctttatcatggccaatgcctcgtcatccagaacttgcattagctgtccattcacctttctatggagccttcgctgatgacgccagaggcttttctatagcagggggtgacacctttggtgtgggtaacgatgatgccgctgagactagagctgatggtgattacattgcggacatcattactgcacatgaagcttgggatccagggtcaccacaaaattga

SEQ ID NO: 61789 - DNA, 3412 bp, Glycine max
  Peptide Sequence Number=SeqID_153474
atggcagccaattccggcaccaaatacgtctcagtgaatctgaacaagtcctatggccagcattcctccgcccggacgccgcgcccttccgccggagccgccgcggctccgccgtcgtcgcggcctcgcagctcgcacaaagccgggcccaagctttccgttccgccccccttgaaccttccttcgctgcggaaggagcatgagcagttcgattcgctgggatcgggaggtgggcccgccggcccgggtggttccggaagcgggcccaggcccagctcctccggtttgggctggaccaagcccgtcgctgaggacgtgtcgctgcctgtcgttaaaccggcagccgccgcggccgctgtgccggtttcgtcggccgttttgagaggagaggattttccttctctgcgggccaccttggtgcctgtgcctggttcaaatcagaagatccaggagaatcagaattcgattcagaatctgaatctgaatctgaatcagaagcagaaacattctctgggtgatgagaatgtgtttattgaggagaagaatgagggttctttggttactgatcagtttagtgttcctcgcagagtgaatgtggctggtggtggtgatgatggtcgcggttcgcgggtggtgaacccgaagtatggtggtggtgttgggaggaagcaggaggagtatttccctggtcctctgccgctggttcggttgaacccacggtcagattgggccgatgatgagcgtgacacagggcacggtttgagcagggagggtagggatcatggttttcccaagggggaagttttttgggattttgatattcctagggttggtggtttgcctcataagcatgagaagaggggactattgaggggcaatgaagttgtaaaggctttgaacagtgaagtggaggcttatgatagaatggggcccgaagggaattcttggaggagttcgaacttgtcctttcccaaggatgctggaaatgagagaaatggtgttggtgtgaggtcgtcaagtgggagtaaggatgtggggaaggatagtaacaagtatgttccgtcgccatttagggatgatgatgctggaaagagggattttgtaaggagggatggtcagggtgggaaacagcagccttggaataatgtggtggaaccgtatggtgatcggcatcgcgagcaactcaacaggaatagagctgattctgtccagagctcggtgtcaagatcagctttctcgatgggtggtaaggggctgcctgttaatgatcctctgcttaattttggtagagagaagcgggctttgccaaagagtgaaaaaggtttcttggaggatccgtttatgaaagattttggaggttctagttttgatgggagggatttgttgggtggtcttgttggggtggtcaagaaaaagaaggatgtgctgaagcaaactgatttccatgatcctgtgagagaatcctttgaggcggagcttgaaagggttcagaggatgcaagaacaggagcggcagcgaatcattgaggagcaagaaagggcattggagttggctcgcagagaagaggaggaaagattaaggcaggctagagaacaggaagagaggcagaggagattggaagaagaggcaagagaggcagcatggagagctgaacaagagaggattgaagctttgcgaaaggctgaagaacagaggttagctagggaagaagagaaacaaaggatggttttagaagaagagaggagaaaacaagctgctaagcagaagcttttagaattggagcaaaggattgctagaaggcaggctgaggcatccaaaagtggcagtaatgctccagttgttgtggaggagaaaatgcctgcaatattgaacgaaaaagaagcatcaagggctacagatgtgggtgattgggaggatagtgaaagaatggttgacaggatattgacttcagcatcttctgattcatcaagtgtgaatagggcattggagatgggctctaggtctcacttctctagagatttatcttccacctttggggatagaggaaaaccagtaaattcatggagaagagatggatatgagaattggaacagctcaacattttatccacaagaccaggagaatagtcacaacagtccccgcagagatttatcaattggtggaaagccatttatgaggaaagactataatggtggtgctggatttgtgtcttcaaggccttattataaaggtggaatttcagagcctcatttagatgaatatgctcatgtaaaaccacagaggtggaaccaatctgcagatggagataatctaagcagaaatacagagattgattctgattttcatgaaaattattttgaaagatttggtgatggttggacacagggccgttcccgtggcaatccatttcctcaattccctgagcgtacttatccaaattctgagtcagagggaccctatgccttggggaggtcacggtattctgtcaggcagcctcgagtacttcctcctccttcactaggttctgttcacagaacttacaaaaatgaaaatgaacaccctggcccttctgctttcctagaaaatgagatgcattataatcaggcaaccagaagtgactctacccttccaactggttatgacaatgggaaccgtggacaacctgaagtagtggatgcccggcaagagactactgagaatgaggaccataaagtggaatccacaccgaggtgtgattctcagtcttcactctctgtttcaagccccccaagttctccaacacatctttctcatgatgacttggatgactctggagattcccctacgatattgacttctgaaggaagcaaaaatgaccccctcacagctccagataatgaatccattgcaacacctgctggaaatgaaaatgtagttactccatgtgctgtctctagtggggatgatgatgaatggactactgagaataatgagcagttccaggaacaagaagaatatgaagatgaagattatcaggaagaagatgaagtgcatgaaggagatgatcatgctcaactcaaccaggattttgaagatatgcatttgcaggagaaaggattgccccacttgatggataacctagtattaggatttgatgagggtgtccaggttgggatgcctaatgaaaagtttgaaaggacatcaaaagatgaagaaacaacatttgtggcacaacaggcttctggcatctctctagaagaatgtgtatcttatgataatgcaagtgatgatgacaaggccctccaacctgttaatgatactaaggtgaatcttaacagcacttccagtgtgttccaggaatccgagaagccagctcaagatctggtcattcagcctagtaattctctttcccctgtggtgtctgagagtttag

SEQ ID NO: 61790 - DNA, 531 bp, Glycine max
  Peptide Sequence Number=SeqID_153475
atgaggtatggcgagacgagcgcgtggcagtggcgcttcaggaggcagagtgtgaagttgcacctctcctcgagggagtccttcacatctccacgtggtgcgtccacaagacgtggttgccgcagaaggcgttgtggacgatgtgatttgacgcaacaacgaaggagacacggtttaaggatggcaagcgggggagagttaatcgacagcacatggcgacaggggcttagttcgaggcattgcctctattcgaagaaacctcttggttgtggtaaaacactgattgccaaagctattgccaatgagacaggggctgattttattcatattaagataagagatggaaaaattaaagttcttactcctagggaagctaggtatgcagttcagctttcaaacaagccccttcttgatgtttgtccctcaaatggacacaaaaaggtgcaggcttgggatgagccttggcgcaatggcaagataatgaggcagagtttcaaggtgttactgggtggatatggagcagacagttag

SEQ ID NO: 61791 - DNA, 63 bp, Glycine max
  Peptide Sequence Number=SeqID_153476
atgagtagcgccacctttaaggttgctgtgttgggaagtggaagtagtgcctccttcgtgtaa

SEQ ID NO: 61792 - DNA, 381 bp, Glycine max
  Peptide Sequence Number=SeqID_153477
atgggtttggttctgtcacactttaagccctggagatttggagcaataaatgcttgttggagttgtttaagaatgaggcgagttcaagttcataggatcagatttggatactgtggttattgggggagtttgaaggagggtgtgtttaaggaagtggaaaagaaaaggttggactgcgatgctaaggtgcacaaagccaacatcctcatcattgcacatacgtgtgtgttgtcaatgttctatgagtcgtcagatcaagggaatttgaggccaaggtccatagatccacctagtcactcacatcattggtggggcacgatgatggtggttatggaggtgatggctagggtttgcctacgagaaaaagggggtgcttggtga

SEQ ID NO: 61793 - DNA, 759 bp, Glycine max
  Peptide Sequence Number=SeqID_153478
atcatcaagaaaaagctacaactcaggctttcatcatgctagacaaaagtgaagaccaagatacctatgttgtggctttcagaggaaccgaaccctttgatgctgatgcatggtccaccgatgtagacatctcatggtttgagattcctggtgtaggaagaacccatgctggcttcatgaaagccctagggttactgttagacttcaataaagaagagttgagatggcctaaggaaatcgaaaccaatgagaaccgtccacgtgcctattactccataaggaatttactaaggaagcatctgaatggaaatgatagagcaaagtttattgtgacgggtcatagtcttggtggagctcttgcaattctctttaccgcaatgctaatgatgcatgatgagagacttcttttggaaagacttgaaggggtgtacacatttggacaacctagggttggagatgaaaattttgccaattacatggaaaaaaatttgaaatattatggcattaagtatttcaggtttgtttactgcaatgatattgttccaaggttgcccttcgatgatgatatcatgaaatttgagcattttggaacctgtctttattatgacagattctatagaggcaagaaagtgaaagaagagccgaataagaactacttctcgtggccatggaaaggtatgatgatacagaagaaggtgaatgctttccgggaacttgattaccagctcattgcccccaggattatgttaatgttacccg

SEQ ID NO: 61794 - DNA, 2217 bp, Glycine max
  Peptide Sequence Number=SeqID_153479
atggccaagagacagaaccaaacccaaaccacccaagctaaacatgacttcaggaataacctaccatctgcttcgtgtgaggatggtgaagttgtacatatcgtcagacctatgctagtcttcattcttactacagaagtctgtttgaaggacaaagagcccaaagttcatatcaaacactttttggatattgagtctttggaaaatgctggatatgtcatcaaagcacccctcatgttatgtggcattcataacttctttgagaacctcgaggtggtggtgcttgaactcatatgcgagttatggagaacagacaaagtctaccgcaatgaggtcattggaggatacttcgttggtaagtttcttggtatatcagtaaaacagattggtgaaacgattccccaagccattgggtgtaagcggaagtatggcaccttgctaagcaaagcaaatatttttcagcagattgtcaacaaacctatcatccaaaaacaaggttcaaaggacttcctgtccaatgtccacaagtttattctataccacttgatgaaaagcactccctttgactttccccagattctcttcaattgccttcccactaaagtgatgaaggacaagagcattgcgaaggacatcaaccatacaattgtcttgaccaaagtctttgaggctcgtggagtcatcagaaagttcttttttcaagagacagtctacttggttgaaacactgaacacaagggaccaacgttccttgggttcattgcaagaagcaggattttcttctcgattgatcactggacacaaaagaccaacgtcttttgggttcattgcaagaagtgggtataacttcttggttgttatcactggacacaagggaccaacgttccttggggatagtggaaatctcaagcgggttgcttggggactggacgtaggcacaggagctgagacaaatgatgatgaagatgggttggtgttcacgaaaaagaaagttgcaccaccttcagatgagaccactacgcctcaagtgaagaaggtgaaactaacaccacaaactcttcctcctccaactcaacctcgcaccagcaagcgagagaaaaaaggggctcaaagaaccaagtgttcaacggatgagcaagttattgttactgttgttaatgatcctcaacctgctgagattcttcccattcgggaacagacctctactaaaagaaagagagttgagtccactgatgacatggacgatgaatttcaataccaatcatctccatcacccatccaccttgatcactttgaacaccaaggaccacccgtcatcgatccaaacctcactgctgaagacatagcaagtccttcctccaccaacttagaagcgtcttcccctgaagatatccaagccttcatcatcagcagccctgcgcaagagtgtttacaagattccatccaaggcttctaccctctaggtattcatatctgcccaaccataaccatcaagttcttgccagataaagttactctgaggttggctccattggacctcaggaaaaagaaaggaaaggtgtctcctcacacaaagccaatacctcaccttagtcccaaagacaacattaccttgcgtccaattccctatgattggaacaagtactttactagggacacggctaagaagacagtcactctgaagccagacactaaacacatccaatcatatgcacatggtgcaaatcttgagtccagcaaagatttacagattcaacaattggtagatgtgcttcttgaggctgcaatacgaagagccattgtcactgcttgggcgcgccatcctaaactcaaagagcatccattatctcctaatcagaacccttgggagaagctcgaatttgaggagctattcaacaacttacaagcttatcttggacctcaagtcgatgtagttgaacctcagcttgctgaactcacttcccaacccatagctgaagatgattcaagaaatgttgtgccttcaacaggccaacctagaagaaaccatggaaaagagtttcctcttttaatgcatggaaacaaatttgcttatcaagaacaccttggaagcttcactcaagtccttcaacgactttgttttgttcaatatgaatatgctaatgcaacaacgactgcctccaaccgtccaaccccttctgccaccaccagctacttcttccacactcacaacttctaa

SEQ ID NO: 61795 - DNA, 210 bp, Glycine max
  Peptide Sequence Number=SeqID_153480
atgttgagtagcgtggagaggaagaacgtgtttgttccgtacaatctagcggtatcggggagtgggtatgcgcagcacatgggtagagattccctgatgtgcgtgaatttcatgatgggttgtgaatgcagagacgaagggttactttttcatacaaagaagcagcaacaaccaatgtgcctgagcaatcacattaggttatgcaaataa

SEQ ID NO: 61796 - DNA, 309 bp, Glycine max
  Peptide Sequence Number=SeqID_153481
atgccaacaaacctgcaaaacttctgttacaagtccaacactcctcccaaaatgaaagatactaacaagaaggatggtttagaagaaaatgcagctactaataagaaggtgtgggatgctattgcatcatacccaaagttgttggtgttcttgaagtcttataggaataatatacctatacctaggcattggtgtcagaagagaaaatttgtacagggtagacgaggtatagagaaaccaccctttcaacttcctgatttcattgctgccactggaattaagaaaatcagtcagattatgagcttctaa

SEQ ID NO: 61797 - DNA, 1335 bp, Glycine max
  Peptide Sequence Number=SeqID_153482
atggcaaccgattgcaattgcaacaagggcttcgctgatagttacatgttgttgaagcccgaagatgcgagtttctttgatctctttcgtgtcttatttaagggaaacttatcacagaggaactttgtggaaagccatgcagatgatgatgctttggacgaaagtttgggccatcgatggcttatagttatttctattttggcccagaagcttttgcagcttgttgccaagccactctcactctttgggagttgcgttgagtttttgctcaaccttgtagcccttaatggaggtgtattcagcatcgtccttaattttctcggaggtaaattggtcttgcccaatcctgaatcagaaaattatttatcctttattggaaatttggacattcgagcaaagttggaagacgccgtccagcgcgaagattccaagtactatccagcactttcgatgatggcttccaaagcatgctacaataacgcggcttaccttaaaactactgtggaagattactggaagatggaatttgtggggttttacaactgcttgaatgagtatcaaggaaagacaacaactcaagtcttgattgccttggataagcatgaggatcgccatacctatgttgttgccttcagaggaacagaagcctttgatgccgatgcatggtgcactgatcttgacatctcatggtatggtattcctggcgttggaagaatgcatggtggttttatgaaagccttagggctaaaacagaatgttggatggcctaaggaaattggagaacaagacgagaatcttccccccttagcgtactatgttatcagggacattctaaggaaaggtttaagtgaaaatgacaaagctaattttatagtgacagggcatagtttgggaggagcacttgcaatcctctttgggacaatcttgtgtttgcacgatgagacattgttgttggagaggttggaaggaatctacacctttggacaaccaagagtaggagatgaagcatatgcaaactatacgagacaaaaatttaaggaacattatataaggttgccctacgatgacaaggaaatgatgttcaagcactttgggacatgtcttttctttaacagacgctatgaactcgaggagcaccgttgttgttcggatcgatttcaacgtcgggtgtcatttgggcccgacgttgtttcagaaatctataaagacgggtggaagatgcacccgttgttgcttttaaaaatttcaacatcgggcttacgcacacccgtcattgttgaaggaaggtataaagacgggtcttggaacgaccgtcgttgttggagaacgctataa

SEQ ID NO: 61798 - DNA, 231 bp, Glycine max
  Peptide Sequence Number=SeqID_153483
atggctacagaccaaacacggttacaaaacatgatgaagaagaagaataaagcttttaaagagtatgcccaacgttggaagggagtagcagctcaggcagttagtcttttgaatctttgtaaggggaaacaaaagatatctcaggcgggagaagagagacacaaaagaattcaggcggttagtccttctgttcttttggcaaagggagaagagaatgaaaaagatgaatag

SEQ ID NO: 61799 - DNA, 327 bp, Glycine max
  Peptide Sequence Number=SeqID_153484
atgactcctactcatgatgacctcttatattacaatggcaggtggaacatgtcacgccaaggcgactttgtgggttacttgttcacaagaaaaaatccaaaaagatttgacattccttcgagatgtagcatccacagactcaagtatgtgatcaagcaagtcgcacctcaagggattcccccttataccttgacaaatttgtgtaacgctgcattttacctatgtatggggtgggctactgctttgcctgataatgacaatgtgcattccacaacaacaccaatggtggtaaaggacaatggtctcgtaaaaaaacctgttacataa

SEQ ID NO: 61800 - DNA, 657 bp, Glycine max
  Peptide Sequence Number=SeqID_153485
atgatgccccccagcgatgaaggcctaccacatctgcctgatcgtcctatagccacagaggaattaaatgaagagcagcaacaaccacctattgaagaaggtgttattgatgttgaaggttttccaggcggaccccatgacacattagttttgagagattttgaaaatcacgttgctttgagagtttgcaatggagataaacgtcctaagcttaagctatcttcctatggaaggaagatgactaagtttggcagagtgctcttggatgcactacgtgacttgacacagagtaggacttacgcttggggcactactacacttgtgcataagcatgataatttaaatgaggcgtcaaagagcaggacgaggttgtttgcaggatatatcagtctgttacagtgttggatctacgagcatttctcgtctattggttccaccatagatgccgatgattatgacgagcggagaccacatgcatgtcgatggacctctggcaaggcattacccgtgtcaacgtatggtaggcgtctagatagactgacccttgatgttatggggccccttgacagtcattcaccgaccggagagggttgtacgatggtttgggtacatctagaccattacgccacatcctattgcacctttggcctccgttaa

SEQ ID NO: 61801 - DNA, 492 bp, Glycine max
  Peptide Sequence Number=SeqID_153486
atggacaacgacaagacaattacggtggcggtcattagtggcgcgacgacagcacaaacggcgaaggcgacggctcgacgaagaatggacttaaacagagggagaagaggaaagggggacgacccggtaaaaactcaacaagcagagaagcctgggtcgcaggggctcgaaagtggcactatagacagggtcaaatgtttgataaacgtgaaaatacccaaatcggatactatgttagatgccagaggtataggcgaggcacagacagcaacagagagcgcaaagaatggaagcggtaagccctctggaaagggcacggtgaataacttggaccccagctatttgaagaagaaaagtaagctccaggtaggttgcatgttaggcaactctatatctaggaatcataccaaggaaggtagtgaattgttggtgattaagtataacactcataaggaggtggaaaggatatgggaatcgtaccaacgaaggtag

SEQ ID NO: 61802 - DNA, 465 bp, Glycine max
  Peptide Sequence Number=SeqID_153487
atgcatctgcataggagacaagtgcaactgcaggatctacgctgtccttttttcagagaagctgaagaggagtcatctcatttgttcttccattgcgtcttcatccaaccaatttggtgggaatcgatgtcttggttgaatttacaaagtgcctttcctcttgggcctaaacaaaattttctacagcatattttcatccaagcagaaggtttaaggattaagagatggagatactggtggatggcatcagggttaaagataaggctaaagacatggaaccaagagcagtttggagatacattcaaaaaggtcacaaagctggaatcagatttaaataaactggaggagaactcaatgcatagacagttaacggagcaagaaaaattggagaggaagcagttacaggaatctctttgggttgctgcccaagcccatgaatccttacttaggcagaaatccagatga

SEQ ID NO: 61803 - DNA, 392 bp, Glycine max
  Peptide Sequence Number=SeqID_153488
cttcgttggaagttgttgtcttcaatcaacaaactaaagctggtgaacctcaaagcggtgaaggcgatgaagaggctattgatgaaggcgcatttgggcgcaacggcggtggagaaggggagtcaccaaacaaggaattggtagagaaagcagttgaagtcaagaaagaggtggaagaggtgttgaaatcaactaagttgaagattgttggagtaatggagagaagtgtggaagatcttaagggcaaaatcaaggagttggagagtaagatagctcaaggctcaaattctgaggatatggaaaagataaaggaaaagattgagagactaagggaagatttggaatcttcatccaaggatgtttatgtaaaacaattaagtgttaagtcttga

SEQ ID NO: 61804 - DNA, 72 bp, Glycine max
  Peptide Sequence Number=SeqID_153489
atgacggtccaacgatccaatctaggtgtagtacctatggctcatcttgtggtacctcaagtttttagataa

SEQ ID NO: 61805 - DNA, 915 bp, Glycine max
  Peptide Sequence Number=SeqID_153490
atgaaggaggtagtctcaatcgggcgtaattggaaagagaagggacaggctaatggcggtgctgaaggttatgcgttttgcccatgcaatggttgcaacaataggactcgaggatttaggggtgagaaaggagaagggtggcttcagaatcttcactatggtttcaatttgattttaatcatggagttgttggttgttgtggcaattgatgcaggtggcgaagggtggccctcttggctctctaaggttgctggtgaggctatcaatggattaacccctcggagggccgacacttttgagaagattgataaggctgtgagtgaattgtgccacaacatagaaggaaacatcaacgttggctcatttagtaggttgatatatgacatgatgcttgtgtgggagagacctagctactacgatgaagaagataccatggagaatgtagcaaaggagaaagaagaaaggaagataactttgaataccactcaggaacaagatgatatccctctttttttttcacatgtgaatgtgagtatgagtacagtgcgtgtggtgactgatgctttggagatgatggtgcgcatgatgcacagaggtgcttgcggctgcgactgtgaagccaacaccggagatggagcagggatgtgtgaggtgcttgcggctgcggctgtgaagccaacactggagatgaagcagggatgtgtggtgactgatgctttggagatgatggtgcgcatgatgcacagaggtgcttgcggctgcggctatgaagccaacactggagatggagcagggatcatggtggctctacctcaccagttttacaaggaggatgtctatccaagatgggctgcaaactctcactacaccttggtaccaattccggagggacaacaacttgatggctcgagatga

SEQ ID NO: 61806 - DNA, 330 bp, Glycine max
  Peptide Sequence Number=SeqID_153491
atgagcaatttaatcgaacagctttatgatcacagcataataaaaactaatcatgctctatcaagttctaaggagacaatacatctttcaatgctaaagcccctaataagcaaggaggagcatgaagcgttagtttgtttgtgtggaagccaagtatgctgggggagctatctgaatctgagtggtgaagaagctttccaaaagttcttgcaccttgcatggatccaaacagatagaaagttgggtggccttggtgacttgaattatcctttgatttctgatgccaccaaattcatattgaaatcttatggtgttctcattccagatcag

SEQ ID NO: 61807 - DNA, 189 bp, Glycine max
  Peptide Sequence Number=SeqID_153492
atgccgttgtgccattgctgttcgtgctgtcattgtgccgccactgtagtggccttgtcgttgtccatcatcatcattatggttagaaccaaaagttcgggtcgggctttaggaagagttataggaagagctctagggagagaagtcaatcgtgatgcagatgatgcccctagcggcgaaggcccatag

SEQ ID NO: 61808 - DNA, 1071 bp, Glycine max
  Peptide Sequence Number=SeqID_153493
atggcaatgctggccaagaccgactccgaggttagcagcctcacgcagtcctcgccgacgcgatccccgcgacgggcagtagcccattgggctccccgccccactcccactccaactcctccttgggccatcactcgcgcgagtccgcctccacgcgcttctctggctcgcgcaagagcagctcctcgggcaacaaccgcaagggcccgtggcggccctggaaggaccagttccatgccatcgaggaggagggcctcatcgatgctcacgacaatgcccgtggcttccctcgttgctgctatttcccagcatttgtcatcggcttcgtcctcctcttctccgcattctccctcattctctggggtgctagtcgcccccaaaagcccgccatttctctcaagtataacctttgatcaattcgtgatacaagccggagcggacatgtcaggagttgccacaagtttggtgtccatgaattcatctgtgaaaatgacgtttcgtaacaccgctacatttttcggggtccatgtgacctcaactcccgtggatctcaattattatcaacttactctagccactggaactatgccaaagttttatcaatctaggaagagccaaagatctgttagagtgatggtgattgggagtcatataccactgtacggaggaggagcaaacctgaacagtgtgaacggtaaaccggttgaaccggtgccactgacgttgagcgtgatggtgcggtctagggcttatgttttgggcaaattggtgaagccaaagttctacaagaaaatagagtgttccatcgttatggatccgaagaagatgggcaaggccatttcactggtcaagaaatgcacttaccaggtgagactcgcccgagaacgtgtttggcaagaagcgttcacgattcttaggattctcattcatgagcagcctccaattgttgaggaagagtttggcttgagtgggctcaacatggatggaccaatcactagagcaaggagtaagagattgcaaaaagagtttggcgagagactaaattctatcgtggagaaaagaaaagaatga

SEQ ID NO: 61809 - DNA, 168 bp, Glycine max
  Peptide Sequence Number=SeqID_153494
atgactaatggaaacagaaggtatatgggaataccagtgacaacacatcatcaaaagaggaaaactttagatgaggcttcactattatcaagcaagtcagagacccaacatgaccacagatcaacctccacttcctatgtctcacacagactcgggtatagggcctaa

SEQ ID NO: 61810 - DNA, 249 bp, Glycine max
  Peptide Sequence Number=SeqID_153495
atgaagagcgtggtgttagaggataagttaaaggcttgtcagaggtcaaagagaagtttgacggaacaactaagcaaaacagaaaagaatatgttgataatcattggtcaatataaggagaaggtgaaccaggttgctagtcatggacaaatgctggaagatgaacaggctaaggtatcggctctgcagattgaaagggaagcgagagagagggtgatagagttattgcacggggaagccatgaaatga

SEQ ID NO: 61811 - DNA, 96 bp, Glycine max
  Peptide Sequence Number=SeqID_153496
atgcctatttcgggaaaagagctctggaggcagcaagaggagcagcttttgcagagatacctaggttatataaacacccttgttggggattgctaa

SEQ ID NO: 61812 - DNA, 486 bp, Glycine max
  Peptide Sequence Number=SeqID_153497
atggctccccgtaagagaaaagccacatctttagtgtctcaggccggttatgatagatcaaaatttgtatcacaggaggcctgggaccattactcagataatgtgcttgtcaggaacattctgccagaaagaaatgtcaagttgtatatcaatgagtttgatgatttcagaagagaattaattagaagaaactggcataaacaactgaccaatgtgactgagggaagcattgatgtggcaattatgaaggaattctatacaaatctatatgtccctgatgacaagtctcccaagaacgttagggttcgagggcacttgataaaatttgatgttgattccctcaacacttttttggagactccagtggttgtggagcaaggggagagcttaccttcttactccaggtttgttagactgaggcctgatcctcaggagcttacagcccgactgtgtatccttgggaggggatttgttcttatgtcgagg

SEQ ID NO: 61813 - DNA, 114 bp, Glycine max
  Peptide Sequence Number=SeqID_153498
atggcgatggctccgaagaagcttcctgctaaaagggataggaaggcaaccacagggaagggatctagtgcagccccgcaactggagattgagtttgacggacaccgtttctga

SEQ ID NO: 61814 - DNA, 270 bp, Glycine max
  Peptide Sequence Number=SeqID_153499
atggagagaactgcgtatctcaacaaaagctatgagaaagtatgtattggttacttagataaaatcaatatccaaaagtcattaagctacgagaaagccaggatagcacacactattaaaaaaaaggccttctacatcggttctaatgagctttctacatcggttacgacgcgtggtggtaacacagtgtcgttgaataccgacatcggttggagaaccgtctttgaaggacgacctttctacatcggttgtgtagctcaaccgatgtag

SEQ ID NO: 61815 - DNA, 207 bp, Glycine max
  Peptide Sequence Number=SeqID_153500
atgaagaaacaacactgtaatggaggtttaaggagcacctacatgaagctcttgtgctctgactaccacttgatggaagcttgcttgtggggcttctatggaggctggatctgtgagtttcaatggggtcctttaatggtgattttccaccatggagatgcagcggaagacaaaggaaaagaggtgagaggaggcgccatccattaa

SEQ ID NO: 61816 - DNA, 201 bp, Glycine max
  Peptide Sequence Number=SeqID_153501
atgctcttaccaatttattgtaatgaagatgcaggagattcgggtgtaatgagagctgttagagcatctctagtgcagacaaaggatcaagctgaatgttttgatgatgccaaagtttcacatgcgtctcaaagtcttaaagctttatacaagacaaagaaattaaagatattcaagatggatgatcaagacagtctctag

SEQ ID NO: 61817 - DNA, 339 bp, Glycine max
  Peptide Sequence Number=SeqID_153502
atgattgtgactgaaagtaaaagtatgttctattctaattacaaagcaataaacgtgagcaactctaacgactattcagcgctctctattctcacatttcattctccacaagtcaggcttaaaaaggactcactgacctcgacgtcgcgcttagcgccattctcgcgcttagcgcgagtaagtgaatttttgctcagtgccaaactcgcgctaagcctggaaggtgacaaacaacttgctgagcaagctgatgacgcactgagcgcgtgcctacatggcagattcccttccagattcctcctatctgctaagcgcgttgatgtctcgcttagcggatga

SEQ ID NO: 61818 - DNA, 267 bp, Glycine max
  Peptide Sequence Number=SeqID_153503
atggctaattatgccagtcgaatatgccattcttgccaacctaattgtgaagccaaggttactgtagttgatggtcaatatcaaattgatatttatagtcttcgtgaaattcaacatggtgaggaaatcactttcgactataattgtgtaacaaaggtttgttcaataagcatgcatttgcaaacagaaatcatgattgtgactgaaagtaaaagtatgttctattctaattacaaagcaataaacgtgagcaagctcaagtactaa

SEQ ID NO: 61819 - DNA, 1068 bp, Glycine max
  Peptide Sequence Number=SeqID_153504
atggcgtcgctcgcccgcatggcgttggtcaagcgccggatgcgcgcgttgagtgacgatcgcccgcgcaatgtgcgctactcacccctgttcacgctggtcgtcgatcagtggcgtacccgccgtatcctgcagcgttaccacgcctggagagatatgatgacggataaagtccgtattgatactttagttgcaaactcattaaacggaaacaatgaaacctatttggcgcgccaagccgaatttgagtcgaatgttaggagttatccgcgcaaattgccgttggcaattgcgaaagcccagggcgtttggatcactgatgttgagaataatcaatatcttgattgcctggccggggcgggaacgttggctcttggacataatcaccccgacgtcctgcaaagcatccaaaatgtcattaccagcggcttgccgttacatactctcgatctcacgaccccgttaaaagatcgtttctccgattacctgctctctctgttgccgggcgaaggcaaagaatattgcctgcagttctgcggcccgtccggcgccgatgcggtggaagccgcgctgaagctggcgaaaaagcacaccggccgttctggcgtgatcagcttctccggcggttatcacggcatgacccacggcgcgctgtcggtcaccggcaacctgtcgccgaaggcggcgatcaacggcatgatgccggaagtgcagttcatgccttacccgcatgaataccgctgcccgctgggcatcggcggcgaagccggcgtcaaggcgctgacctactacttcgacaacctgatcaacgacgtggaaagcggcgtgcgcaaaccggcggcggtgatcctggaagccgttcagggcgaaggcggcgttaacccggcgccggccgagtggctgcagcgcatccgcaaagtgacgcaggagcatggcattctgctgatcatcgacgaagttcaggccggtttcgcccgtacgggcaagctgttcgccttcgaacacgcgggcatcgagccggacatcatcgtgatgtcgaaagcggtcggcggcggcttgccgctcgcg

SEQ ID NO: 61820 - DNA, 945 bp, Glycine max
  Peptide Sequence Number=SeqID_153505
atgaaactttcattttgtaccgacaggctgggccaattacccttcgagcagatgctggacccggctgctggagctgggggtgtgcggcgtggaaatgacccacccggcggctggtctccggcaccccatctggatgccgacgatctgctggccaaccccgccaaacgccggcagctgctgcaggcgctggccagccgcggcatggagatcgccgcgctcaacgtctccggcaatccgctcgatcccggcgaactggggcaacgccatcagcgccaaaccgacaatacgctggagctggccgggctgctgggggtgaaaaagatcgttatgatgagcggcctgcccccggctagcccgcatgacaccattcccaactggatcacctataccgtcagctggccgccgacggtgaaaaactgtctggattatcaatggaatgaagtggcaatcccctattggcaggcgctggtcgcccgggccaaagcgtgcggcgtcgagcgctttgcgctggaaaacttcagcgccatgctggtgtggaacccggaaacgctattccggctgcgcgaggccgttggcccgatggtgggtctgaacctcgatcccagccacctgatctggatgggtgcggatcccatcgcggtggcccgcgccctcggccccgccattcaccatgtgcacggcaaagacgtgcgccttgagcgcggcgtcgttgaggttaacggactgctggagaccaaaccgatcgacgacgtggcccgccgcgcctggaactatgtcgccgtcggctgcggccgggatctgcagtggtggaaggcgttcttctcggtggtgcgcatgatgggctacaacgactgggtgtcgctggaaatggaagacctgaccatgtcggtcgatgccggcatcgtttcctccgttcaggcgctgcagcagagcatcagccagtaa

SEQ ID NO: 61821 - DNA, 405 bp, Glycine max
  Peptide Sequence Number=SeqID_153506
atggggacacatcccaggagcctccccatgtttgaccatgtgaaatttggcgtcagcgactttgcccttagtaaagcgtttttcctcaatgcactcgcgccgctgggcgtaaagatcgttgccgaaggcgaacccggctatggcgtcgaactttgtcacgatcggggtaacgtgtcattgtgcctgtttcaaaccgatgaaaaaccggcgcatctgcacctggcatttgccgcaagcagccgtgaacaggtcgatgcgttctaccacgctgcgctaaatgccggcggcaaagacaatggcgcacccggtttgcggcccaattaccatgcccactactatgcggcatttgtgatcggcccggatgaccacaatatcgaagcggtgtgccataacccgatgagctag

SEQ ID NO: 61822 - DNA, 360 bp, Glycine max
  Peptide Sequence Number=SeqID_153507
atgaccgccgaatcccactgcagcccaacgggcatcagcctcgaagacaccggctatggttatacgctgtcggtgattaacggcaaatataaaatgattattctctactggctggcgttgtataagccggtattgcggttcaacgagctgcagcgctgcatcggcaccatttcctacaaaacgctgagttcgacgctgaaagagctggaaaaagatcggttggtggtgagaaaggagtatccgcagatcccgcccaaggtggagtacagcctgtccgaacgcgggcgttcgctgatcccggtgatcgacatgatgtgcaactggggggagcagcaccggccggaacagccggtgccgtga

SEQ ID NO: 61823 - DNA, 432 bp, Glycine max
  Peptide Sequence Number=SeqID_153508
atgtgcagtgccaccgattataaaactaaatcaatcggaggtatgtgcatcttactacaattgtgggcatgggaacgatgtccaaccttggctccaaagaggactccttcccaaatagaaaatataccactagggcacaggtggctgcgacgtggaaaccaacatattggcaatgatgatgtgaaagttttttgtcgcaagttggatattatgaaacgtcataagtttgtgtgggagccttacccatcaaccgttatatcattgttgcctcccgtttgtttagtcggaactctcgcgtggcgaaagacaaagatgtttgttgacccagaaaatgcaaagatggctacattggctgaagttgcggagacattacaatacatggtgtctcctcaagggaggaatacatggacagttgatgatctcgtgccttat

SEQ ID NO: 61824 - DNA, 372 bp, Glycine max
  Peptide Sequence Number=SeqID_153509
atggaattattgagattacaccaacatgaagaaaatgacaagaaaaagaaaggaattgctcttaaagtatcatcatcaattcaagaagaaagtgatcaggataatgatccagatgatgatgatgatctaagtctttttgtaagaagattcaacaagtttcttaaaaaaaagatggaaaaatctgaaaagaaaaatcatagtgaaaagaaactgaagaaagcatacatcacatgggatgaaaatgatatggaatcttctgaagattctgaaaatgaagagataaatctctgccttatggctaaaagttacgaaagtgatgaagagaagaggacatggcatatcaacttgctacttcaagaaaaattacagtaa

SEQ ID NO: 61825 - DNA, 237 bp, Glycine max
  Peptide Sequence Number=SeqID_153510
atggtttccggggcttccgcgacttccgtaacattccgaggaagcaactgggaggcaagctcctccacgtttttgaaaaatggttttcggggcttccgcggcttccgtaatacttccgtaaaatttccgaaaaccttgggtaagcatattccacttaacattggtgaaagggaagagaaaaaagatgaaaatcaaattcgaaaacagttccgtaaggcttccgtaacttttccgtaa

SEQ ID NO: 61826 - DNA, 123 bp, Glycine max
  Peptide Sequence Number=SeqID_153511
atgcctgcgggtatagggcttttcgactctgacaggatcaagacagaactcatatgcaatgcctatgcaaagacacatgcaggacgtgcacagtatgacatatttaccgaacataagcaaagg

SEQ ID NO: 61827 - DNA, 117 bp, Glycine max
  Peptide Sequence Number=SeqID_153512
atgaggaagagaagagtgttggacttcaagaagaaagttgttgaagagaaaggtactgatggcaagaaaaatgatgagcgaggtgaaaataatcaggaaaaagagaaacaaataatg

SEQ ID NO: 61828 - DNA, 629 bp, Glycine max
  Peptide Sequence Number=SeqID_153513
gtggaaagacccggtggatcgttcggtcctgccgacaaacctttttcggagccccatgaattgcgttttcgttcatgtgtcctccaccttcgagtttggagccatgcgtagggattgcttagtgcaattctccattctcaaccctttttcggagcccatgaattgcgttttcgttcatgcgtcctccaccttcgagtttggagccatgcgtactatgcgtagtgattgcttagtgcaattctccattctcaacctttttcggagccccatgaattgcgttttcgttcatgtgtcctccaccttcgagtttggagccatgcgtagtgattgcttagtgcaattctccattctcaacctttttcggagccccatgaattgcattttcgttcatgtgtcctccaccttcgagtttggagctatgcgtagtgattgcttagtgcaattctccattctcaacctttttcggagccccatgaattgcgttttcgttcatgtgtcctccaccttcgagtttggagccatgcgtagtgattgcttagtgcaattctccattctcaacctttttcggagccccatgaattgcattttcgttcatgtgtcctccaccttcgagtttggagctatgcgta

SEQ ID NO: 61829 - DNA, 293 bp, Glycine max
  Peptide Sequence Number=SeqID_153514
gggagacacatgaaattccccaccgtaatctggccgacttcgagccttgcctcggatatgccactgaagggcaagcagttggtggtatacccctgcaaaacactttgaagggccccttacattttgcggtgggaagagcccctcctgctatggctgaaaagggaaagttggatcatatagaggaaaggctcaaggacattgaaggaggtgaagattatgcctttgctaacctagaagagttgttcctagtacccgaacatggtcattcccaagttcaaggtgccggactttga

SEQ ID NO: 61830 - DNA, 831 bp, Glycine max
  Peptide Sequence Number=SeqID_153515
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccgcactggggccagatggtaagccctcccgtatcgtagttatctacacgacggggagtcaggcaactatggatgaacgaaatagacagatcgctgagataggtgcctcactgattaagcattggtaa

SEQ ID NO: 61831 - DNA, 424 bp, Glycine max
  Peptide Sequence Number=SeqID_153516
atgggtgacatagaagaggtgcaagaacaaatgaaggccaatatggaggccttgaaggatcaagtggcttccatgatggaagtcatgttaagcatgaagagaatgatggaaagcaacgcggccatagttgccgccgccagcaccgtcgctaaggcggatcctacccatccctccgccataaaccaagcgaaccaacccgcccaggacatggtgggacaaggaggagcggtgttgggcagtaccggtggttcacatttggggtataataggaatgcttacccatacgacttacccctcaattatacgccgcccaccatgcacatgcctaatgagaacgttaatcatgttgttcccgttacctttgagggtcaacaaccccaacctataggaggcacccgcgaagaacctcggaagcgtgctcaag

SEQ ID NO: 61832 - DNA, 150 bp, Glycine max
  Peptide Sequence Number=SeqID_153517
atgggtgaagactcatggtcgttggtccgcaccaatctgcttaaagaacttgggaaattcttatatgagtgtatgaagctctttggtggcaaggagagatttgaggaattaaggatgtcactacttgttgatgggctaaccaaggtttaa

SEQ ID NO: 61833 - DNA, 534 bp, Glycine max
  Peptide Sequence Number=SeqID_153518
cgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggaagagccggacatcgaagggatcaaaaagcaacgtcgctatgaacgcttggctgccacaagccagttatccctatgtgccgccccagccaaactccccacctgacaatgtcttccgcccggatcgaccggccgaagccgaccttgggtccaaaaagaggggcagtgccccgcttccgattcacggaataa

SEQ ID NO: 61834 - DNA, 449 bp, Glycine max
  Peptide Sequence Number=SeqID_153519
atgaccacattggtctctacttgtcaatcggacttgggatctccgaatgacgtggtgcggataaccgtaaggtgtctccgcatactaccggactcttgggtcatgatagcaaaaggtggggtggtcgacaaaagggaggctcttgctcctacgcatcctccatttgtgatgaggaactcagacctatgtgcggataactgtaaggtgtctctgcatgctaccgaactcttgggtcatgatagcaaaaggcaagtatgggcaatttcaccctgggtcaaggtttgtggtgagttgggattttggctcaaggcttgtagaatggctggacatgatatatgtcagggcgtcggtttggccagcggttcagggataaaggggatgtctcacattatttccatgacacatgtcacaacctacccttctgcgggagggcgacgcgtgactcgcgg

SEQ ID NO: 61835 - DNA, 207 bp, Glycine max
  Peptide Sequence Number=SeqID_153520
atgaatggaatatttattagtcagtcaaaatattgcaaagaactaattaataggtttgggatggaaaatgctaaacacatggccacttttatgagcactgcttgttatctggataaagatgaaatcggtcagtcaatagacataaagaaatatagagatatcaagcaaatcccaaagaatctcaccttagtgcaattaaaagaataa

SEQ ID NO: 61836 - DNA, 363 bp, Glycine max
  Peptide Sequence Number=SeqID_153521
atgccaagaaggaggaatgcgccgtcaagactccgggcggatagggcatggcccggccatgttagccagtgtttcaccagtgctggaatggtgtccgaagaggaggtggcagcaataggagaggagttccctcaagacccgccaaatttcgtatatgagggtcgagtctttgaggatcctaacgatgagggtttgacaattgattttgaccgagatgtgagccaaacgataaacgaagaagaggaagaggacgtcctttcaccagagttggagaggttgatcgctcaagaagaacgcgaaatgaagcctcaccaagaggaaaccgaactggtaaacttagggactggagagggaaagaaataa

SEQ ID NO: 61837 - DNA, 312 bp, Glycine max
  Peptide Sequence Number=SeqID_153522
atggtgtttgtatctccttccactagtgaatggcaatatttccagcctgggtctaccttatttttcctcgttgcacttgcagtagcagcattggatgatgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 61838 - DNA, 490 bp, Glycine max
  Peptide Sequence Number=SeqID_153523
tcaaggtgcaccttttgagggcaccattgttgatgactggaaatttgattattctagtcatgatgctcaccgtatggtttgtaattaccaggctgaaatgaccgcctctgaggaggacttgatcttgatgtgggttttccttaccgatcatcagatcgactgggctcacttggttcagtaccgaatgcataaggcattacgggccaatgcacctcttccttaccctcaattggtcactctgtttctcctcaagcgttcctttgctataggtgctggtgcagtcacttcatttggataccttaaggatcgtaatgccctcatgactaaagttctttccgagttacggggtcttcgttcttatgttggtgaacgttttgattctttggataatcgctttgccggaatggatatccgtctcacacagcttgaagaagatgtgggttatattcgtcagagcttcgatcttccaccaccacctccaccttcttag

SEQ ID NO: 61839 - DNA, 401 bp, Glycine max
  Peptide Sequence Number=SeqID_153524
taaaggcgagtgtggacgaggttaaagatgcagatgctccagttcctgtacccactgctgaggtttccttagtggggcaggcacttcacaccttccttgcttggccgacacatctgatcaagtctttatcacaccaggtagttgtgtctccgccaaaaccacctccgaagcccgatccggaggtcgatgatccgctttatctgatgacattgaccatcgcagagcttttcttgaggccttatcagggtcttgatgatgctccacagcctaaatcaaaggctcctgctaggcggattgtcgtcaagtgtaatagacaaaaaggaactactgagtgcggctactatgtcatgcactggatgtccaccattattttaggaacttttacaaataattgcgaagcg

SEQ ID NO: 61840 - DNA, 712 bp, Glycine max
  Peptide Sequence Number=SeqID_153525
atgaggggagcaccgacgaaagaaagcttgtctcctttccttgcgtgggaaagcccgttaaggaaagataaagaacttaggggcatttgtaatggcatcatcggtggttatcatgaatggctgaaaattcatacacgagggttagattggctctccaagttaaagattatcaacgaagagaacttcgaagctccggaagaggatgaagaagtccgagctctgaaaactgaactaggaaatgcaagacttgccaaagaaaaattcaagttggtcactacagacgtccggaaagagtgtgctgggttacgagaagaaaatgcagctaccgcaagagcccttgaacaagaaaccaagagggctcgcaaggaagagcatggccgtgacaaattttgtggagctttgtggggcagcaacagtgagctcaagcttcgaagggaagagagagaccaatcacgagcacatagcatggtcttgaaagaagagttagagctcaaggtccaaaaggaacttgtctcagcgtttatgcgagacaaagaccaacatgctagaggaagggtgatcgactcgttacatcaagaggcaacaatatggatggaccggtttgctcttaccttgaacgggagtcaagaacttccccgattgctagccaaggccaaagcaatggcggacacctactccgcccccgaggagatccacggacttctcagctact

SEQ ID NO: 61841 - DNA, 138 bp, Glycine max
  Peptide Sequence Number=SeqID_153526
atggagagtgaagaggacgaggatgtggggcttcctccagagctggagaggataatcgctcaggaggaccgagagatgaggcctcatcaagaagagacagaactagtagacttaggaaccgacagtgggaaaaaggaa

SEQ ID NO: 61842 - DNA, 267 bp, Glycine max
  Peptide Sequence Number=SeqID_153527
atggcagcggaatggagaaggaagagagagaggagacgccacttcaaggagaagatgagtctagaagaagctcatcaccataggaggccatggataagagcttggaggaagaaggagatgaatgaaaggagagggagagaagagcacgaaattgtgtgctctaaaagagctctgaaatctaaattatggttcaacccactaatccaagataaattccaagattctccactaagtgtgcataggcgtcatgaggcatgtaaagcatga

SEQ ID NO: 61843 - DNA, 596 bp, Glycine max
  Peptide Sequence Number=SeqID_153528
gaatccattgatgaagaagatcctaggcctacaagctccaatggagcttgcatcaattatcaacgaagagaacttcgaagctccggaagaggatgaagaagtccgagctctaaaaacagaactaggaaaagcaagacttgccaatgaaaaattcaagttggtcgctacagacgtccggaaagagtgtgccggcaacagtgagctcaagcttcaaagggaagagagagaccagtcacgagcacatagcatggtcttgaaagaggagttagctgctttctcaaggtccaaaagaaacttgtctcagcatttatgcgagacagagaccaacatgttagctatcgtcagcaagtaccgagaagaactaaatctagccacgacccacgagcataaagtggcggacgagtatgcccaagtgtacgcggaaaaagaggctagaggaagggtgatcccgttacatcaagaggcaacaatgtggatggaccgatttgctcttaccttgagcgggagtcaagaacttccccgattgctagccaaggccaaagcaatggcagacacctactcctcccccgaggagatccacagacttttcagctatt

SEQ ID NO: 61844 - DNA, 495 bp, Glycine max
  Peptide Sequence Number=SeqID_153529
atgactaggggcaatccaggtgatttacaaccctttgatcctgaaatagatagaacctttcataaattagttaggcatagtgtgcatcctgtgcattttgagcattatgttgagggtgattctgaatattctgattttgagcattccactactaattttcatactgagaacatggctcaacctccaccttgtgagaggactcttagggagatggctgcacctaatttcacttatgaaagcttgtgcattcaatatcctgatgagcgtgttccatatgttctcaagactggactaatacatttgctgcctaagttttatggtcttgcaggtgaagatcctcataagcatcttaaggagttccatattgtttgttccaccatgaagccccttgatgtccaagaagatcatatctttcttaaggcttttcctcattctctggagggagtggcaaaagattggctctactaccttgctcccaggtccattgtcagctag

SEQ ID NO: 61845 - DNA, 210 bp, Glycine max
  Peptide Sequence Number=SeqID_153530
atgggggtgcaaatagcaactaggcccacttgggccctccagaagattcctccagaaggttgttgcttctggaggaagcaaccttgctcgcctgggcgagctgagctcacctgggcgagctggataaatggcagcggaatggagaaggaagagagagaggagacgccacttcaaggagaagatgagtctagaagaagctcaccaccatag

SEQ ID NO: 61846 - DNA, 223 bp, Glycine max
  Peptide Sequence Number=SeqID_153531
aagatctactgcagttgatttgattcccattgatttggagattaatgccacctatcgaaggcgtaattcagagagaatcaaatttttttggcaggatttagaagcagcagcaactccagaagaagaacctcaatcttccgaggcatcttctagttttcctattgcagggaattctcatataaaatcagttgaagatacaatcatggatgaagagccaagatga

SEQ ID NO: 61847 - DNA, 394 bp, Glycine max
  Peptide Sequence Number=SeqID_153532
ttctggatgtttgctagtagatcccaacggtcacaatgtaggcttatgtactatagacttccaagttttctgcctttgccctattttgcttggctgtgatagcttgtgctgtttgaatgttgttttgcttggatgttgtggaagcttgggaggattgatggggacccggggatggtgggtttatgcgtgcattgtggatgtggaaaacttgttgtgcaccatcgcccgaccgccacctagtaccacatgtgatggggtgaaacttcctgcttttattgttgaccacagagtggtacctggagatatgtcgtgggggtcaggagaccttggggacgtcaggcttgaaaacgaggtcaggaagctaaggaagcctctggtaatcgattaccaaggg

SEQ ID NO: 61848 - DNA, 473 bp, Glycine max
  Peptide Sequence Number=SeqID_153533
atggcatcaaagaagagaaaggcacctgccacaccttcccatgtccgatatgaccgatccaggttcacttctcctgaggcttgggaaaggtacactgacattattgttcctaggaagctgctgccagagagaaatgtggtaatctaccacactgaatttgataaattcatggaagaattggagagaagaagatgggatgaagaattgaccagctttgaggaaggcaacattgatgttgccataggggagacattatcagcttattctaggtttgcactcttgaggcctaatcctcaagagttagctgctaagctctgcatcccagggaggggatttgagcttaatgctgatggtcagcctctgaagatcctcaagaagaacatgaccacactcgctcagacatggagtgttctttcttactccaacttgatccccacctcccacacttctgacatcacactggatcgggctaa

SEQ ID NO: 61849 - DNA, 276 bp, Glycine max
  Peptide Sequence Number=SeqID_153534
atggctaagtttgaccctgatatagtcctggagttttatgctaatgcttggcccatagaagagggagtgcgagacatgcggtcatggatgcccttatccagttcctgggtgacccgctattgttggaggaaggctaggagtacgagttcggtcagaagaggaattgggccgatgggtttgacaaggaggccattgcccagctgttatgcaccccagggcaggatttcgcccggatcgctacagggaggcgggtgcggatcatgcgcaccagcatga

SEQ ID NO: 61850 - DNA, 274 bp, Glycine max
  Peptide Sequence Number=SeqID_153535
gtggctgcgacgtggaaaccagcatattggcaatgatgatctcatagtttttcgtcgcaaattggatatcatgaaacgacatgagtttctgtgggagcctcacacaacaactgttatgtcgacgttgcctcccatttgtttggttggtagcgtagcatggtatgcagtggtgccacttatttgtttccatgttgtagagtgtcccaacccgatagagtgttgcgacaatttggaatgcaataacctatttaggagtctccttcgcaaccactga

SEQ ID NO: 61851 - DNA, 747 bp, Glycine max
  Peptide Sequence Number=SeqID_153536
atgacgtgtggatcgctactgccggccaggtggccgcgcactggcagacgcagccggataacgatgccgatcatccggcagaggtgtttgcccggctcagcggaggcgaacatggacaccacgcttgatcggctggcggatttcatcgcggccacccgctttgcccagctgccggaaccgctggtagcgcaggcgaagcgccatctgctggatacgctcggcgcggcgctggcgggctgtgacagcccgatctggcgcgaatgccgggcgctggtggctgaagagggcggcagcaccgtggcgcagctgtggggctgtgcgcagcaagcttccccgcgccaggcggcgtggctcaacggcgtggcggcgcacatgtatgaactggacgacaccggcggctgcgatcactccggtgccgtggtgttaccggcgctgctggcggcactgccgctggcgacgcagccggtcgacggccgggcatttctcaccgcgatggtcgtcggttatgacatcggccgccgcgtgatgagcctgcgggggtcggcgcacaacggtgcgggctggcactcaactgccagctgtggcgtccggatcgccggcgaatccgctgagacgcggcggccgccaaatactgcggctgccgcgcgcagtgtgcctcggcggcatcggcagcagctggcgctgtgtctgacgctggataacgtggcggatgtgcggcaagtcgcggcgttgctggcgacccggtaa

SEQ ID NO: 61852 - DNA, 261 bp, Glycine max
  Peptide Sequence Number=SeqID_153537
atggccattattgtcaatgcggaagcttgtggttacgtgagcatgaactactaccaatatatagatgttgtttacacaaatgagcacatcttaaaagcatactccgcacagtggtggcctcttgggaatgaagcggcaattcctccttctgatgatgcatggacacttatccttgacccaactacaattcgtgcgaaaggttggccaaaatcaacaaggataatgaatgagatggattggctggaaccatctgaccactga

SEQ ID NO: 61853 - DNA, 181 bp, Glycine max
  Peptide Sequence Number=SeqID_153538
atgtatagcggtagaggacctgttgcaacagaccaaggccggctggaagtcgacgataaaaggggtgaagagcagcacatatgcatgcagactgcagatgatgaaggtcatgaaaggcctaaagcctttggtgatatatttcaccagggacgcaactccccaaacgccccgatacccctcg

SEQ ID NO: 61854 - DNA, 172 bp, Glycine max
  Peptide Sequence Number=SeqID_153539
gagaatgatagatctcatccagcgcaagttgttgcagcccagatacgcacactgctatttaaacatgaaggctgcacgggtttgagtaccaaccaccttgatgtcaccctaacatcaagtgttggacctgagtgtgtagagttgatctctattgttcagagagcaatctctg

SEQ ID NO: 61855 - DNA, 357 bp, Glycine max
  Peptide Sequence Number=SeqID_153540
atggaaagaagtatgatagatgctgccagtggtggagcccttggagacatgacccctgccgaagccagaaatttaattgagaagatggcttccaactcccagcaatttagtgccaaaaatgatgctattgtcattagaggagtgcatgaagtagccacgaattcatcttcatcagccgagactaagaagcttgaagcttctttacccacacccgttcagaaatgtgggaacccttgcttacttttcactacatccgggcggcgatgcagcggcccttgctcttttgacactgtactcgagccatacagcgcgttgcttccgggcaacgacctagcattcacattattacgtaattga

SEQ ID NO: 61856 - DNA, 162 bp, Glycine max
  Peptide Sequence Number=SeqID_153541
atggggtataaaaagggagaagcttgccacccagctcgcccaggcgagctcagcttgcccaggcgagcaaggttgcttcctccagaagcaacagccttctggaggaaggatctggaaggcccaagtgggccagattgctatttgcacccccctttttactaa

SEQ ID NO: 61857 - DNA, 351 bp, Glycine max
  Peptide Sequence Number=SeqID_153542
atggtggggtatgcaccttcaagctttgcggatttggtcttcgccagcgaaaggatcaaagtgggcttggaaagaggtaaatctaaccatcctactttgatgaatacgaaaactagggcaaatgaagagggtgagaatgagggagaaactcatgctgtgactgccattcctatacagccaagtttcccaccaacccaacaatgtcattactcagccaataacatcccttctccttacccaccatccagttatccacaaaggtcatccctaaatcaaccacaaaacccacctaccacacaaccaatgctaaacaccacctttagcacaaaccaaaacaccaaccagaaatga

SEQ ID NO: 61858 - DNA, 540 bp, Glycine max
  Peptide Sequence Number=SeqID_153543
atgagacagctagggtaccccatgaggggagcgccaacagaagaaagtctctcacctttccttgtgagggatctaggcgcgcaaagtctcaaggtgatacaaagagtccacaaggcgtggagaagtccgttgaggaaagacaaggagcttagaggcatccaaaatggcgtcatcggtggttatcatggatggctaagagttcacacgcgagggttagattggctctccaaattgaaagttatcaacgaggagaactttgaagctccggaggaagacgaagaagtccgagctttaaaattagagctagggaaggcaagactcgccaaggagaagttcaaatcagccgctacacacatccggaaagagtgcaccgagttacaagaggaaaacgcggccactgcaaaagccttgaacaagaaactaaaagggcccgcaaggaagaatatggccgagagaaattccggggggcattgtggggtagcaacaatgagctcaagctccaaagagaggaaagagactggtcacgggtgcatggcatga

SEQ ID NO: 61859 - DNA, 657 bp, Glycine max
  Peptide Sequence Number=SeqID_153544
atgtttgttgacccagaaaatgcaaagacggctacattgggtgaagttgcggaggcattacaatacatggtgtctcctcaagggaggaaaacatgcacatttgatgatcttgtgccttatgtggaaaaaattacaattttatccgaagagcaagagagagtcactgagccagtgtcacatggtccagcatcagagcgtcaatttcccccacaacagtttcacatgcttcagtcaagtattgaaactcaggggatagacagaagaagggacactgttgaagcggaagaatattcccaacaaatggcggagcgtggccatggaatgtattacacgccacaaacatttgctgagtatccgacacagatgtatcagtatccttttcagggtcatgaaactgatacttctgcaacccagcaatcgttcggtggttttgcggaaacacaagctcatttttcatggcccacaatgaccccttcacagcaatatcatgggccaattccaacacctaatgccccgttaggaacacaatggaatgtaccgggacaaatacctaatacgggtgacttattcggtgttgatttgcgtcacgcattttctgcggaggctgacgaagaagaagcggggaggcatcggggcagtggaagaccgtatcgataa

SEQ ID NO: 61860 - DNA, 651 bp, Glycine max
  Peptide Sequence Number=SeqID_153545
atgggtgatcaagaggagacacaggaacagatgaaagccgacatgtcggctctgaaagaacaaatggcctccatgatggaggccatgttaggtatgaggcagctcatggagaagaacgcggccaccgctgccgctgtcagttcggctgccgaagcagacccaactctcttggcaactgcgcaccatcttccctcaaacatagtaggacggggaagggacacactggggcacgatggcagccctcacctgggatacaaccgagcggcttacccttatggattgtcgcccaactactcaccacccgtcttgcaagaagatgcgggccatattgcttctcccggccttgaaagagagcctcctcaacagcccgaagaaggccacaaagaccctcaagactacgctcaaagggatgtcgagttctatcccccgatccccgaagggccggcacctagtacgttgcctcaacccaacatcgcgacacaaccaatagttttgcccaaggaaggaccgtccccggcaactgaagaaaggaggaagctcgatctccttgaggaaagattgagggtcgtggaaggatttggggactatccgttcgcagacatgacggatcttagcttagtacccgatgttgttatccccccgaagttcaaa

SEQ ID NO: 61861 - DNA, 915 bp, Glycine max
  Peptide Sequence Number=SeqID_153546
atggccaaaatacaaggcccagaagaaggaaaaacctattctaatatttacaaagaagagtggacccaaccttggcccatgtgcttagaaatctaccctaaggttcatgagaaccctagggtcttctttagcagctctagcccaatcttcttggagtcttctatccaatacttgtggggtaggattgcatcactctttccaaatttggatggcctagtagacctagcgtctgtcaatgccttccttgcttatcaccatggtaaggaaagtccgattgttgctgttttggccaatgcctatgacacatttgaccggcggtgcgagaagagcggcacaaggattgtctattgcacaaccgctctttatgaaagaggggccggagttttatccttatgtgaagggttctcaaacgtcaccttgatgggaacgaggggttgtatcaattataatcccatccttgccataagacaacttggctatccgatgagaggagcaccgtcagaagaaactatcatgcctttcattgcacgaggtttcagtgaccccaatgcaaggatgtttcaaaaggtccgaaaagcgtggagtgtggtgcaaaggaaggataaggagcttaggggaagcataaatgggatcgtcggcggctatcacaagtggctgaaggctagaacgcaagagataacttggctcccgaagctaaagatctcaagtgaggaagagactgaaacccctgaggagagcgaggaggtacaagccatgaaggtggaacttgaaagagtgcaagcggtcaaggaaaagttcaagaagatggccatcaaggtccgaaaagagtgcgatgagctgagggacgtcaacatggccacgaccaaagcattggaacagaaaacgaagagggcccaaaaggaagaatggggctga

SEQ ID NO: 61862 - DNA, 504 bp, Glycine max
  Peptide Sequence Number=SeqID_153547
atgattgatgctgccaatggtggagctcttggtgatatgactcctgttgaggctaggaatctgattgagaagattgcttccaactcccaacaattcagtgcaagaaatgatgctattgtccttagagaagtccatgatgtggccacggattcatcttcatcttctgaaaataagaagcttgagggaaaacttgatgccttgggcaacctggtaactcagcttgccataaatcagaaatatgcaaatgcactcgttattgttgcaagagtctgtggtctatgttcttctgctgatcaccatacagatctttgtccttctttgcagcaatctggagtcaatgagcaacctgaagcctatgttgtaaacatttataatagacaccctcaacagcaaaaccaacgactgcagaataattatgatctttcaagcaacagatacaatccaggttggaggaatcattcaaatctgagatgggcaaatcctccacaacaacaacaacagtag

SEQ ID NO: 61863 - DNA, 126 bp, Glycine max
  Peptide Sequence Number=SeqID_153548
atgatgatgacgaccaacatgatgtcggagatgaagatgaggacgaggtggattcggaggtacacaatgacgatggtggatattatgatgatttctagattccaggagagtttcaacatcagatag

SEQ ID NO: 61864 - DNA, 90 bp, Glycine max
  Peptide Sequence Number=SeqID_153549
atgggtgccaaatacctcgaagtggtcaaacgagggtcgcatcccaacaacggatggtccccggataaaattaggataaaagggaagtaa

SEQ ID NO: 61865 - DNA, 205 bp, Glycine max
  Peptide Sequence Number=SeqID_153550
atgaatattttgtcttataacattagagggcttggtagaggtataaagtgggcctctattaggagattggttgggaaacacaagatagacctcctctgtttgcaagaaacaaagagggactctttggataaggcactgtgccagactttgtggggtcaatcagactttgaattggaatgggtccctgctgtgaatactgctgggg

SEQ ID NO: 61866 - DNA, 171 bp, Glycine max
  misc_feature (92)..(92): n is a, c, g, or t
  Peptide Sequence Number=SeqID_153551
atgaacacccactcaaacttagcatacttctaccatcgtgcacacaggaagcggtttccggcagatttcaggcgggaggagaaagagaagancgatttcaggcaagaggagaaagagaagagcaagtgcaaggttttcgagcgtgcgagttgtgaaatgccaacattttaa

SEQ ID NO: 61867 - DNA, 381 bp, Glycine max
  Peptide Sequence Number=SeqID_153552
atggagatgtctaacttggcatctaaactgaaagcacataagttagagcttggtgaagacctactcgtgtttctgatgctagtgctgcaaatgtatactactcaagtgaacaatatctctatgctaaatgggacaaattttaaggggaagaaagccgtagaaattgttcgactgtatggatttggatttgacactgagaacggaacgatccacttccactgctggaagcctccaatgagaagcgtttcagagccattcatgggtgtaaaagcaaagcttttgtccaaaaatgagataggctggagacgagtagattctggctactatctccataagtataagggcaatgcagggttgcctatggagccgactgccaagtga

SEQ ID NO: 61868 - DNA, 246 bp, Glycine max
  Peptide Sequence Number=SeqID_153553
atgaagttgcagatgctctttttgttcatgatgagactaaacataaggtctgaaatagggttcaaagctagctgtaggttgcgcatgctctccttgttcatgatgagactaaacataaggtctgaaatagggcttataactagctgtaaatgttcacagaacacttgcaatgacattgaatacttgcaaaatttcatactgaaagagagtaagaaactgaagagaggaagaaagaggttcgtttga

SEQ ID NO: 61869 - DNA, 192 bp, Glycine max
  Peptide Sequence Number=SeqID_153554
gtgggagagaaaacttcaatatggcagacagatgaacttaggcgttcaaaacccactccagttgatgaagctagggcagcagagaaaacaagagaaacagaaaatagaagaatatacggaaaatactgggagcaaactgaattattcaagaaggaaaccttcttccaagggaaaaccctttacaatttctaa

SEQ ID NO: 61870 - DNA, 147 bp, Glycine max
  Peptide Sequence Number=SeqID_153555
atggtaaaataccgcgccaaatccaagacaggaatgaatcgaggtgctcggggacgggtacgaatggacgctaggcctgtgatcaacagatcgatgtcccgcgtttggcttcggacgatcaagaagcgctatcgggaggtagcctag

SEQ ID NO: 61871 - DNA, 225 bp, Glycine max
  Peptide Sequence Number=SeqID_153556
cgatcttgaaatgcaacatccgatgaagcttcttgaacatgatcagtatattcattggcacataataaaggatgaagacgtggttcgtgatatcttttggtgtcaccttgatgcagtgaacacctataaaacaaaccgataccgactcccattgcttgattttgttggggtgacaccgactgggatgacattctctgccggtttgcatatgtggagtgtgaacgc

SEQ ID NO: 61872 - DNA, 214 bp, Glycine max
  Peptide Sequence Number=SeqID_153557
ggctagaggggttgtctcttacagcgttaccttcgagcacttgagtccggtcattaacttggcctacatcaggaagaactgttggaatctcgacgatcgagcagtttctatccaaggagctaggagggcgagggcaaggccagctgagcttccttctacttttgtagctcctactccagcatccacttcagcagctctttctgtccctgcttag

SEQ ID NO: 61873 - DNA, 942 bp, Glycine max
  Peptide Sequence Number=SeqID_153558
acaccgacacacggatatagcaagccggtacaactgaatatattcatcgatggcttgcgaccccactcgaaacagctactagacgcgtccgcagggggaaaaatcaagttgaagactccggaggaagcaatggagctcatcgagaacatggcggccagtgatcaagcaatccttcgtgatcgaagctatgtgcctacaaaaagaagccttttggaacttggcacgcaagacgcgacattggcacagaataagctgttgacgaggcagattgaagcccttaccgaaaccctcagcaaactacctcaacagttacaagcgccaacaggatacttctcgagaagtaaactatatgggcgtaccaaatcgcggatatcagggttacaaccaggggaactcatctggattccaccaagggggagcaggattcaatcatgggccaccaggattcaatcaaggaaggaacttcacgcaaggttcagggtggaggaatcagggaaaccagtacaaggagcagaggaatcaacaaccgtaccaaccgccataccagccactcctagccagcaagtattgcaagacggaggcaagccgcaaatatctcctacccgcattcccttatccagcttattcaagggaatctcttccatggtcttccaagcgaagatccatatgctcaccttgcctcatacattgaaatatgcaaccctgagaggcaaaacgatggttgcactctttcaagggcaacagcttatgaacctgggaagaagtggtggaaaagtttttaaagaaatacttcccagagtcgaagaccgccgaagggaaaatggagatttcctccttccaccaatttcccggatggagtccctcagcgaagcactagaccgttttcacgggctgtttacgaaagacaccgacacacgggatatagcgagccgggacaactga

SEQ ID NO: 61874 - DNA, 546 bp, Glycine max
  Peptide Sequence Number=SeqID_153559
atgtccttgcctacagaggacagcatgccctcgccttcagaggactgcacgtcctcgtctttagagggctacacgccctcaccttcagaggactacacgtcccttgcctttagaggactacgcgtcctcctttcaaggactacacgtagcctttcgccgttcgaggactgcacgccccctgataagagggctgcaagtcctcgccttcagaaggcttcacgcacctcgccttcagaggactacatgtcctcgccttcagagggttgcacgccttcgccttcagaggactacacgtcctcgccttcagagggctacacgccctctccttcaaaggactacacgtccttgccttcagaggactacacgtcctcgccttcacaagactacatgtccttgccttcagaggacagcacgtcctcgtcttcagaggactgcacgtcctcgtcttcaaaggactgcacgtcctcgtctttagagggctacacgctcttgccttcagaggactgcatgtcctcgccttcagaggactacacaccgtcaccgtga

SEQ ID NO: 61875 - DNA, 306 bp, Glycine max
  Peptide Sequence Number=SeqID_153560
atgcctgctcctcatctccccgatctcaatcacattcgtgccaccatttccttcgacaacctcttcagcattgttcttcgttatggccatgcaacaactcctcatgacaagccttgggaaaatagagacatggcgttgtttgagatgggacctgagtcctatgggactgccatggtcacatgcaagtgccaaccagctgcctttgcactatggacaactactaaactaggtgtgtttcgctgggacagaccttgggatcccagtattacttttgaaaaccatggtttggagccccaacacctttaa

SEQ ID NO: 61876 - DNA, 354 bp, Glycine max
  Peptide Sequence Number=SeqID_153561
atggaaaccaatgcggttgcagttgccgctaccagggctgttgctaaggtgaacccgatgcccccatctgatctcaaaccaaatgaatcatccaacctcagatatgccactgaagggcaaggccctcagtatcacccacaaccacaccccttgcattccacagcgattaaaaaccctcatgctatggcggaaatgggaaaggtggatcatctaaaggaaaggcttagggccattgaaggaggcaaagattatgcctttgctaatctagaaaagttgttcctagtacccaacatggtcattcccaagttcaaggtgtcggactttgacaagtacaaggggactactttgccctaa

SEQ ID NO: 61877 - DNA, 450 bp, Glycine max
  Peptide Sequence Number=SeqID_153562
tatgcgccactaggcaccctttggacccagataagtccaacagggcctgggattccccgcactgatcacaggactctgccggctcagggtgacgctccacaggccgcaggcgcgccaccaccacctcatcaggctgaccaggctggggcatttgacatagagcagtatttacggcatttggttcgccagcaggcggccaaccaccgagcacatgtacggacccatgactgtctgtaccagatgagccttagcatgcagagccagggctccacttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 61878 - DNA, 270 bp, Glycine max
  Peptide Sequence Number=SeqID_153563
atggccaaccatataattcacagtagggacagtggaggaatcaccctgaaaattagttcaaataaagaccagggtggtccatctaacaggccacaacaacaagggcctagtctctatgatcgaacaacgaagctggaagagactcttgctcagttcatgcaagtatctatgtcaaaccataagagcacagagtctgccataaagaatctggaagtccaggtgggacagttggctaagcaattggcagatcgtccgtcttgtagcttttga

SEQ ID NO: 61879 - DNA, 264 bp, Glycine max
  Peptide Sequence Number=SeqID_153564
atggtcgaaagggagatgctcaccatgatggtagacaccttggcagtgttttactatgagaagttagtaggctacatgccttccagcttcgcggactttgtattcgtcggggaaagaattgaagtagggttgaaaagagggaagttcgattacgtttcctccacaagtactcatgctaaaagagtcagagcaactggggcaaaaaggaaggagggagatactcatgccatcacttctgcgcccgcatgggtcaagcccctgtag

SEQ ID NO: 61880 - DNA, 363 bp, Glycine max
  Peptide Sequence Number=SeqID_153565
atgtacttacaaaataccgtctcaattcatccaaggattatttcattccataggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttcctcgacagatggtcagaaacttcatctgagttcgaatcctactga

SEQ ID NO: 61881 - DNA, 162 bp, Glycine max
  Peptide Sequence Number=SeqID_153566
atggttaaagcacgtcaaaaaggggggaaaagagggaggtggttgccgcccaggtcgcccaggcgagctgggttacttccaccagaaggcaccgccttctgttggaacaccctagaaggtccaagtgggcttagttgctatttgcacacccctgtttactaa

SEQ ID NO: 61882 - DNA, 288 bp, Glycine max
  Peptide Sequence Number=SeqID_153567
atggactggtggctaaaggataaagggttccagaatttggtgaaacttgaatgggttctgaaacagaaaatcaagttcatcaaacagagaataaggcagtggagtatatctcagggtcatatcagtactagaaaagtccttaacctaaagagggagctgaatgctttggaggatggtctcaccaacagaattttatctcaagatgaagtcaaaattaagaaatcactccaggaacaactctggaatgcagcctatgcagttgaatatatgttgagacaaaaggctaga

SEQ ID NO: 61883 - DNA, 510 bp, Glycine max
  Peptide Sequence Number=SeqID_153568
gattcgtttgaggagcaggccacacagggatcgttcgtcctccatggacgtcaagatgttctcgccggtgctattggacgtccagagcaccctggacgtgtccgtgctgctggagctgctgacccagcagatcagggactagctagaggagtccatcacagagaaagtgacgaggcaagtcaggcatccttcaaccagcttcagtcgcagatgcaatctcaaggacttgcagtgcctcctgagcctctggttggtccctccggtcctcagagaaacgatcctgagatgggtgactctgacaggtgtggcttgtacatagaagcagatcctgcccgcctggttgccatggggagagtttatgagggatccactcttgttcataacactcctttgttgcctggccaagtaaaggtgagtgtggaggaggttaaagatgcagatgctccagttcctgtacccactgatgaggtttccttagtggggcaggcacttcacaccttccttgcttga

SEQ ID NO: 61884 - DNA, 392 bp, Glycine max
  Peptide Sequence Number=SeqID_153569
taaagctaagcactaacactcctcctcctcctactacttcggactcatcggcttcgacgtctgccgtgaagtggaaacgcaaagcctcacgcctacgattgttgtccactagaccacctggtgttgagagaccagtggtgcatgttgatcctgctacagggaaggccgacggtccccacaagaagaaattaagaacatatttggggattgtggcacgtgataaggtggacatcacctacgagaactggaaggagtttaaatcagacctcacgaggaaatgggcccttgcagccgatcaagacggtgtcgaggacactgtctgtgagaaatacggcatcagcaaggaaaaatgggcccagttttgccagactcgcagagacccttcttgggag

SEQ ID NO: 61885 - DNA, 195 bp, Glycine max
  Peptide Sequence Number=SeqID_153570
atgacggtgctcaaggtggcattgtcgtcagtcccgatttattgttttcgaattactatggccaatagtcacaagagtaggagaaggatcctttgcggggtggagaagattcatcctcagatcaaaagccatctcatcatcagaagaagcattaccacaataatgaaattaacattgaaagcatcagaactatga

SEQ ID NO: 61886 - DNA, 311 bp, Glycine max
  Peptide Sequence Number=SeqID_153571
attgctttatgcattctgaagctgaagcactagaacatacgaagaaaagagatacaggccatcaaagtgtgtcattggagaataagacaggagattcaagtgtgttgaagataggagattcggttaaagttgtgataaaacaagacatgaagggaagaaatcataaatatgggtttaacaacaataaacgtgagaagataaagaacaaaagggtggtggatgatgaaactggcaacaaacatcagctgtatgaagtcataaggataccatctaaaagaaaataccgatgcctcaattatagaaaaatgtag

SEQ ID NO: 61887 - DNA, 127 bp, Glycine max
  Peptide Sequence Number=SeqID_153572
atggcggatgcgcttaccactttagtgtccatgttccagctaacaccgcacggagacctaccgtacattgagttcaggtgtcgtggcagacccacacattattgtctggtggaaaaacagtgggacg

SEQ ID NO: 61888 - DNA, 246 bp, Glycine max
  Peptide Sequence Number=SeqID_153573
atggagatatacactccgagggagaaggaagaagaagccaccgacgtcaactcgttttcggctaagcggtcgtgtgttcgcgcctctggacctaccagtccaacccgcgaacgtcaaggggaaaggaaaagtggtgggggagcgaagccccctcgcttgaataaagatattccggtgaaaggtcggcagaaaagggatgtggcaaaaaggaggtttagaggaaaagggaggtgtgattccccgtga

SEQ ID NO: 61889 - DNA, 97 bp, Glycine max
  Peptide Sequence Number=SeqID_153574
ccatgaactgctgcgcttagcggatggtttgctaagccagagaattggcttagcgagcggctcagaatcagaacttccacaaaacttacctaattag

SEQ ID NO: 61890 - DNA, 501 bp, Glycine max
  Peptide Sequence Number=SeqID_153575
atgaggggttgtattaattataacccagtgttggccataagacagttaggatatcttatgaaaggtacgccatcagaggaaaccatcatgcctttcatcgcacgagggttcaacaaagctaatatgaagatacttcaaaagatccgtaaggcatggaataaagtgggaagaaaagataaaaagcttagaggaagaagcaatggtgtcctaggcggctatcacaaatggttgaaatctagaacgcaagggataacttggctcaaaaagctaaaaggtctgaatgggaaagaggcagaagtgctcgagaagagtgaagaggtgcaagccttgaaggctgagctcgaaaagacaaaagtagcgaaggagaagctgaaggtggtagtcactagagttaggaaagaatgtgataggctgaaggatatcaacatgtttgtggctgaagcgctagagcaggaaatgaagaaagccagaaaggaagagtggagtagaaataagttttga

SEQ ID NO: 61891 - DNA, 461 bp, Glycine max
  Peptide Sequence Number=SeqID_153576
tccagcttcgcggacctagtgttctgcggggagagaattgaagtagggttgaagagaggaaaattcgattatgtttcctctacaagtgccaatgctaagagggtcggaacaactggggcaaaaaggaaggagggagatgcccacgccgtcacttcggcgcccgcgtgggttaaacccccgcagacatctcatggtacgcatcaatacgctcaacatcatccgagcttctcagctcacgccaggaattcctctaattcagcacctatgcagcctaaggcgcccgttcagagggaggccccccaagttccaactccaactacgactcacccggccggcaattcaaacacaatgaggaactttcccccgaggccaattcaagaattcaccccactcccaatgacgtatgaagacctcctgccgtccctcatcgccaaccagctggccataataatcccgggaag

SEQ ID NO: 61892 - DNA, 660 bp, Glycine max
  Peptide Sequence Number=SeqID_153577
atgaggggagcgccaaccgaagaaagtctctcgcctttccttgcgtggaggagtccgttgaggaaagacaaggagcttaggggcatccgaaacggcgtcgttggaggttatcatggatggctaagaattcacacgcggggcttaggttggctctccaaattgaaagttgtcgatgaggagaaattcgaagctccggaggaagatgaagaagtccgagctctaaagttagagctagggaaggcgagactcgccaaggagaagttcaaatcagctgctacacacatccggaaggagtgcaccgagttacaagaggaaaacgcggccactgcaagacctcttgaacaagaaaccaaaagggcccgcaaggaggaacatggccgagaaaaattccgaggagcattgtggggtagcaacaatgagctcaagctccgaagagaggagagagatcggtcatgggtgcatggcatgatcttaaaagaagagttagttgcttgcgcgaggtccaaaaggagtttggctcaacacttggaagccacggagcaaagcatgctagccatcatagggcaatacaaggaagaattgaaccaatccatggcccatgaacaaaagccagtggaggattttgcacaagtgtatgccgaaaaagaagcaagagggagg

SEQ ID NO: 61893 - DNA, 162 bp, Glycine max
  Peptide Sequence Number=SeqID_153578
atggcagaaatcaaccaagggacggatgcaagtggggctagggtcacgaccgaccgctcgttgccccttcccggcgctaaacaagcagagaacgtcgctgcaaggcttaggattgtgggactgttttatatacatagggacagcatgaaggatttaaaatga

SEQ ID NO: 61894 - DNA, 192 bp, Glycine max
  Peptide Sequence Number=SeqID_153579
aagattcctccagaaggcggttgcttctggaggaagcaccctgctcgcctgggcgagctgggcggcagcacctcccctattttgcataaataggggaggaaccgaggcgcttccgaaacgtttccgtaaggaatttcgtgaaggtttcgaccgctcttcattcgttcttcatcgttctttgatcttcaacgg

SEQ ID NO: 61895 - DNA, 261 bp, Glycine max
  Peptide Sequence Number=SeqID_153580
atgaatatgctcttcccgctgttggccgtgctgatttggtcgattaacgccgtcgtcagcaaactctccgccaccgccatcgatccggcggccatttcgctctaccgttggctgctggcgctgattgccctgacgccgttcgtgctgccgggcgtgctgcgcaactgggcgcaggtgcgcgccaactggtggaagctgatgatcctcggcctgctgggcatggtgctgtatcaaagcctggcctattacgcggcgcacagc

SEQ ID NO: 61896 - DNA, 327 bp, Glycine max
  Peptide Sequence Number=SeqID_153581
atggctagaatacgaggtttaggtcgtgtcataggtagagttataggcaaagatagacaggatgaccatgatgatgtttccgagaggcgtaggcctactgcatcagcccgtaggcaacgggttcatcagatgactcaggatgttccttctgaggatgcccctgatatggctgaggatgcacctgagatgactgtggacgtacatggtgctgatagtgctgaggggtcacatgcttatgatgctgagggattcccaggtgggtcacgtgacccgtcagtgctgacatcatttgcagatcgtgttgcacacgccgtttggagtggacag

SEQ ID NO: 61897 - DNA, 276 bp, Glycine max
  Peptide Sequence Number=SeqID_153582
atgggtcgcttccattgggaccacatcacacagcaccttgtcattatatcgcccaatgacttatcttcctttaccggaagtggcgtctacccagacttatcgggggggtttggaagtggcgtctacccagacttatcttccttcaccggaagtggcgtctacccagacttatcttccttcactggaagtggcgtcatccaaatcttcgtagcctgtatcaaacgatccgctcctactcaggttcacatcatttggtatcagagcttcggttcttga

SEQ ID NO: 61898 - DNA, 711 bp, Glycine max
  Peptide Sequence Number=SeqID_153583
atggtgtggtataggcgtaaaacaaagatgtttgtcgacccaaacaatgcaaacacaactgcattgggtgaagttgtggagactttacaatatatggtgtcaccacaagggagcaacacatggacagttaatgatctcgtgccttacgtggataagttagcgattatatctgaagagcaagagagaatcattgagccagtgtcacatggtccagcatcagagcgtgaattcccagcacaagagtttcacattcttcagtcaagtgttgaaactcggggcataggcatacgaagggagcctgttgaagcggaacaatattcccaacaaatgatggagtgtggtcatggaatatgtatcagtattccttttgcaggtcatcatactgatatatctgagacctcacattcgttcggtagtgttgcggaaacacaacctcatttttcatggcccactatgactccttcacagcagcacgatgcccccatggcaacacctaacacctcatttgctccgcaatggaatgtacccggagcaatacctgatatgggcgacttattaggtgttgatttgcgtcaggagttttctgcagagggtgagcaagcagaagcggggagacaacgcggcgacagaagaaattttaatcgtcaagcacgaagatgggatcaaccatgtggcacatcttcacgacatcacggacaccataatgactga

SEQ ID NO: 61899 - DNA, 135 bp, Glycine max
  Peptide Sequence Number=SeqID_153584
atggcggcgcagctaatccgtgatcgagtagagatggagtgcctagagggagcttgggagaccctcgaaggcaacacgagatgtacctgcacggacgcttcagcgcatggtggagtggacaactccttggattag

SEQ ID NO: 61900 - DNA, 186 bp, Glycine max
  Peptide Sequence Number=SeqID_153585
atggtttacaataatggatttacacgcgattctcctcaaatttcagccagcccgcatcaattagactttgcaccttgcgcttcgaggtcatacaacgctcaatggaatgccccggggctcctccatgataagcacacgttgtgttcgagtcgtatccttagaaaaatggaggtcgaggaaacctag

SEQ ID NO: 61901 - DNA, 47 bp, Glycine max
  Peptide Sequence Number=SeqID_153586
atggaagctcttgagaaattcaaatgctccttaattttcaaacggat

SEQ ID NO: 61902 - DNA, 750 bp, Glycine max
  Peptide Sequence Number=SeqID_153587
atgacggacaaaagaaaagttttaggaaaaaataatgaggaaacaagaagttattttacatggaatttagaaatggaacgtgtattggctgatgtacttagagatcaaaggaatttgggcaacaagggtgatggaggttggaaaaggtcagcattgaatgctgcagccgcaatgttatctacaagcttcaatgttaatgtcacatcagataatgtcaaaaatcgtatcaaattatggagatcgtggtatggtattgtaagtgacatccttggccagagtggatttgattgggatggcactaagcacatgatcacagttgagaatgaaaatgcttggaatgaatattgcactattggatttgactttttctttgttttccaatcgcataaatcggctaaactgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatagggttaggtgctactgccatagatttagaagaaccaagctctaatacaaaaggaaaaagacaatgttcgacttcttctagcacacatcctcacaagaaaaagatgggagaaaaagaaggaatagcagcttctttggataaaatggcgaactctttcaaccgaatggtggaaaaaatggatggtaaagttgatgacgaagatattcaagaa

SEQ ID NO: 61903 - DNA, 297 bp, Glycine max
  Peptide Sequence Number=SeqID_153588
atggaggccaacatggaggccatgaaagagcaaatggccgcaatgatggaggccatgatgagcgtgaagaagataatggaagccaatgcgattgcaattgccgctaccagtgttgttgctaagggaagtacgggcggcccccatgatgtgcaaattcaaaacgagcacgccttcccgccatatggcttgcctctcaactatacaccacccaatgtggcgtacactcccaataagaatgtcaataactccactcctatacccattgagagccagcaaccccaaactgatcatgcacat

SEQ ID NO: 61904 - DNA, 327 bp, Glycine max
  Peptide Sequence Number=SeqID_153589
atggctacactgcccagctctcctccttttcctcctcctactggtgcagcatcgcattcgctgtctaccttgaagcgaacaagaaaggccacacgcctaagatcattggcgactagacagttgggacagagagacccctggtccatgtggatcctgctactaggaaagcggatggctgaatttgatatccatgaagcatctgacgtaaggacaagaaagaaaatacttcagactgtgggggagcagtggagacaatttaagtctaatttgacatccaaatgggcacttacagtcgacaaggacaatgtcaatgacactgtatgctaa

SEQ ID NO: 61905 - DNA, 198 bp, Glycine max
  Peptide Sequence Number=SeqID_153590
atggagaattggcgaacagcgctatgcaataacttcgcgggctccggactcgaaggacacatgagcagcgctagggcaataaattatttgggctccgaaaaaagtggagaatggagaattggcgaacagcgctacgcaataacttcgcggggctccagactcgaaggtggaggacacatgaacagcgctaggcaataa

SEQ ID NO: 61906 - DNA, 255 bp, Glycine max
  Peptide Sequence Number=SeqID_153591
atgaaaaatactaaaaatcacacaagttggcagaaaaatcagtatccaggaaaaaaaaatgaaagggaagtgtgcttgttgttttggctcaaaatttattctataattggtgcctatgttataccattcttagttccgaaatttcaattgaaaattactgtgaaaacaagtgccaaagctagagggaattggaagaaggattggtgccatcccttgaagaatttgagtcaagaagcaaggggccaaccaccttaa

SEQ ID NO: 61907 - DNA, 147 bp, Glycine max
  Peptide Sequence Number=SeqID_153592
gaaaaggagcctgtcacttatactgatgcggtgaaagacagtcggtggagagatgcaatgaaaagtgagatacatgcccttgagaccaatggaacttggacaaccacacaaattgccttcaggaaagaaagcacttgctacaagtag

SEQ ID NO: 61908 - DNA, 195 bp, Glycine max
  Peptide Sequence Number=SeqID_153593
atgaagaaacaacaatggaagagaagcggaagacaaaggaaaataggtgagaggaggcgccatcctgtaaggaataagccatggaagaaggagcttcccccccaagatgagccttggataagaagcttggagaggatgcttcaatggaggaaaagaaagagggagagaaagagagaggggggagcacgaaattga

SEQ ID NO: 61909 - DNA, 443 bp, Glycine max
  Peptide Sequence Number=SeqID_153594
atggccccaaggaagcttgcctcaaagagatccaggaaggacaaagcggctgaaggaaccagttccgctcccgagtatgacaaccatcgttttaggagcgctgagcaccaacagcgttttgaggccattaaaggatggtcattccaccgggagagacgcttccagctcagggacgacgagtataccgacttccaggaagagatagttcgccagcggtgggcatcgctggttacccccatggccaagttcgacccagacatagtcttggaattttatgccaatgcttggcctatacaggagggcgtgcgagatatgcgatcttgggtgaggggtcagtggatcccattcgatgcggatgccctcagccagttcctgggataccctttagtgctggaggagggccaggagtgcgagtatggccagaggaggaaccaggccgatgg

SEQ ID NO: 61910 - DNA, 459 bp, Glycine max
  Peptide Sequence Number=SeqID_153595
atggcgcctaccaggcaccctctagacccggataagtccaatagggccctgggattttccgctttgatcacaggactctgccagtcgttcagagttcccgtcgcacctagcaaggtgattcggccgcccatcacccgggcttttattgagaagtattgcacgcagagacagtcccagggtgatgctccacaggctgcagatgcgccgccacctcaccaggctggcccagctggatcatttgatacggagcagtatttacggcatttggttcgccagcaggtggccaaccaccgggcgcatgtacagacccatgactgtctttaccagttgagacttagcctgcagagccagggttttacttcttttccatgccctactccggatcagttcaaggcagaggtcgcatggcccggagattggcctgaggcccgggcaggagtggcacgtgggatcctctag

SEQ ID NO: 61911 - DNA, 306 bp, Glycine max
  Peptide Sequence Number=SeqID_153596
atgactgcggatgcacgtgatttggctgaggacgttgctgacatgactaaggatgtccctgatctggctgaggagacacctgagatgcgtgcggacatacaaggtgctgatggtgctgaggggtcagatgctgatgatgctgaaggattccctggtgggccacatgacccgtcagtgctgacatcatttgcggaccatgttgcacacgctgtttggagtggacaggaacgtcctaatttgaagttggtgtcacatgggaggaaggtgacattgattgggaggccagtgcttgagattgaaggactg

SEQ ID NO: 61912 - DNA, 321 bp, Glycine max
  Peptide Sequence Number=SeqID_153597
atgaaccaagagttagctcgcctgggcgagcaccctctgcacgaaaaatataaaaaggagggtggggtgaagcttcattcaccccaaaaactccccccaacactcaagaacgaaggaggttgcggaaatcatgaattttctggccctaagtcaccatttcttgcatttttggttccgtttggaattgttgttcactcccaacaaggagttgtaggcaatggccttaggcctaagttgtgttctgaaatgtttgggcatgccatattgcccccattcccttgctattcatgcttaaacatgcgtccaccaagtactcggtga

SEQ ID NO: 61913 - DNA, 378 bp, Glycine max
  Peptide Sequence Number=SeqID_153598
atggttgctcacatcccagatccaagggttgatccttctcaatatcgtgatttagtatattattggtgttctgagaaacgacaggatgaactaaaaaagaaaatgattgaagcagagagttcacaaaatttacaaagcacccaagattctactaattggaaaaatgatatatatttaaaagtcaaaggacatgaaaaaagaggacgtgtgcgttgtcttggcaagcttccacatcaagcaagttcatctcaaagctcttatgcaaacaatagaattcaaaagttggagaatttgcttgaaaaccttgttgttgtccttaaagtgcattttgcagaagatccacaaattaatcaagtcttagaagctatagatcaagag

SEQ ID NO: 61914 - DNA, 95 bp, Glycine max
  Peptide Sequence Number=SeqID_153599
atggagaaattcacaagcaatcactacgcatggctccaaactcgtgggtggagatgcatgaacgaaaacgcaactcatggggctccgaaaacaag

SEQ ID NO: 61915 - DNA, 220 bp, Glycine max
  Peptide Sequence Number=SeqID_153600
agggtacatctacttgagtttgactgagaacaagagagggtacatctcttgtggatcaattctagtggagggtacatccactaggttcaaagagaacaagggaggcctccatgattatatagccgtgtacgattctgggctgcaacgccttgatgctggaggagatctatcttcttctgaaaaatctgcagttaaagaactaaaaggtgggatcctctag

SEQ ID NO: 61916 - DNA, 442 bp, Glycine max
  Peptide Sequence Number=SeqID_153601
atggcagtaatggtggcccgggtgatgttggggaatggttacgagcttggaatgggtttaggcaaggacaacggcggtagaaccagcctggtaaacaccagaggaaaccgcgagaagtttggattaggctataaacccacacaagcggacataaggaaaggtgttgcgggaagaaagagcggaagtcaaggctcgcgattgggacgagaagtcgaagggggcccgccctcccacatcagtaggagctttataagcgcgggtctaggacactggtggttgggtgatcagacggagggtgaagaggacgaagatctgggacttcccccggagttggagaagatagtcgcccatgaggaccaagagatggggcctcatcaagaagaggcaacactagtggacttaggaaccggcagtgggaaaaaggaagtaaagataggcatgg

SEQ ID NO: 61917 - DNA, 426 bp, Glycine max
  Peptide Sequence Number=SeqID_153602
atggggatcgcacccacaaagacacccagtggacctgaagaagtccaacagggccctggggtttccagctctgggatcatgcccacaagacacctagtggacccgaagaaggccaacagggtcttggagttgccagccctaaatacgggtctctgtcagttcaagggagtgcttgtcgcccccagcaaggtcctcaggccctctaccaatcaagctttcatcaagaagtactgcgcccccagacaggcgcagggcgaaacaccacatcagcattgggatggtcggcagcgggaaacagacgcaccgccatcacctctagagttcacctctgctcatccacaaaaaggtttgagtattgcctacacaacatggccgacccataggcgaccaagtccaaagccaaaggacgcacctagttgctcatga

SEQ ID NO: 61918 - DNA, 249 bp, Glycine max
  Peptide Sequence Number=SeqID_153603
atggggctccgaaataaaagcggagaatggagaattgcacttggcaaatcactttcgcgtggctctagactcattggtggaggatgcatgaaacgacaatcaattcatggggctacaaataaaagtggagaatggagaattgcactaggcaatcacttcgtgtggcttcagactcattgtggaggatgcatgcatgacaatcaattcatggggctccgaataaaagcggagaatggagaattgcactag

SEQ ID NO: 61919 - DNA, 587 bp, Glycine max
  Peptide Sequence Number=SeqID_153604
atcatgggttctccacctgcctccactcctcctcctcctcctcctccaccacctcctcctcctcctcctcctcctacttcggacgcatcggcttcgccgtctgtcgtgaagcggacacgcaaagcctcacgtctactatcattggccactagaccacctggtgctgagagaccagtggtgcatgttgatcctgctaccgggaaggtcgacggtggacatcacctacgagaactagaaggaggtgcctactgctcagaaggacctgatttgggaggatattcagaatttgatatcccagagcttctgacagtaggaggaaaaggaaacctcacgaggaaatggacccttgcagccgatcaagacggtgtcgaggacactatctgtgacaaatacgacatcagcaaggaaaagtgggcccaattttgccagactcgcagagacccttcttgggaggatgtgcgcatcaaggcacaggccatccagaagcagaatactgccccccaagttttgtctcgtgggggttatgattatttggagcagaagctcctggctgagaaaatcaagaagaagttgcaggaagctgcaca

SEQ ID NO: 61920 - DNA, 176 bp, Glycine max
  Peptide Sequence Number=SeqID_153605
gattagggaagaaaataagtgttgctttgttgggtggatgtgcaactagaggtgcaatatcagcaaaagatccttttgttgatgcaaatgttgatgacccgggtgttgggtcaaaggaatacgtgcataagcgaattggtaggaaaagcctgacaaccattcagattatgagataa

SEQ ID NO: 61921 - DNA, 366 bp, Glycine max
  Peptide Sequence Number=SeqID_153606
atgaaacccccagatgtccaaaggaagcatcgttgcatatttctgaaggcttttcctcattcattagagggagtggcaaaggactggctgtattaccttgctcaaaggtccatcacgagctgggatgaccttaagagagtattcttagaaaaaattttccctgcttccaggaccacagccatcaggaaggatatctcaggactcagtaatatggagagaagtatgatagatgttgccagtggtggagcccttggagacatgactcctgctgaagccagaaatttaattgagaagatggcttccaactcccaacagtttagcgccagaaatgatgccatagtcattagaggagtgcatgccccttag

SEQ ID NO: 61922 - DNA, 267 bp, Glycine max
  Peptide Sequence Number=SeqID_153607
atgtctcgggcttcatcctcctcagcttttgttttaccagggaacactcaggatgtagagttctgtctcttcttgatgaggccccatttcttggtcctcatgggcgactatcttctccaactccgggggaagtcccacatcttcgtcctcttcactctccgtctgactcgtttcttgcttgaaatcgatggtcgggtcccaggcattagtaccttcgagggattcatcatcggatctggcgttttaagcgtaaaggggatcctctag

SEQ ID NO: 61923 - DNA, 201 bp, Glycine max
  Peptide Sequence Number=SeqID_153608
atgcacccacgaatccaatcaatactactcggaatgatgcatgcccctgactcaactctcagatgcaatgtggtgcgtaccaacaaccaaatcccaggaaatagcctaagcgtgtccacacgacactctcacttaggaaaccaggcagagttcgtcgagaccacccagtcatgcaccgtaactacccctccccttaggtga

SEQ ID NO: 61924 - DNA, 168 bp, Glycine max
  Peptide Sequence Number=SeqID_153609
gtgactacggataagtggatgaatataaccgacataggatatgtcattgcatcaagcaattgtcatccgcaggcgaagctgtggccaaatccatatattagcaaaatgcagcattacaagagctttgtgatgttcaagagagactatgttgacataaatgatgattga

SEQ ID NO: 61925 - DNA, 297 bp, Glycine max
  Peptide Sequence Number=SeqID_153610
atgggggtgcaaatagcacccaggcccattttggcccccccagaagatttcctccagaagggcggttgcttctggaggaagcaaccctgctcgcctaggcgagctaagctcgccctgggcgagctgggcggcaaccacctcccctattttgctataaataggggaggaaatgaagaaggaagggccgaggcgcttccgaaacgtttccgtaacgttttccgtgaggaatctcgcaaaagtttgaaccgttcttcgacgttcttcattcgttcttcatcgttcttcgatcttcaacgg

SEQ ID NO: 61926 - DNA, 300 bp, Glycine max
  Peptide Sequence Number=SeqID_153611
atggcgccgaccaggcaccctttggacccagataagtccaacagggccctgggattttccgcgctgatcacaggactctgccagtcgtttggagtccccgttgcacctaccaaggtgattcggccgcccatcacccgggcttttattgagaagtactgcacccaaagacaggctcagggggatgctccgcaggccgcagatgcaccgccacctcatcaggctggcctagctggatcgtttgatacggagcagtatttgcggcatttggttcgccagcaggtggccaaccaccgggcacat

SEQ ID NO: 61927 - DNA, 537 bp, Glycine max
  Peptide Sequence Number=SeqID_153612
atgataaggggaggtaccttacggttatccgccccccctttgccattcagacacagtcgtgttcgatggcaagcagagaccaagtttggtcattctgcacacatgatacgcggagataccttacgagaccaagtttggtcattctgcacacatgatacgcggagataccttacggttatccgcccccctttgccattcagacacagtcgtgtccgttggcaagcagagaccaagtttggtcattctgcacacatgatacgcggagataccttatggttatccgccccttttgccatccagaggccggcgggcccgatgacaagcagagaccaagtttggtcattctgcacccatgatacgcggagataccttatggttattccccccttttgctatcagacagaacgcttgataggcaatgcaggggctggcacaggtcttctgcacctttttttcctctgggaacaacaagtcatttgcatgtggagtttttatggtcacccgcgactctcgtcaaatcgagagggacgaaattag

SEQ ID NO: 61928 - DNA, 210 bp, Glycine max
  Peptide Sequence Number=SeqID_153613
atgaccgatcgagatattgatgaggacatgaccaagagcaagggcaaggatccacttgaaggacttggaggacctatgacaagggctagagcaaggaaagccaaggacgctcttcaacaagtgttgtccatactatttgaatacaagcccaagtttcaaggagaaaagtccaaggttgtgagttgtatcatggcccaaatggaggactaa

SEQ ID NO: 61929 - DNA, 292 bp, Glycine max
  Peptide Sequence Number=SeqID_153614
acgatgagccagtggtctctacgacagaggttgttggagcttcggttgaggctgccgtatatgcggatgagtcgatggcaggaggtgatgtacatgacattggggcagacactcctgcagacacaggcgcacaggctgctgaggatgagcctaagggatttccgggtggtccgagggacccatctgtgctaaccaagtatgcgaatcacgttgcaggcagtgtatggatgggagaggagcttcctgagttaaagctaacctctcacgggaggaaggtgcatagtttaggcag

SEQ ID NO: 61930 - DNA, 99 bp, Glycine max
  Peptide Sequence Number=SeqID_153615
atgtccaaccttggctccaaagaggactccttcccaagtaaaaaatacaccactggggcacaggtggctacgacgtggaaaccaatatatcgacaatga

SEQ ID NO: 61931 - DNA, 144 bp, Glycine max
  Peptide Sequence Number=SeqID_153616
atgtatcaatctcacacaggattttggctcaaggcttgtagaacggctggtcatgatacatgtcaggatttggccagcggttcagggataaacgggatgtccccacattattcccatgatacacatgcaacaaatgatgattag

SEQ ID NO: 61932 - DNA, 284 bp, Glycine max
  Peptide Sequence Number=SeqID_153617
atgaaacatccatctgaggatcattctatttttcgtgttgagatacttgatcagattgttgatgattatatgtttgattttgattatcttcatggtgttgtacctcttgatgttaattttttagagtcagaatgcactaaccatgttgcaggaagtacatatacttctgacttgctttatgaggtacaggctgaggaacctttctcttcttgtcctaccctagttcctcccactgttcagccaccacccacaccagagttgaagcccttaccagcaaacctcaa

SEQ ID NO: 61933 - DNA, 498 bp, Glycine max
  misc_feature (131)..(131): n is a, c, g, or t
  Peptide Sequence Number=SeqID_153618
atggcagtgctatttgcaactcatgttcttctcttgatattgtccactgcaacaactctccacttcagtgcaagcaaggcagcaaagctcaatatgacttgcagtgagaaggaaaggaatgcactcctcancttcaagcatggactagcagacccatcaaacaggctttcatcatggtctgacaaatcggattgctgtacatggccaggggttcactgcaacaacactggtcaagtcatggaaatcaatcttgacacacctgaaacctctcaaacctgcaagcaccttaatcttggatacaattatgctcttcagatagataaccttaattggatatcaaggctatcttccttagagtaccttgatttgagtggttcagaccttcataaacaagggacaaattccacaaataatatcaagccttcagaacataaaaaatctagacctgcagaacaaccagctcagtgggccacttccagattcattaggccagcttaa

SEQ ID NO: 61934 - DNA, 156 bp, Glycine max
  Peptide Sequence Number=SeqID_153619
atggaccctaagagaataaaggtcattcctgagtggcttactccaccaagtgttaaggaaagaattcatgagtttcaagaacctctagatttgaggtcaaatccttttcaagggggagggaatgatgtaatcctaccccccaagggcattggatag

SEQ ID NO: 61935 - DNA, 357 bp, Glycine max
  Peptide Sequence Number=SeqID_153620
atgcctttacaaactaggcccgtaacacaaaggcggccacgcgaggcccgttacaatgggccagatcacacgtgggcctcagagcaggacgaggccgtgctgcggggagacgtcaccgcaggccttcgtctggtgctgaatgaagcgaagggtgtccctacccattttgtcttcgtcaaaccagcgactgcagcgaaaggcgccgagcgaagggtggcgtctttgccttcgccccaacatggtgataaaccagcttttaggaaggctgcagcagtgccccgagaagctacccaggcacagaagtcaccatgcccagctataacttcgtcgagctcgtcaatttcaccctcaatatga

SEQ ID NO: 61936 - DNA, 372 bp, Glycine max
  Peptide Sequence Number=SeqID_153621
atggctgatagatggatgcagttcagtgactatgttgcacttgtggggcaaatatctgtaccagaggatcctcctagagttctgccagttcagcaatatgacacatttgttgaaccagatgtgcctcagcaaccaaaggcgacaacgacacatgatgaaccagacattgatgtgcatcttcctcgacatgcagtggatggttatgaagcaattgctactaaattggaaaggctactgaacctgaggatcttaaccgaaggaacaaaagcttatactgttgctgaagaatgtctaagcatcgctagaagctacattggccaaccaactatcggccacagatcgaggcgtaggcggtgtatgaatgaccattga

SEQ ID NO: 61937 - DNA, 85 bp, Glycine max
  Peptide Sequence Number=SeqID_153622
aactagtggatcccccgggctgcaggaattcgatgttgtcattctgaatgctgttgctaatacatgcattgttggagttcaattg

SEQ ID NO: 61938 - DNA, 132 bp, Glycine max
  Peptide Sequence Number=SeqID_153623
atgtataggtttaggataggtagcaagatacctttggcaacttacactttgggtgtggtagcgaaatacttggatgtattagaaataccagaatgtgcacgtatgcaatttttggtagccaaagtgctttga

SEQ ID NO: 61939 - DNA, 342 bp, Glycine max
  Peptide Sequence Number=SeqID_153624
atgggtggtggtgcatggccgttcttagttggtggagcgatttgtctggttaattccgttaacgaacgagacctcagcctgctaaatagctatgtggagggtaaaactaacctgtctcacgatggtctaaacccagctcacgttccctattggtgggtgaacaatccaacacttggtgaattctgcttcacaatgataggaagagccgacatcgaaggatcaaaaagcaatgtcgctatgaacgcttggctgccacaagccagttatccctgtggtaacttttctgacacctctagcttcaaattccgaaggactaaaggattgataggccacgctttcacg

SEQ ID NO: 61940 - DNA, 516 bp, Glycine max
  Peptide Sequence Number=SeqID_153625
atgatgcccccaacgacgaagacttactgcatctgcccacaggcagtgacagtaggagcgtctgctgcagaggaattgcatgaagaacaacaagaagcacctattgaggatcctcctattgatgaacgtcctaagttgaagctatctttccatggaaggaagatggctaagttcgagaggtctgctccagagattgaaggccttgtggcttccagtggacaaagtcctttgatcgcctgttccctagatacgggcgatcggagactaatggacgaaacttttgatatgttgctggaattactcgaggtcagcgctacagaggagagagctgagacgattcagtttcatggctcttatgttcgactatcatggctgcaagatgtgtatgagacgaagatcgaggcatgtcactggattatagcatctgggcgttacgctgggggtgctgttgcacttgtatacatgtatgataattttaatgatgcatcgaagagcacggagaggcaacttgcatga

SEQ ID NO: 61941 - DNA, 141 bp, Glycine max
  Peptide Sequence Number=SeqID_153626
ggaggtgatgaaatcctcccaaggaggagacctatcaccagagccatggctaggagactccaagaagactgggccagagatgtaagagaaggccctagggttctcatgagcattaagctagattttgggtccatggactaa

SEQ ID NO: 61942 - DNA, 198 bp, Glycine max
  Peptide Sequence Number=SeqID_153627
atgaaaacatcagccaggagcaagagattattgaaggcaaacttcaggacggacaacgaaactgaaggcctgaaggcgagaccagtgcaccatcaacatcatcgaaagaactctctggcatgccagcatcagattttgctcaagctttatgcgcacagacatctagctatgataacgagatgcacagtcaccgactag

SEQ ID NO: 61943 - DNA, 174 bp, Glycine max
  Peptide Sequence Number=SeqID_153628
atgaagaaacaacaatggaagagaagatgcatcggaagacaaaggagaagaggtgagaggaggcgccatccactagggaataagccatggaagaaggagcttcaccaccaagatgagccttggataagaagcttggaaggatgcttcaatgaaggaaaagaaagagggagataa

SEQ ID NO: 61944 - DNA, 114 bp, Glycine max
  Peptide Sequence Number=SeqID_153629
atggagaaaaatgaagaaacaacaatggaagagaagctcttgtgctctgattaccacttgatggatgcttgcttgtggagcttctatggaggctggatctttgagcttcaatga

SEQ ID NO: 61945 - DNA, 348 bp, Glycine max
  Peptide Sequence Number=SeqID_153630
atggtaggactcctcgcagctagcttagcttttgcacccttggggctgaccgggagagcgcgtcgtggtcagaatgagcgcgttcctccactgccgccaccgcctcccactctgcaggagctaatggctcagcagaatgagatcttgaggcagctagcccagcgccagccaccacctcagcactatggtggtggagaccatcaacgtcaccccgcggcagctacctaccaggagttcctcagtacccagcctccattgttcaccagggcagaggacccacttgatgcagatgtatggttgagagtagtggaatccaaattcccgctactccatggagtttgctcagag

SEQ ID NO: 61946 - DNA, 522 bp, Glycine max
  Peptide Sequence Number=SeqID_153631
atgcctttgtggtgggaattttattcctgggtcaaggaagttagagctctgcacagcaatcctatggagaactttcttcagcattgctccttggctgcctcgaggaactccaatagaaggaggaaggtctggtggatagcagctacaagatccatttggaacctcagaaatgacatgatttttaataatcagcctttcgtcatttccaaattggtggataactcgatatttctcacttggtcatggctgcgggggtgggaaaaggacttcaatgagatactgtatcatatcttccttgtagtacctctgtttattcagcatatttgtgttgcttctgcaaggttgcagggaaaaagatggcaatggtggtggtttgctcttacttactcgatttggaagcataggaacaacattattttctccaatacgacattattttccctacgctgtatcaaatctctaaccaataacagcaacctatcatcctcttgggaagtcataaggaggaatggtgggaattga

SEQ ID NO: 61947 - DNA, 237 bp, Glycine max
  Peptide Sequence Number=SeqID_153632
atgcaacaagtttggtgtggtgatgccaagcccatcaaaacagcccgacttgtggaaccaatgggcatctcgacctcacaagtcgagagattcctcaacggaccaatcaaggaagaggtctatgttgagcaacctcccgggccatttaagatagtgagatatcttacgtattataaactcctaaggcgcatttataggggatcaagcaagccccaagagcatggtatgaatgcctaa

SEQ ID NO: 61948 - DNA, 243 bp, Glycine max
  Peptide Sequence Number=SeqID_153633
atgattattgaagaatctatccatgttgcctttgatgagactaaccctataaggccaagaaaggaaactcttgatgatattacagattctttagaagacatgcatattcatgaggaaaagcacaaaggcaaaggaaatggaaatgatgaagactttcaaattgagaaactaaaacaagtatatggtttaccaagagagtggatgaacttcaagatttaccatcctcttgaaaatcatcagaaa

SEQ ID NO: 61949 - DNA, 216 bp, Glycine max
  Peptide Sequence Number=SeqID_153634
atgatgacaacaaaagatgatgacaaaaagctcaagagaatcaaagaacatccatctcaagtgaaatcaaagaacatcccatctcaagagaatcaagaacaagtcaagagtttcaagaatcaagaagaattcaagactcaagaagaaagcctacaaatcaagaatcaagattcaagattcaagatcttaagaatcaagatcaagattcaagaatga

SEQ ID NO: 61950 - DNA, 408 bp, Glycine max
  Peptide Sequence Number=SeqID_153635
atggggagagttaacttagagtcaaatgtgagaatgatagtgttgtgggtggaaaagattgagattttgagggttagaaaagtcaaatttggggttagtggaaattggagtctaaagacttgtaggaaagcttgggcggagcaaatgagaaaaatgagtgacaaatgtgaaaggaaagagccatttctaggacagggtttaggacttgtaggatccaatttgagcgaaattggatacaagcaagctagaattcgaaatctgccaaattatgcagcaaaaactgtcaaattgtgcagcagattttaccaattatgcagaaaaaatggttgtgcagcgctagtcacaggaaaacttagaggggttgatggggacccggtgctgaaaggaacgaggataagggctacgtag

SEQ ID NO: 61951 - DNA, 141 bp, Glycine max
  Peptide Sequence Number=SeqID_153636
atgaacaaatgcctaggatcttcttcatcaatggattcctttgcttcttggaagatgaatggtagcggaatggagaaggaagggatagaggagatgccacttcaaggagaagatgtgtctagaagatgcttatcaccatag

SEQ ID NO: 61952 - DNA, 471 bp, Glycine max
  Peptide Sequence Number=SeqID_153637
atgtgcagtcctctgaaggtgaggacgtgcagccctctaaaggcgaggacatgtagccctttcaaggcgaggacttgtagtcctctaaaggcgaaggcctatagccctctcgaggcgaggacgtgtagtcttcagaaggcgaggacgtctagccctctaaagacgaggacatgtagtcctctgaaggcgagggcatgtagccctcttaggccaggacatgcaaggacgtgtagtcctctaaaggcgaggacgtgtaatcatctaaaggcgaggacgtgtagtcctctgaaggcgaggatgtctagccctcttaaggttaggacgtgtagcccatggaaggtgaggatgtgttgtcttctgaaggctagggcgtgtagccctctgtcataccctaatttcgtccggggacctttgctcgatgacgtgcgaccattctttggtcctcgtgaggtgcttggcacccatcattag

SEQ ID NO: 61953 - DNA, 351 bp, Glycine max
  Peptide Sequence Number=SeqID_153638
atgatgataacaaaagatgatgacaaaggtgatgacaaaaagctcaaagatcaatcaaagaacaactcaaggtacatcctttgtgatacaagtagagggtacatctacttgggtttgactgagaacaagagagggtacatctcttgtggatcagttctagtggagggtacatccactaggttcaaagaaaacaagggaggacctactctgatgaaaggagtgactttctgtagaagtgcttgtcatgctaacctatcaacatggactctctacatgaagaaggaacacacatttaatgcaatcattaattgcctcaatgacctgaattcatcagacgaagaacttgagtga

SEQ ID NO: 61954 - DNA, 465 bp, Glycine max
  Peptide Sequence Number=SeqID_153639
atggtcattcaagttaattgcccacttttgtccaccacgttgcgttataggattgaaggtctcctctacttcaaaccttgtcgagtgaatatcatagacgcggacgatgtgcaaacaagtttgttcttgatttttttgaagttctttaacaaccttagaacaaaatgtagtagcaaagaatttgactttgatgttttgatgatgccatatgatcgtgatgatttgatgccttatgaaaatgtgcttctcaagtttaattcaagacaaaaattcaagaatacaagatacaacatcaagaagatctatagtgttttaggaagggaattccaaattgaaattgcaaaaggtttggccaagaaatttaagcaaaaatgtctttttcaagagatttactctctgtggaactctcaagcgggttgcttggggactggacgtaggcacaagggtgtggccgaaccagtataa

SEQ ID NO: 61955 - DNA, 150 bp, Glycine max
  Peptide Sequence Number=SeqID_153640
atggagagaagccataacttcaagaatgggaagagatcccaagaagtttctcctacacttaaatgctataagtgtaatcaacccgagaaggagatcaaccttctatccaaggactatgaaagcgatgagaacatcactcaagaagattaa

SEQ ID NO: 61956 - DNA, 1221 bp, Glycine max
  Peptide Sequence Number=SeqID_153641
cttgtccccacacttgaagagtactcctacctagttggcttacctgtgccagacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagctagtacacttgccttccattctgtcctagccctccttatatatggccttttactcttcccaaatattgacaacttcatcgatatcaatgccattaaaatcctccttacaaagaaccccgtacccactctactcgccgatacctaccactctatccatgaccgtacccaggctggccgtggaaccatttcttgttgtgcacctttactctatctgtggtttacctcccacttacctcaatcccgtgccttcaagaccaatgatgacaaactttcttggcctcaccgaatcatgactcttgacccatctgacatcgtttggtaccaagcagctagtgacgttggagagattattgtgagttgtggtgaatatcccaacgtacctcttttgggtatgcgtggcggaattagctacaacccacttctcgctcgacgacaatttgggtacccgataaagacaaaaccaaacaaccttgccttgactaatgaattctatcttaaccatggagatcactcgaacaaaaaggaaagattcgcacaagcttggagcgccatccgtagactcagcagaagtcagttggggaagaaatcagaccatgtgcatgaatcttacacccagtgggttattgataggaccaagagctttggcctaccctaccacttaccaagatacctatcgtccaccatcccaccatcatccttgcctatcccctttgacactaaggaagagtttcatgaacaattaaccaaagaaaggcaagaaaaagaaacttggaagaggagatgccaggagctcgagcgagagaatgagactttgaaggggaagatagcccaacagagccgtgagctttttatccagaaccagaggatgattgagaaggacgacttgcttcgtcggaaagacgctttgctccaccaagatgctagaaggaagaggaggtttatggatttgttctcccgtacacattcagattccgaggacccatctactccgggagtttga

SEQ ID NO: 61957 - DNA, 477 bp, Glycine max
  Peptide Sequence Number=SeqID_153642
atgaggatgttaataactccactcctatgctcattgagagccgacaacctcatcatatacatgtctctcaacccatgggggagacacatgaaataccccaccagagagctagccgacttcgagccttgcctcggatatgccactgaagggcaagcggttggtggtatacccctgcaaaacactttggagggccctcagtatcacccgcaaccacaccccttgcattccacaccgggtaaaaatcctcatgctatggcagaaatgggagagttggatcatctagaggaaaggctcagggccattaaaggaggtgaagattatgcatttgctaacctagaagagttgttcctagtacccaatatcatcacccctcccaagttcaaggtgctggactttgacaagtacaaaggggactacttgccccaagaaccatctaaagatgtattcttggaagatgagggcatacgcaaaagatga

SEQ ID NO: 61958 - DNA, 240 bp, Glycine max
  Peptide Sequence Number=SeqID_153643
atgatgataacaaaagatgatgacaaaggtgatgacaaaaagctcaaagatcaatcaaagaacaactcaaataagaatcaagaagaattcaagactcaagaagaaagtttagagtcaagaatcaagattcaaggttcaacatctcaagaatcaagatcaagattcaagactcaagattcaagaatcaagagaaggcttaatcaagataagtatgaaaattttttctcaaaaattgagtag

SEQ ID NO: 61959 - DNA, 678 bp, Glycine max
  Peptide Sequence Number=SeqID_153644
atggtcattgatcagtcattgttcttttctttaactaatttacccagtcaaggtgcaccttttgagggcaccattgttgatgactggaaatttaattattcgagtcatgatgctcgtcgtatggtctacaatgatcaagctgaaatgaccggtagattgctggccgggtcattaacatttgataatcgcatcatgcactatataattgttagaattttgcttcctcagtcttcaaatttagcacaagcctctgaggaggatttgattcttatgtgggcttttcttaccggtcgtcagatcgactgggcccattttgttcggtaccgaatgcataaggcattacgggccaatgcacctctcccttatccacatttgattactctgtttctgctgacttcctttgggtaccgtaaagatcggaatggtcaatggctgaagaaggatgcactccctcctcaagatgaacgtactccttcacctcctcctcagcgcgatgattcagcactcatgaatgaagtcctctccgaattacggggtcttcgttcttatgttggtgaccatttcgactcattagatacacgctttgccgacatgggcattcgcctcacacagcttgaagaggatgtaggttacattcgtcagagtttcgatcttccaccaccacctccaccttcttag

SEQ ID NO: 61960 - DNA, 435 bp, Glycine max
  Peptide Sequence Number=SeqID_153645
atgcgctcatgggtgaggggtcattggatcccctttgatgcagatgccatcagccaattcttgggtgacccgctgattttggaggaggaccagcagtgtcaattcagccaaaggaggagccaggcagacgatttcgatgaggaagccatcgcccagctgctgtgcataccggggcaggatttcgcccggaccgctgcagggaggcaggtgcggatcatgcgtaccaacatgactaccctgacccagatatggatgatactgctgcttagcaatgccttgcctagcgaccacaactccgacctccctctgcctaagtgccagttggtgtatgccatcctgatacggatgagcgttcatgtggcccaggaatggcgcctactaggcatgctttggacccagagaagtccaatagggccctggggtttctggctctga

SEQ ID NO: 61961 - DNA, 240 bp, Glycine max
  Peptide Sequence Number=SeqID_153646
atgggaaaggaaagaatcaaaagaattctcagactatgccgttttgaattctttgacaagggagaagggagacacaaaagaattcaggcggttagtcctttgttcttttggaaaagggagaagagagacacaaaaagaattcaggcgctaaaggcccaagtggagaaggacgaaggcccaagtggagaaggacaaagcccccgagtggagaaggatgaaggcccaagtggagaaggatga

SEQ ID NO: 61962 - DNA, 366 bp, Glycine max
  Peptide Sequence Number=SeqID_153647
atgtaccctctcttgttctcagtcaacaacccaagtagatgtaccctctacttgtaccacaaaggatgtaccctccaatgtgttaagacaaagatcttaggcggggagaagggagacacaaaagaattcaggcggttagtcctttgttcttttggaaaagggagaagagagacacaaaaagaattcaagcggttagtccttggcgaattctttttggcagagggagaagagaatgaaaagatgaatagcacaagttttcatggtttagaaaaccagaaaactttggaaagcttttggtacaaagaagaagaagaagttcaaagagattcaaggcttgtaaaggattgtatgaaatgttcaagatga

SEQ ID NO: 61963 - DNA, 339 bp, Glycine max
  Peptide Sequence Number=SeqID_153648
agaattcaagggactaatcgcctaagaattctttgtcttaacacattggagggtacatcctttgtggcacaagtagagggtacatctacttgggttgttatactgagaacaagagagggtacatctcttgtggatcagttcaagaggagggtacatccacttggttgttcaaagagaacaagagagggtacatcccttgtggatctttggcttgtaaaggattttacaaggttgaaagaaatctcaagaaccattggttgtttggggactagatgtaggcacgaattccggccgaaccagtataaatcttgtgtttgtcttcttccctacactctttaa

SEQ ID NO: 61964 - DNA, 582 bp, Glycine max
  Peptide Sequence Number=SeqID_153649
atgtctcagcatatcagtgttacagttgtggattctatataccaccggcatctgactaatacaagtatgcgagtggggaattctcatatctatggattcctcgagccacagtccattcagaggtctgggcaatcacaatttgagtctgaaagttatataaagacttggatgcaaagttcaaagcgcgatgtctatcttggagcctacctaaatggcggacactggcagatggtggtcatcctgcccaaggaacacctaattgtctggttttgttcattgcataacaggccagacaactaccttaaggggattattaacagtgctttaaaaggtcttgatgatgctccacattctaaatcaaaggctcctgctaggtggattgtcgtcaagtgtaatagacaaaaaggaagtactgagtgcggctactatgtcatgcactggatgtccaccataattttaggaacttttaggaatatctgggaagcgtattttaacgatcctagaccattggagctagagagattcaaggcgttgcggatccagtggacacactattatctccgagttagagatcagacttag

SEQ ID NO: 61965 - DNA, 645 bp, Glycine max
  Peptide Sequence Number=SeqID_153650
atgacggagaggtacgcctggggagtgactgctttggtacatatgtacgaccagctgaacgatgcatctatgagccacaaccgacagcttgacggttacatcacactactgtggattgcgacgaagaagaccgtgaaaagcattcatacaccggcgtatagggagcgcctggaccgacttcgaattccggatgtctgttggatcccatatggggagcatcgatcggtccgagacttccacgtcagatcatgctatttcggtctcttgcgctgggggcctgttgctgtttattaccgaccagagagggtcatgcggcagtttggatacacgcataccattcctgctcctcctgtcgattcatgggtgtcgtatgatgatatacacgacaggtggatgcactactcggatcatatcgttccagcaggtgaggtgtgcattgtgtcaggtcagtgttctagtgactacatgtactggttcttccgcatctcgcatcctttcatgacactaggccacacattagatcctctacctcatggtcatgcccctcagccccgagtcgtccctcaggtctcgcagacgaatatccctcacgtgccggagccaggagcatcgtcgacatctgcggaggagcctagacatgcagtg

SEQ ID NO: 61966 - DNA, 558 bp, Glycine max
  Peptide Sequence Number=SeqID_153651
atgtataggctttcagaattgggcattgagatgcgctcagttttcacacgtcgttcccagtggagttcacagccttcaggttctgctcagttatcatcaagggagacattcatttccaagtcagaggcaaagaccatttctgagataaacaacctttgtgaagagtttgtttgtgttactgttggtacaatcatgagggttgttatggacaatcattcatggtgttatgcagcttgcattcagtgccataagaaaacagatgtctatacagaaccgtttgtgtgcccatgtggcaaacataatgatctagctgtgcttagatatagagttgaagtgatgatcaattataaagatgacagcacaaaatttctcctgtgggatcgtgaatgcactgaattgattgggcagtcagctgatgaagtcaataccctcaaaatagaagatggtgatctagatttaaatgcctccccaaaagcacttgataaactactgggtcatctactcgcccttcaaagtcaaaaatccagccgcagtataaaaaaattctgctgtttttga

SEQ ID NO: 61967 - DNA, 345 bp, Glycine max
  Peptide Sequence Number=SeqID_153652
atgtgtctatcggggaaggagagcatgctgatgaaattttctcataaccgaagcactgggtccaacaaagataggagaaaatcactcaaagtgtatcaatctcacacagtgcgtggcgagaaagtcgctagcgcacaggattttgtcagcaatcaaagggagaggaccactttaggtcgtgggaaaggattgacattctcaccctgggtcaaggtttatgataagttgggattttggctcaaggcttatagaacggctggtcatgatatatgtcagggtttggccagcggttcggggataaaggggatgtcctacattatttccatgatacacatgcaacaatga

SEQ ID NO: 61968 - DNA, 243 bp, Glycine max
  Peptide Sequence Number=SeqID_153653
atgcaatggagggagaagagggtaaggattcatgacaacgatagcaaggttttaagagtggttgcgaggaggtggtggcgtcgcattttcattgtggtgttgtcgtcatcatggacccttagaactctcatagccccaagtaggggtggattagcgggtcggttcatcccacgtaaggccctctcgcgtaagctcgcattagcagcggacaaggctgacccggtaggatatgccatcacatag

SEQ ID NO: 61969 - DNA, 1014 bp, Glycine max
  Peptide Sequence Number=SeqID_153654
atggtcaattccatgagctttctcctgcttctttctttactagcctttgctcccttgtgcctctgtaacctcaaccctcagttttatgacaattcatgccctcaagctcagcaaattgccaagtccattcttacctcgtattttgtaattcaacccggatatgcggctcaaattctcaggcttcatttccatgattgttttgtcatggtctctccctatgacttgccaacagaattagtgggatgtgatggttcattgttgttagatagcagtgaaagcatcgtcagtgagaaggaatcagatcccaaccgtgattcagctagaggatttatagtcattgatgcaattaaactggcgatagagagagcatgcccttctacagtgtcttgtgctgacatcttgactatagctgcaagagattcagttgttcttactggtggaccaagctgggaagtacccttaggcagaagggactctcgagatgcaagcataagtggctccaacaacaacattccagccccaaatagcatatttccgaccctccaaacaaaattcgagcaacaggggcttaaccttactgatctagttactctatcgggggcccatactctaggagtcgccaggtgcaccaacttcaggcaaagactctacaaccaaagtggaaatggccagccagatcccactcttgaccaaaactatgctgcttttttgcgtgttacgtgtccaaggacgactttgggtgaccagaatccgttcttcctagactacgccacaccacttaaatttgacaacagctacttcaagaacctgatggaaaacaagggtctcttaaattctgatcaaattctcttcacaatgaaccaagaatcagctgagttagtgaggttgtatgctgaaagaaacgaccttttctttgaacaattctccaagtccatgatcaagatgggaaacatttctcctttgacgaattcaagtggagagatcagacagaactgccggagggttaacgcttga

SEQ ID NO: 61970 - DNA, 268 bp, Glycine max
  Peptide Sequence Number=SeqID_153655
tgattttgtcctcaaaggcagaagtggtggtcttgggaagaagcctagtgctgactattggaggaaattaaaatacagtgaatggacaccattgattggcgtgatggggtcctttgtaacgttgaagcagccccacatggaacacgggatagattctggcagtggccggaagttccaattcataagccacgaccccaatgtgtttgagaatgtgataaggcccacaaaagtggccgtgaagtttggaatcactctgattgcaagctga

SEQ ID NO: 61971 - DNA, 123 bp, Glycine max
  Peptide Sequence Number=SeqID_153656
atgaatttggtccctgagctcattccctttcgaattcggtctgatacaccatctagagaaagaaagagaaagcttggaagaaccaaaaacaagaaactcttcatggcaatggctggaggttaa

SEQ ID NO: 61972 - DNA, 618 bp, Glycine max
  Peptide Sequence Number=SeqID_153657
gtttgcgagaatgctttggcattaggtgtttttgagaaggatccaaagatcatgcgaggtcctggtgtgagacaccagggaggccacttcattagagagagtggtgaggagagcaccatatataaggcggtcctgaaaagatccatctggatattggaggagatcatagccatcaaggagagcttcaacttgttgtttccaattaggataattgttgggaagaagtttggtgacattggtgaaagtgatgcaagcaaggggtttggatggctcatgggggtttggaatgaaggagttgttgtcggccatgggaggcaagggtggggaacgacgtccttaattgaagaaatagggaatggggaagagggggtaaaggaggacaatggtgtgtggtgcaacggtggtgtgtggcaaagtaatgatgttttgaagttggtgcaatggtgggtgataacgttacaagaggatgttgaagggcgggacgtaacagggtgggaagcaggattaacagatgcagaatttaaaatgggaggtgcggtattcaaatgcccatttgcggaagaggaggcccaagtcttggtaaagatacctgtggtggaagaagcaaaagtgatatag

SEQ ID NO: 61973 - DNA, 213 bp, Glycine max
  Peptide Sequence Number=SeqID_153658
atggcgccaccaccattggcgctttcattagggatgtgccacgtgttgctcatggagccagtcaaacgcaaggccctagggttgcagtgttgcagagtgcagcaggtcagggttgcagcgatgcaggggcagcaggtcaggggtgagggacgcgtcattgggtattgcgagtttcataaaggaggcgccattccctccagcaatttgctttaa

SEQ ID NO: 61974 - DNA, 147 bp, Glycine max
  Peptide Sequence Number=SeqID_153659
atgaccaccaccgccgcaagaaccaccattgagggtctaagtttacggtgtatcacaaccgtgcatctaggtggggaagtggtagaactgatcattagtaaggggcgagggggagctaagaataaagtcgtagctaggttactatga

SEQ ID NO: 61975 - DNA, 2358 bp, Glycine max
  Peptide Sequence Number=SeqID_153660
atggaagtagcaaaggtactgcacatgaacggtggcgttggagacgcaagctatgcaaacaactcctttgttcagcccttaagagaagaagccataaaaagcctctattgcggcacactccccagaaggttggcaatggcagatttgggttgctcttctgggcaacatgctttaattgtcgtgtcagacttcatcaaaactgtggagaagctttgcctagaattgaaccataaatctccggaatacaaggttttttttaacgatcttcctgggaatgacttcaacaacatatttaagtcccttgacagcttcaaacagaagttgtgtgaagaaatggaaagtgggattggtccatgctacttctttggtgctccaggttctttctatggcaggattttctcaaaccaaagtgtgcattttatccattcctcttatagccttcaatggctatctaaggttcccgagtgtatagacaacaataagagcaatatttacctaggcagaacaagcccatcaaatgttgtgagagcttactatgagcaatatcaaagagatttctctctttttctcaagtgtcgtgcagaggaactagttgaaggaggtcgaatgattttgacaattatgggaagaagaagtgatgatccatctagcaaagatggttgctacatttgggaaattatggctacggctcttaatgatatggtattgcagggaataataaaggaagagcaattggatacttttaacatccctttctacactccatccccatctgaagtgaaattggaagttcttaaagaaggttcatttgccattaattgtttagaggtgtctgtagtgcactggagcgcttgggatgaatggagtgttcttgactttgaatctgaaagcggatacaatttgacacagagcatgagggctgtggcagaatctatgctggttagccactttggtgaagctatcattgatgagcttttcagccgttaccaagaaatcttggctgatcgtatgtccaaggagaaaactaagttcatcaataaaagttcggagtgtcttggtggtgttatcggtgttggggggagtggagggacgtcactcttgtcgtctcccttcgcctctctcccaattggggttggtggcagggcgatggagaatttggttagagaggggtttatacagggtgtttttgacatttcaacaacagaggtagcagattacatagttggaggtgtaatggcttgtgaaagttctcgttttgatgccgtcatagagaataaagtccccttagtcttgagtgtgggagcattagacatgccgtatcctcatcatattaatgaccttgaatttgcaaatgcattggttgatgcatttttagagattaatgagaaaactagtaaagattctactcagcaacaagtagctagtcctgaatctgttgaacaatttcacgaggataatgtttcaaatgcgtcaagcattgcaacaattgtctatacacctagtgaattcccagaagcaaggagaggagctggtgcttggactggtatatctgctaagtttgaagaagctggaggagttgatctaatagtattgtacaattcagggcgcttccgaatggctggaagaggttcattagctggattattacctttttccgatgctaatgctgtcgttcttgacatggccaatgaagttttgccagatgttcagggtaaaggtccaatggctaaagcagaaagcaatttgggtctgggtcatcatcacaacttactggtagtaaagaaggttccagttcttgctggtgtatgtgcaactggtctcttccgtagaatggattatttccttaaacaggtggagtctactggattctctgggttacaaaattttcctacagttggattatttgatggaaattttagactaaatcttgaagaaacgggaatgggatatagcttggaagttgagatgatccagaaagcccataaaatgggtctctttacaaccccatatgctttcaatcaatatgaagctattgaaatggctaaagttggcgccgatattatagtggcccatatgggtctaactacaacaggctccataggtgcaaaaacatctgtttcacttaaagaaagtgtagttcatgtacaagctattgcagatgcagcacataggatcaatcctggtgtcatcgtgttgtgccatggaggtccaatatctggtccaaaagaggcagcatttgtattgaagagaaccaaaggagttcatgggttttatggggcttcaagtatggaaagacttccagtggagcaggctattacaaatacagtcaaacagtacaagtcaatttctattcattaa

SEQ ID NO: 61976 - DNA, 279 bp, Glycine max
  Peptide Sequence Number=SeqID_153661
atggtattggagcttctagtttccagcactctcgaacttccccccaaatcggacaaatcgctggagttgtcatttcgggtggagaacttgaacgcgccagagctgcttagctcgtcgacgttgctctgtgaagctcagtgctcaaacgcgatcacggaggtgggagagactgttgtttcggacgctagcttggaaaccctagcttcgggagtgatacacgctttaaggtttggaggggaagagtggggtgcgacggggggtggagtggttgacagatga

SEQ ID NO: 61977 - DNA, 294 bp, Glycine max
  Peptide Sequence Number=SeqID_153662
atggcattcgatggtgtggtggttgaaggatgcactttggctaaccaagatggcacaagccgtgcccttcctataacacaaagggaagttgcctcccagtattgttggggaactcgagcaacatttgaaacagattattgtcgggcattctttcttcgcagttgtccatgtctgtatcaagtagttaggtaccagacatggtgcaatagtcctcaagggtctcaaattagaaatattctagcggtgaaaatctatgatcatgtagtgttgcctagatccaatatgaagctttag

SEQ ID NO: 61978 - DNA, 243 bp, Glycine max
  Peptide Sequence Number=SeqID_153663
atgaaggaggacttgaagaaattaagagatatgaacaaagatggcataaactttcaagctaatgtaataaaaagtgttgaagatgaagatgatgtgtttttggcaaaagacgagagattgagagatgttggacactttgaaaatcaatggagaatcgaccattttaagttaggaaatggtggaaaaatgatggttgaaggcatagggagcgtgagggtgaagctccataatggtgttatttga

SEQ ID NO: 61979 - DNA, 171 bp, Glycine max
  Peptide Sequence Number=SeqID_153664
atgtcggctcaacttaggtcattaactctgagtaggcctcggggtctcgagaaccttcctttacaacagtggttgggttgggtgaaaggttgtgggcgagtggtggtcgttggtgacaattgcggcggtggtcgtcaagtgtctcttcctataacttggccaaggatatag

SEQ ID NO: 61980 - DNA, 339 bp, Glycine max
  Peptide Sequence Number=SeqID_153665
atggcttaccttgtcaaaatccagcgcggcggcttcatccagccctttggctccatgatcgccgtcgacgagccctccttccgcatcctcggttactccgacaatgaccgcgacatgctttgcattactccgcagtccgtcccttcgctcgacgacaagaacgacaccaccttcgctctcagcaccgatgtccgagccctcttcactcactccagtgccttactcctcaaaaaggccttttcagttatcagctttccacattttcaaggggtatccaatcctctttgtaaagtttggcatccgttgagaactggagaagtcttgtatttaccatgttag

SEQ ID NO: 61981 - DNA, 576 bp, Glycine max
  Peptide Sequence Number=SeqID_153666
atggagttgtatcaactcaaaatgatgatgggaggagatctccatgacaacatcaacaagttcaatcagctagtaaaccaatttttgaatgtaaatgataaactctctaatgaggagcaaacactgttgttgttgacctcactaccaagatccttcaaagctttggttcaaatgttatttgtggaaagatcaactttgaatttggatgaggtgatcaccgctattaaagaaaatgagagaatgatgagaactgaaaatattgatgatgaacaccatgcaatagctatgaatgataatgtccaagtgaggtgcaaacaaatgaaggagaacttgaagaaattaagagatatgaacaaagatggcgccaactctcaagctaatgtaataaaaagtgttgaagatgaagatgatgtgttggacactttgaaaatcgacggagaattcgcccatttcaagttagggaatggtgaaaaaatgaaggctgaaggcatagggagtgtgagaatgaagctccatgatgggtacaagtatgttggttcaaaatggggatgcaaggtgtataagggaagatactag

SEQ ID NO: 61982 - DNA, 390 bp, Glycine max
  Peptide Sequence Number=SeqID_153667
atgccgatgttggatcagttttatccttgcattcaccattccattgaaaactttgtcgatgttaaagttgatggtaactctagatatcgtacaattgttgccttattaggtatgtgtgaagattcatggtctttggtgtacaaccaattgcttaaagaacttgccaaatggcctgatgagtatatcaacctccttggtggcataaacaaatttgaggaattaaagagtctcgaagctatgaaaggcgcctatgataggcagataaagcaaagaggctacatcatcaagggtgatggtcacttctcttacaggaagatgaaaactcctagtttccttatgtcatctctctgcaaaagcctatataagtctctgatagccagtgtccaatga

SEQ ID NO: 61983 - DNA, 207 bp, Glycine max
  Peptide Sequence Number=SeqID_153668
atgaagagacaaggatctcaaatggtgatttcctgcttagtatgggtgtggctaggaaatttgttagataaatcaccgtctgaaatgcaaatgatcgatgttgtgggggttcagaagggttgtcctaggacatggtgcaaggaagggtggggggatgatgttgaaagtagtgcttttagatgcaatggtggttgcaaaaattggtag

SEQ ID NO: 61984 - DNA, 246 bp, Glycine max
  Peptide Sequence Number=SeqID_153669
atggttaacgacgaaacggtgcggcgatctcttccttccatccagtgcgcagttcaattccgcccctgcatcgatatccacaaggggaaagtgaagcaaattgtaggctctacccttcaagacttgaaagggtccgatcccgttaccaattttgagtctgacaagtcagcggccgaatacgccatgctttacaagcaagatggactcacaggtggccgatcctttcagcaaagcttctgcccttga

SEQ ID NO: 61985 - DNA, 3231 bp, Glycine max
  Peptide Sequence Number=SeqID_153670
atggctctgcgatcattctcctatgacgtgttcctcagcttccgaggggaagatactcgttatggtttcactggcaatctctacaatgtcctccgggaaaggggaattcacaccttcattgatgacgaggagctccagaaaggggatgaaatcaccacagcacttgaggaggcaattgagaagtccaagattttcatcatcgtgctctctgaaaactacgcatattcctccttttgcttaaacgaactcactcacatccttaactttactgaggggaagaatgatccgttggttttgccagttttttataaagtgaatccttcatatgtccgacaccacagaggtagttatggagaagcactggctaatcatgaaaagaagttgaactctaataacatggagaaacttgagacgtggaagatggctctgcgccaagtgtctaacatttctggccatcatctccaacatgatggtaataaatatgaatacaagttcattaaggagatagttgaatcggtgtctagcaagtttaatcgtgatcatttagatgttccgaatgtcctggttgggctagagtcaccggtgcgacaagtaaagtcgcttctggatgttggacgtgatgatgtcgtccacatggtggggatccatggactcgccggagtgggtaaaacaacacttgctgtcgcagtctataattccattgctgatcattttgaatcttcttgctttctagaaaatgtgagagaaactaccaataagaaggggttagaagatctccaaagtgcctttctttctaaaacagctggagaaattaagttaacaaattggagagaaggaattaccataataaagtgtaagctcaagcaaaagaaggttcttctgattctagatgatgttgatgaacataaacagttacaagcgattattggcagccctgattggtttggtcgtggtagtagagtcatcatcaccactcgagacgaacatttgttagcgcttcacaatgttaaaataacatataaggtgagagagttgaatgagaaacatgctcttcaattacttactcacaaggcttttgagttggaaaaagaagttgatccaagttaccatgatattttgaatcgagcgataacttatgcttcaggcctcccattagctctagaagtaataggttccaacttacttgaaaaaagtatagaagaatgggaatctgctctagatggatatgaaagaattcctgataaaaagatctatgacatacttaaagtaagctatgatgctttgaatgaagatgagaaaaatatttttcttgacattgcttgttgcttcaaagcttataaattggaagagctccaagatatactttatgctcattatggtcattgcatgaaatatcatattggggtgttggttaaaaaatctctgataaacattcatgggtcatgggattataaggtcatgagattgcatgacttgatagaagacatgggtaaagaaattgtccgaagagaatcaccaacaaatcctgggaaacgtagcaggttatggtcccatgaggatataaatcaggttttacaagaaaataaggggactagtaagattgaaatcatatgtatgaatttttcctcatttggagaagaagtagaatgggatggagatgccttcaagaagatgaaaaatctcaaaacacttatcatcaagagtgattgtttttccgaaggtcccaagcatcttcctaatactttaagagtattggaatggtggagatgtccttcacaggattggccacataattttaacccaaagcaacttgctatatgcaagttacccgatagtagctttacatcagtcgggttggccccattatttgaaaaggcaagtaggctcgtgaatttgacaagtttaattttggacgagtgtgatagtttaacagagataccagatgtatcttgtctctcaaatttggaaaatttgtcatttagaaagtgtcggaatttatttacaattcaccattcagttggtttattggaaaagcttaaaatcttggatgctgaatgttgcccagagcttaagagttttccaccgttgaagttgacctctcttgaaaggtttgaactttggtattgtgtcagtctcgagagttttcctgaaatattaggaaaaatggaaaatataacacaactttgcttgtatgaatgtcccataacaaaactcccaccttcatttcgaaatcttactcggcttcgatccttaagtcttggacaccatcaccaaactgagcagttaatggactttgatgctgccaccctcatttcgaacatctgcatgatgccagaactggatggtatttcagctgacaatttgcaatggaggctattgcctgaggatgttttgaaattgacctcagtcgtgtgttcaagcgttcaatctcttactttgaaactgtcagatgagcttcttccgctatttctctcatgttttgtaaatgtgattgatttagagctatcagggagtgaattcacagttattcccgaatgcatcaaagaatgccgctttttatctacccttactttggatcgttgcgatcgtcttcaagaaattagagggattcctccaaacttgaaaactttctctgcaatggattccccagccttgacctcctcaagcataagcatgttgctgaatcaggaactgcatgaggctggagacaccgactttagtttgccaagagtacagattccacagtggtttgagcacaagaatccgggacggccaattcgtttctggttccgtaacgatttcccagccatagttgcttgcattgctaagtcagattttcagggagttttcgattatccagatctcagcgtgttcattaatggaagggaacataaacattacggtcgtacccctgtccttgaaaaaccttgtacagttctttttcatcttctaatagaagatgatttagatgtatcactgttagagaacgaatggaaccgtgcagagattgtatgttatggttcatgggacgaatgcggaatccatgtattgaaagagctaagtagcatggaggatattcgattcactgatccttttagaaaagaaaaatttgtagttcagaggttgcggttcgggaaaaagcaaaggcaatcaataattgaaagaggaatcaagttgaggagtggtatggtatcaaggctgataaaagacaacagtatatactcaacataa

SEQ ID NO: 61986 - DNA, 108 bp, Glycine max
  Peptide Sequence Number=SeqID_153671
atgtcagatcaaaataatggtgatatggatgagacacaaacaggcatggatatagattacttattcaaggacccaacaatagacgatagtgatgattatgatgaatag

SEQ ID NO: 61987 - DNA, 2556 bp, Glycine max
  Peptide Sequence Number=SeqID_153672
atggacatgaggaacaaatatgaatacaagtttattaaggagatagttgaatcagtgtctagcaagtttaatcatgctcttttacaagttcctgatgtcttggttgggctagagtcacccgtgctagaagtaaagtcgcttctggatgttggatctgatgatgtcgttcacatggtggggatccatggactcggtggagtgggtaaaacaacacttgccgttgcagtctataattccattgctggccattttgaagcttcttgctttcttgaaaatgtgagagaaacttccaacaaaaaggggttacaacatctccaaagcatccttctttctaaaacagttggagagaagaaaattaagttaacaaattggagagaaggaattcccataataaagcataagctcaagcaaaaaaaggttcttttgattctagatgatgttgatgaacataaacacttacaagcaattattggcagccctgattggtttggttgtggtagtagagtcatcatcaccactcgaaacgaacatttgttagcgctacacaatgttaaaataacatataaggtgagagagttgaatgagaaacatgctcttcaattacttactcagaaggcttttgagttggaaaaagaagttgattcaagttacaatgatattttgaatcgagcgctaatttatgcttcaggccttccgttggctttagaagtaataggttccaacttatttggaaaaagtataaaagaatgggaatctgctctaaatggatatgaaagaattcctgataaaagtatctatatgatacttaaagtaagctatgatgctttgaatgaagatgagaaaagtatttttcttgatattgcttgttgcttcaaagattatgaattgggagagctccaagatatactttatgctcattatggtcgttgcatgaaatatcatattggggtgttggttaaaaaatctcttataaacattcatgggtcatgggattataaggtcatgagattgcatgacttgatagaagacatgggtaaagaaattgtccgaagagaatcaccaacagagcctgggaaacgtagcaggttatggtcccatgaggatataaatcaggttttacaagaaaataaggggactagtaagattgaaatcatatgtatgaatttttcctcatttggagaagaagttgaatgggatggagatgccttcaagaagatgaaaaatctcaaaacacttattatcaaaagtgattgttttaccaaaggtcccaaatatcttcctaatactttaaggaggttcgtgaatttgacaattttaaacttggacaagtgtgatagtttaacagagataccagatgtatcttgtctctcaaaattggaaaaattgtcatttgcaaggtgtcggaatttgtttacaattcactattcagttggtttattggaaaagcttaagatcttgtatgctggaggttgcccagagcttaagagttttccaccattgaagttgacctctcttgaacagtttgaactttcgggttgtcacaatctcgagagttttcctgaaatattaggaaaaatggaaaatataacagtacttgacttggatgaatgtcgcataaaagaattccgaccttcatttcgaaatcttactcggcttcaagagttatatctgggacaggaaacttaccggttaagaggctttgatgctgccaccttcatttcaaacatttgcatgatgccagaactagctcgggttgaagctacccaattgcaatggaggctattgcctgacgatgttttgaaattgagctcggtcgtgtgttcaagcatgcagcatcttgaattcataggctgcgacctgtcagatgagcttctttggctatttctctcatgttttgtaaatgtgaagaatttaaacctgtcagcgagtaaattcacagttattcccgaatgcatcaaagactgccgctttttaactacccttactttggattattgcgatcgtcttcaagaaattagagggattcctccaaacttgaaatatttctctgcattaggatgcctagccttgacttcctcaagtataagcatgttacagaatcaggaactacatgaggttggagacaccttctttattttgccaagtggaaagattccagggtggtttgagtgccatagtcggggaccgtcaatttttttctggttccgtaacaaactcccagccatagttgtttgctttgttaaggaagattttttgaactttacctcagatctagttttgagcgtgatcattaatggacatgaacatcaacataaacctttgtttggtgggtttttcttcgaatcaccttgtacagctctttttcatcttcaaatgaaagataatttagatgaagcactattagagaatgaatggaaccttgcagagattgtatatggagatttgtgtgatgaaaacggaatccatgtattgaaaaagcaaagtagcgtggacgatattcgattcattgatccttgtagaaaaaaaaaattaaatgatgatctcattagttcataa

SEQ ID NO: 61988 - DNA, 858 bp, Glycine max
  Peptide Sequence Number=SeqID_153673
gttgggggagctggtgccagagcaagcaaaaagccatgcctcaactacgtggttgcctcatttgttgacgtgtgccacagagcttcccgtattgttcaaattcaggcgacggtgtcaaagagagctcttgaactaattgcattgcctgatgaccgcattcctaaactactccttgatatcggttgtggaacgggacttaacggcgagacaatctcggagaatggacaccattggattgggcttgatatttcagcatcaatgcctaatgttgtggtggagcgagaggttgagggtgaccttttacttggtgacatggggcttaaagcagcagcagccataggaggtggtaccaaacttcctcagcctcccccaacacaaccaacaacaagggaattccaacaacaacaacatgggagagaacaaaccgtcagaggacgagagcaagaagcaacaacagttggcaccaaagaggagaaagctggatttggtttacccccttattgttccttctccccaggtctaggaattcatcctggagttatggatggggccatcagtatatctgttgttcggacgttgaacaaattttcatgtatagcattggctggggtgtatactgagtatcttatatatggattttctgaaggaggtctagatgacataagaaaggacctaggcttcgcacagaagaaggcagattctcaggttagatggtctttgctaaacacggtcttgcggaggtatcaagcagcacgagggaaggttgttgaggccttatcaacgggaaaatccgtaggatcctacattgacattatagagaattctattgatgtttcagacctcttactgaagctttga

SEQ ID NO: 61989 - DNA, 819 bp, Glycine max
  Peptide Sequence Number=SeqID_153674
atggtgaagacgagagatacagcagcgtcaatgacgaacgtcatagaggagcagggaaacatggctctgtcaaatgcccaggaagagagaatcttggtttccataagaataaggcctttgaacaagagagaaaaggctaggcatgatacaagaacaacggccatgtggaaccacgaccactctcaatggatacctatgcctttggtgcgtaacaaatatcaaaatgctaggcaaacaagcagtggaaagacacacaccatgtctggcattactgaatatgttgaaagggacatatatgaatacattgagaagcataaagacatagaatttgttaattttgttgatctagtaggaagtgagtgtgcttctcaagcaatgacagcaggcataagattgagagaaggtagccacataaatcacagtttactgagccttgaaactctaattcggaaactaagtatacctctgaggtcatataatgtggggtactgcatggtgtgtgaagctaatctgaaaatattggaaggggtaactgacattgacttggtggtcaatctgaagctccaagaagaagcactgcttgcaaaatgccttggtagaagaatttgtaatcaatgtggaggaaattttaatattgcctccattagcatcaagggtgagaatgggcgtcctggaatggtcatggctccacttcttcctcctgcacactgtatgtcaaagctcattactcggtcagatgatactaaagcagtagtcaaagaaaggcttcgtatatacaatgaaaaggaacagatgatttctgtgagaattgctgattga

SEQ ID NO: 61990 - DNA, 441 bp, Glycine max
  Peptide Sequence Number=SeqID_153675
atgtttgagaagcgtcccaagactgacattgtcctaacctgttttgcagatttcttagaattggcattgcagtttggaatgattttgatgtttgcttgcgcattcccacctgcatttgcttttgctgctgtgaacaaccttatggagatcaggacagatgcattgaagctgctagtaattttgaggcggcatgttcctcgtgccgctgcaacagtaggagtctggcttaacatatttcagtttcttatactgatgtctatatgcaccaactgtgctattttagcatggctatatgatgaggagggaaaatggaaaatagagcctggacttgcaacaattttaatcatggagcatgtcctcttgttgactaagtttggtttctctcgcttctttcctgaggtgattgttttgcttcccaaaagtaccaaacattctccataa

SEQ ID NO: 61991 - DNA, 1017 bp, Glycine max
  Peptide Sequence Number=SeqID_153676
atgtgttccttagcttccgaggggaagatactcgttatggtttcactggcaatctctacaatgttcaccgggaaaggggagttcacaccttcattgatgacgacgagctccagaaaggggaccaaatcgatcaccacagcacttgaggaggcaattgagaagtccaagattttcatcatcgtgctctctgagaactacgcatcttcctccttttgcttaaacgaactcactcacatccttaactttactaaggagaagaatgatgtgttggttttgccagtttttcataaagtgaacccttcagatgtccgacaccatagaggtagttttggagaagcactagctaatcatgaaaagaagttgaactctaataacacggagaagcttcagacctggaagatggctttgcaccaagtttctaacatttctggctatcatttccaagatgatgggaacaaatatgaatacaagttcattaaggagatagttgaatgggtgtctagcaaggttaatcgtgatcatttacatgtttcggatgtcctggttaggctagagtcaccgatgctagaagttaagttgcttttggatgttggacgtgatgatgtcatccacatggtggggatccatgggcttgatgaagtgggtaaaagatcacttgctgtcgcagtctataattccattggtggccattttgaagcttctttctttcttggaaatgtgagaggaacttccaacgagataaatgggttagaagatctccaaagcatcattctttccaaaacagttggagaaattaagttaacgaattggagagaaggaattcacataataaagcgtaagctcaagggaaagaaggttctattgattctagatgatgttgatgaacagacacaattacaagcgattattggcagccttgattggtttggtagtggcactagagtcatcatcaccactcgggacgaacatttgcttttgagttggaaaaagaagttgatccaagttatcatgtgttaa

SEQ ID NO: 61992 - DNA, 2877 bp, Glycine max
  Peptide Sequence Number=SeqID_153677
atggagaccgaaaactcacacaaacctttattcaaaattctgatggctgtgcgatcattctcttacgatgtgttcctcagcttccgaggggaagatactcgttattgtttcactggcaatctctacaatgtccttcgcgaaaggggaattcacaccttcattgatgacgacgagctccagaaaggggaccaaatcacgtcagcacttcaggaagcaattgagaagtccaagattttcatcatcgtgctctctgaaaactacgcatcttcctccttttgcttaaacgaactcactcacatccttaactttactaaggggaagaatgatctgttggttttgccagttttttatatagtggatccttcagatgtccgacaccacagaggtagttttggagaagcactggctaatcatgaaaagaagttgaattctactaacatggagaaccttgagacatggaagatcgctctgcaccaagtttctaacatttctggctatcatttccaacatgatggggacaaatatgaatacaagtttattaaggagatagttgaattggtgtctaacaagtttaatcgtgatcttttacatgtttcggatgccctggttgggctagagtcaccggtgctagaagtaaagtcacttatggatgttggatctgatgatgtcgtccaaatggtggggatccatggacttggcggagtgggtaaaacaacacttgctgtcgcagtctataattccattgctgaccattttgaagcctcttgctttcttgaaaatgtgagagaaacttccaacaaaaagggattacaacatctccaaagcatccttctttctaaaacagttggagagaagaaaattaagttaacaaattggagagaaggaattcacataataaagcgtaagctcaaggaaaagaaggttcttttgattctagatgatgttgacgaacaaaaacagttacaagcaattattggcagccctgattggtttggtggtggaagtagagtcatcatcaccactcgagatgaacatttgttagcacttcacaatgttaaaataacatataaggtgagagagttgaatgagaaacatgctcttcaattacttagtcagaaggcttttgaattggaaaaagaagttgatccaagttaccatgatattttgaatcgagcggtagcttatgcttcaggccttccgttggctttagaagtgataggttccaacttatttgaaaaaagtatagaagaatgggaatctgctctaaatggatatgaaagaattcctgataaaagcatctatatgatacttaaagtaagctatgatgctttgaatgaagatgagaaaagtatttttcttgacattgcttgttgcttcaaagattatgaattgggagagctccaagatatactttatgctcattatggtcgttgtatgaaatatcatattggggtgttggttaaaaaatctctcataaacattcattggtggggtaagctcatgagattacatgacttgatagaagacatgggtaaagaaattgtccgaagagaatcaccaacagagcctgggaaacgtagcaggttatggtcccatgaggatataaatcaagttttacacgaaaataaggggactagaaagattgaaatcatatgtatgaattcttcctcatttggagaagaagtagaatgggatggagatgccttcaagaagatgaaaaatctcaaaacactaattatcaagagtgattgtttttccaaaggtcccaaacatcttcctaatactttaagagtattggaatggtggagatgtccttcacaggattggccacataattttaacccaaagcaacttgctatatgcaagttacccgatagtagctttacatcactcgggttggccccattatttgaaaaggcaagtaggctcgtgaatttgacaagtttaattttggacgagtgtgatagtttaacagagataccagatgtatcttgtctctcaaatttggaaaatttgtcatttagagggtgtccgaatttatttacaattcaccattcagttggtttattggaaaagcttaaaatcttggatgctgaattttgcccagagcttaagagttttccaccgttgaagttgacctctctcgaatggcttgaactttcgtattgtttcagtctcgagagttttcctgaaatattaggaaaaatggaaaatataacagaacttcacttgattgaatgtcccataacaaaactcccaccttcatttcgaaatcttactcggcttcaagtgttgagactgggacccgaaactgctccgttaatggactttgatgctgccaccctcatttcgaacatctgcatgatgccagaactatatgatatttcagctagcagtttgcaatggaagctattgcctgacgatgttttgaaattgacctcagttgtgtgttcaagcattcaatctctttctttggaactgtcagatgagcttcttccgctatttctctcatgttttgtaaacgtgagaaatttaaatctatcatggagtaaattcacagttattcccgaatgcatcaaagaatgccgctttttaactacccttactttggattattgcgatcgtctccaagaaattagagggattcctccaaacttgaaagaattctctgcattaggatgcctagctttgacttcctcaagcataggcatgatactgaatcaggaactgcacgaggtcgactttagtttaccaatactaaagattccagagtggtttgagtgccagagtcgggaaccatggaggatattcgattatcactcatatgtatgtgaagattcttgggacgaatgcggaatccatgtattgaaagagtaa

SEQ ID NO: 61993 - DNA, 282 bp, Glycine max
  Peptide Sequence Number=SeqID_153678
atgcattgggaatgcgaaaattttccaacatgcttctgggggagatacatatctaatgattcaagtagcatagatatattgttgaagatagagtcagacgttggtaagaatagaagcatacctgcaatcaagatatggttgaatttcatcttgaatctgagagtgatcaccattcgtgctgtgatgattttgaagagtagctctgatacggtcagaacctttgttgatgtatttgaacagatatttaatggatgtactttgattacaccattccacatttag

SEQ ID NO: 61994 - DNA, 2052 bp, Glycine max
  Peptide Sequence Number=SeqID_153679
atggtggggatccatggactcggtggagtgggtaaaacaacacttgttgtcacggtctataatttcattgctggccattttgaagcttcttgctttcttggaaatgcgaaaagaacttccaacacgatagatgggttagaaaaactccaaaacaaccttctttctaaaatggttggagaaattaagtttacaaattggagagaaggaattaccataataaagcgtaagctcaagcaaaagaagattcttttgattctagatgatgttgataaacataaacagttacaagcgattactgacagtcctgattggtttggtcgtggtagtagagtcatcatcaccactcgagacgaaaatttgttagtgcttcacaatgttaaaataacatataaggtgagagagttcaataagatacatgctcttctattacttactcacaaggcttttgagttggaaaaagaagttgatccaagatactgttattttttgaatcgagcggtaacttatgcttccgaccttccattggctctagaaataataggttccaacttatttggaaagagtatagaagaatcggaatctgctctaaatggatttgaaagaattcctgataataatatctatgaaatacttaaagtgagctatgatgctttgaatgaagatgagaaaaaagacatggataaagaaattgttcgaagagaatcagcgacagagcctgcggaacagagcaggttatggtcccgtgaggatataaagaaagttttacaagaaaataagaggctcgtgaatttgacaagtttaattttggacgagtgtgatagtttaacagagatatcagatgtatcttgtctctcaaatttggaaattttgtcatttagagagcgtcggaatttatttagaattcaccattcagttggtttattggaaaagcttaaaatcttggatgctgaaggttgcccagagcttaagagttttccaccgttgaagttgacctctcttgaaagccttgatctttcgtattgttccaatctcgagagttttcctgaaatattaggaaagatggaaaatataacacgacttcacttgattggattttccataagaaaactcccaccttcatttcgaaatcttactcggcttaaagtgttatatgtgggaaccgaaactactccgttaatggactttgatgttgccaccctcatttcgaacatctgcatgatgtcagaactgtttgaaattgcagcaaacagtttgcaatggaggctatggcctgacgatgcttgtttgcaatggaggctatggcctgacgattttttgaaattgacctctcttctgaattcaagcattgaatttctttgtcacggcgacctgtcagatgagcttcttcggctatttctgtcatgttttgtaaatgtgataaatttagagctaaaagggagtaaattaacagttattcccgaatgcatcaaagaatgccgctttttatctacccctaaattgaatggttgcgatcgtcttcaagaaattagagggattcctccaaacttgaaaagattctctgcaatagcatgcccagacttgacttcctcaagcataagcatgttgctgaatcaggaactgcacgaggctggagacacctactttagtttgccaatagtaaagattccagagtggtttgagtgccagagtcgggaaccgtcaatttttttctggttccgtaacgaattcccagccataactgtttgcattgttgagtcacattttaaggaatattccaatgatctggttctcagcgtgatcattaataagaaacataaacataaacaaagagaaatattcgattcagtgatcctgatcctgatccttttagaaagagaaaaatttgtagttcagaggttggggttggggaaaaagcaaagattagtaggcagtgaagttgttgagacacaatttgtagagcagcaacaacatatgggtttttttctcacacgtgtagaactgggcactatcacttgtaatgtctcgctgctccggcaatcaataattggatga

SEQ ID NO: 61995 - DNA, 189 bp, Glycine max
  Peptide Sequence Number=SeqID_153680
atgttaggattcaacacggctgttgggttctacgaagctttatatataggaggtgttatttatggtcacagtgtcatggcggtacttgatagtttgatagtcatggatgctgctattcagatttttgcattttgcgtgttgccttacattgaagtttacagtaatgttttatatatggaggactcttag

SEQ ID NO: 61996 - DNA, 96 bp, Glycine max
  Peptide Sequence Number=SeqID_153681
atgctgctgttcgatcagattggtatgggtgtggaagaagagggaggtgttatttatggtaaagaccattgcttggaactggtcctcttgggataa

SEQ ID NO: 61997 - DNA, 552 bp, Glycine max
  Peptide Sequence Number=SeqID_153682
atgaaaatttcttcattccatcaatttcctgatgaatgcctcaacgagacacttaaccgttttcatgggttgctttggaagactcctacacatgggtttagcaagctattccaactcaacatctttattgatggcttgcaaccccattccaagcaacttctcgatgcctcaatcggtgggaagatcaagttaatgactccagaagaagctatgaagctgatagagaatatggcggccaatgatcatgtcattctacgtgacccagagcccaacccacaggaagaaaccactaggctagaagaattgttggtacagttcatgcaggaaacaaggtcacatcagaatagcactgatgcaccactcagaaatctggaagtagaactagctaagctagttgctgaaaggcccaccgaaacctttgcggtcaatactgagatgaagcccaaagaggagtgcaaggtgtttccaggatgcatgagtttcatggcgtctctagctaagaggcgaaaatgcaaggaggatgtgttctacgtgaccttcatgtcaccttga

SEQ ID NO: 61998 - DNA, 1476 bp, Glycine max
  Peptide Sequence Number=SeqID_153683
atggctctgcgatcattctcttacgatgtgttcctcagcttccgaggggaagatactcgttatggtttcactggctatctctacaatgtccttcgggaaaggggaattcacaccttcattgatgacgacgagccccaggaaggggacgaaatcacgacagcacttgaggcggctattgagaagtccaagattttcatcatcgtgctctctgaaaactacgcatcttcctccttttgtttaaactcactcactcacatccttaactttactaaggagaataatgatgtgttggttttgcccgttttttatagagtgaatccttcagatgtccgacaccacagaggtagttttggagaagcactggctaatcatgaaaagaagtcgaactctaataacatggagaagcttgagacgtggaagatggctctgcaccaagtgtctaacatttctggccatcatttccaacatgatgggaacaaatatgaatacaagtttattaaggagatagttgaatcggtgtcaaacaagtttaatcatgatcatttacatgtttcggatgtcctggttgggctagagtcaccagtgctagaagtaaagtcgcttctggatgttggacgtgatgatgtcgtccacatggtagggatccatggactcgccggagtgggtaaaacaacacttgctatcgcggtctataattctattgctggccattttgaagcttcttgctttcttgaaaatgtgaaaagaacttccaacacgataaatgggttagaaaaactccaaagcttccttctttctaaaaccgctggagaaattaagttaacaaattggagagaaggaattcccattataaagcgtaagctcaagcaaaaaaaggttcttcttattctagatgatgttgatgaagataaacagttacaagcacttattggcagccctgattggtttggtcttggcagtagaatcatcataaccactcgagacgaacatttgttagctctacacaatgttaaaataacatataaggtgagagagttgaatgagaaacatgctcttcaattacttactcagaaggcttttgagttggaaaaaggaattgatccaagttatcatgatattttgaatcgagcggtaacttatgcttcaggtcttccatttgttttagaagtaataggttccaacttatttggaaaaagtatagaagaatggaaatctgctctagatggatatgaaagaattcctcataaaaaaatctatgcatacttaaacttgatattgcacccttgcgatttggagcagcccaatacaagcggatctccaattaatgtattactagtcacaatagcagtgaacgatttgatgattgccttaccaattcctcctgtttcttttaaaatattaaagtccttcttcactagcgctccctacaacatttcaattcaaaccttaatgcttcatgatacttacaagccttaa

SEQ ID NO: 61999 - DNA, 1533 bp, Glycine max
  Peptide Sequence Number=SeqID_153684
atggtcaacaaacatcaacgtgtccatggtggctatttctttgcaacacattctacaactatttttcgtcttcaaattgaagataatttagatgaagaactatcaaagagtgaatggaaccgtacagagattgttgcggttgggaaaaagcaaagattagtaggcagtgaagttgttgagacacattttgtagagcagcaacaacatatgggttttttgtcacacatgtggaactgggcactagcacttgataacaggggaaaaggagcttctgaaatgtcccaaggagaagcagagcattcaggaaaggtggcttgcactgcaacaaatttcaatggtgatgagcatagttttagttgtgaacagacatgcactgagaaaactaagactgcccctcaaatgaaatttgatgctcaaagtggagagaggaaaattggtgagagaggaaatactaaacaacatctgaatgttgcaataaaccccgaagaaagcagggaccaaatgtcatcaagccaaggtgattacagaaggaacacaatagcagatgaacctgctgcagtgcaagaaatgttgagaggatcagaagagaaagagagttggaaaaagatggaagaggagatggagagagaaagggaaagacagaaagacaaaatggctgttgatagtgcaatgctagaggctgagagggaaaaggaaaaagaaaaagataggatggcggttgataaagcaactttggaggctcgtgatagaacatatgttgatgctcgtgagagagcagaaagggctgcatttgagagagaacctacagaagctcgacaaagagcgctggctgaggccagagaaagacttgaaaaggcatgcactaaggccagggacaaaacatatgctgataaggcagctgcagaagccagattgaaagcagagcaaactgctgtagaaagagcaactacagaggctcgagagtgtgcaatggacaaagttaaggagacagggctcttcatcctcagtaagatatactggatccacattgttagaactctagctccttcacgcattccaaatatccatattcctcagtttatggtgtattgtcctttacttgaagcttcctcttttactgaaagattagaacgagaaggtgaatcagctcagaggtgtagagctagactggagaggtattgccgaacagctgagcgtgcagcaaaagctttggaagaaaagaacatgcgtgaccttgtagcccagaaggagcaagctgagagaaatagattagcagaaaccctggatactgaagtcaggaggtggtcaagtggaaaagaaggaaatttgcgtgcattactttcaaccttgctatatattcttgggcctgatagtggctggcagccaatcccactcacggacgtcattacttctgccgctgtaaagaaaacttacaggaaggccaccctttgtgtccatcctgacaagttgcagcaacgtggagcaagtattcaacacaaatacatatgtgagaaagtctttgatctcctaaag

SEQ ID NO: 62000 - DNA, 846 bp, Glycine max
  Peptide Sequence Number=SeqID_153685
atgaccaaaagtctatccaatccccaacttactcttctatggaactttatgatgttatctgacaactttagcattgataaggaaccacaacagagatggtttttccaaaattttaagggaacaaatagacaacagatccaagacaagttctatgaatttgtcgaaagagtaaaaatcaatattcttttctttgattggttccatgcttacaccatcatagaagatatagattacccatggaaacaagatatcataggtgatccaacaacaaatgtcataacaaactggcaattgaaagacgacgagttaatccaagcagatttaccccctgcaactcagtatcaacttcccaatatcaaagatagtagtaataaacctgtcatggcaattccattcaaaatgaaagacatcaatgaggaagtaacctatagggatattaggagcctaatggaacaggctaactatacaaacaagtacttacaagtcctaggaaaaactctcaagacaaaaatttctaaacaaaaaacaattgaagaagcttcaacaagtattcccattgaaaaaccattattcaaacctttcaaaattagcgacaaagctaaaaaaaaaataagagagcttaggaaaaacaaatcactaattgaaggagtaggagacaataatagtgaaatactacacaaaattagtagtttacttaaggtcatcccagaaactccccaaacctcagataatacatcaaaaatagtaacaagaagttcatcaagattagtcaatgttattaatgaggatagtgatcaaaattctaataatacaactgaaacagaaaattcaaagaaggccatctaa

SEQ ID NO: 62001 - DNA, 2661 bp, Glycine max
  Peptide Sequence Number=SeqID_153686
atggacatgagggacaaatatgaatacaagtttattaaggagatagttgaattggtgtctagcaagtttaatcgtgatcttttatatgtttcggatgtcctggttgggctagagtcaccggtgctagcagtaaagtcgcttctggatgttggatctgatgatgttgtccacatggtggggatccatggacttggcggagtgggtaaaacaacacttgctgtcgcagtctataattccattgctcgccattttgaagcctcttactttcttgaaaatgtgagagaaacttccaacaaaaaggggttacaacatctccaaagcatccttctttctaaaatagttagagataagaaaattaagttaacaaattggagagaaggaactcacataataaagcataagctcaagcaaaaaaaagttcttctgattctagatgatgttaatgaacatatacagttacaagcgattattggcagccctgattggtttggtcgtggtagtagagtcatcatcaccactcgagatgaacatttgttagcgcttcataatgttaaaaaaacatatatgttgagagagttgaataagaaatatgctcttcaattacttattcagaaggcttttgagttggaaaaagaagtcgatccaagttaccatgatattttgaatcgagcggtaacttatgcttcaggccttccattggctttagaagtaataggttccaacttatttggaaaaagtatagaagaatgggaatctgctctaaatggatatgaaagaattcctgataaaagtatctacatgatacttaaagtaagttatgatgctttgaatgaagatgagaaaaatatttttcttgacattgcttgttgcttcaaagaatataaattgggagagctccaagatatactttatgctcattatggtcgttgcatgaaatatcatattggggtgttggttaaaaaatctttgataaacattcatgagtgttcatgggattctaaggtcatgagattgcatgatttgatagaagacatgggtaaagaaattgtccgaagagaatcaccaacagagcctgggaaacgtagcaggttatggtcccatgaggatataaatctagttttacaagaaaacaaggggactagtaagattgaaatcatatgtatgaatttttcctcatttggagaagaagtagagtgggatggaaatgccttcaagaagatgaaaaatctgaaaacacttattatccagagtgattgtttttccaagggtcccagacatcttcctaatactttaagagtattggaatggtggagatgtccctcacaggaatggccacgtaattttaacccaaagcaacttgctatatgcaagttaccacatagtagctttacgtcactcgggttggccccattatttaataaggcaagtaggctcgtgaatttgacaaggttaactttggacgagtgtgatagtttaacagagataccagatgtatctggtctctcaaatttggaaaatttgtcatttgcaagctgttggaatttatttacaattcaccattcagttggtttattggaaaagctcaaaaccttgaatgctgaaggttgcccagagcttaagagttttccaccgttgaagttgacctctcttgaaatgtttcaactttcgtattgttccagtctcgagagttttcctgaaatattaggaaagatggaaaatataacacaactttcctggactgattgtgccataacaaaactcccaccttcatttcgaaatcttactcggcttcaattgttagttgtggaaaatcttacagaatttgactttgatgctgccaccctcatttcgaacatctgcatgatgccagaactaaatcaaattgatgctgtcggtttgcaatggaggctattgcttgacgatgttttgaaattgacctcagtcgtgtgttcaagcgttcaatctcttactttggaactgtcagatgagcttcttcagctatttctctcatgttttgtaaacgtgaagaagttaaacctatcatggagtaaattcacagtcattcccgaatgcatcaaagaatgccgctttttaactacccttactttgaattattgcaattgtcttcgagaaattagagggattcctccaaacttgaaaacattctctgcaatagattccccagccttgaattcctcaagcataagcatgttgctgaatcaggaactgcatgaggctcgagacaccgactttagtttgccaagagtaaagattccagagtggtttgagtgccagagtcggggaccaccaatttgtttctggttccgtaacgaattcccagccataactgtttgcattgttcagccacatttgaatatgtccaaaagcctctcggtgatcattaataataaaccggaatatagattgtatgtaaggatttgtgggatgaatgcggaatccatgtatggaaagagcaaagtagcatggaggatattcgattcagtgatccttgtagaaaaagaaaaatttgtagttcagaggttgcggttggggaaaaagcaaagattagtaggcagtgaagttgttgagacacaatatgtagagcagcaacaacatatgggttttttctcacacgtgtggatgaaagaggaatcaagttga

SEQ ID NO: 62002 - DNA, 165 bp, Glycine max
  Peptide Sequence Number=SeqID_153687
atggctctgggttccacctatggggacatcaatctaaagagaaaccccacaaagaagaaaaagaaaacaacagcaaggcctgaatttgcaaggtatcatgagtatctcaaggaaggagacatgtgggatttgaattccaataaacctgtgatgtattacaaatga

SEQ ID NO: 62003 - DNA, 204 bp, Glycine max
  Peptide Sequence Number=SeqID_153688
atgtccttacgaaccttattcctacttccccatcaggctctgataccagagatcaagggcactttcatgactctctggatcactatccttgaaggagagggatgtatgacgtatgatctacccttgatgtttgatccctctccgctgatctcatctgactctgatatcaatacatgggctctgatatcaatatatgtgccctaa

SEQ ID NO: 62004 - DNA, 106 bp, Glycine max
  Peptide Sequence Number=SeqID_153689
atgaccccttcacaacaacatgatgccccaatggcaacacctaactccccattagctccacaatggaatgtatccgaagcaatacctgatatgggtgacttattag

SEQ ID NO: 62005 - DNA, 369 bp, Glycine max
  Peptide Sequence Number=SeqID_153690
atgaaaatcattcattatgatgtctgtgatgacgtgagaatgtgtcacatggtcgacctcatcttcgcgcttgacgatcaggatttcttctgccgcgatgtctccccgcttctacttgctcaatctcagcagaaaactcctcactcggctataaaaaatgaggatgtgttttcgcaacatcaccgaacgaatgttcgcttgcaaacatatcagtgtgatgaccttcgaaccgatattgatacatctgtgaaggatacaaagaaaatgttgctggcttgtaatacattccatggccacgctcctcaatttgttgggaaaattcttgcggttcaacagcctcccttcgcctgtcaaaaccccgagttttaa

SEQ ID NO: 62006 - DNA, 420 bp, Glycine max
  Peptide Sequence Number=SeqID_153691
gcattacgggccaatgcacctctaccttatccacatttgataactttatttctgcgtcattttcaaattccgcttgatgatgagccatttgttcaagtcaagcgttcctttgctattggtgctggtgctttgacttcctttggttaccgtaaggatcggaatggtcaatggctgaagaaagacgcactccctcctcacgatgagcgtactccttcacctcctcctcagcgtgaagattcagcactcctgaatgaagtccttaccgaattacgagttcttcgttcttatgttggtgaatttttcgactcattggatacacgctttgccgacatgaatattcgcctcacacaagttgaagaagatgtctccttcatccgtacttgctttgatccaccaccaccgcctccatcatcctcttag

SEQ ID NO: 62007 - DNA, 114 bp, Glycine max
  Peptide Sequence Number=SeqID_153692
atggatcccgtgaaatacatctttgagaaaccggccctcacgggacgaatcgctaggtggcaggcggtaaagggaagtgccttagcggattatttggcccagcaacccctctag

SEQ ID NO: 62008 - DNA, 216 bp, Glycine max
  Peptide Sequence Number=SeqID_153693
atgggaggaagttcctcaaagattatgattttggactttcctaccacccgggaaaaggctaatgtagtagccgatgcgctaaagccggaaatctttacatgttgcgactatgatgagtttggagcagagattgatagaggagttccgagatctgaatctagcaatcgaggtgcgacccaagagcttatttgtgggaacgttgcagattaccaatga

SEQ ID NO: 62009 - DNA, 246 bp, Glycine max
  Peptide Sequence Number=SeqID_153694
atgtaccctccattagaactgatccacaagagatgtaccctctcttgttctcagtcaaacccaagtagatgtaccctctacttgtaccacaaaggatgtaccctccaatgtgttaagacaaagatctcaggcgggagaagagaaacacaaaaagaattcaggcagttagtccttggcgaattctttttggcaaagggagaaggtgttggatcgagtggcctcagaataattaagaaggggggttga

SEQ ID NO: 62010 - DNA, 255 bp, Glycine max
  Peptide Sequence Number=SeqID_153695
atggctgaagatcaacctaggagagttacccttgaagactactctagttctactgtgccgcaattcatcactattatagcgcggccagaggttcaagcgcataatattacttatcctcattctttaataaagctaatacaaggaaatctatttcatggcctgctgaatgaagaagacccgtatgcacacctagccacttacattgaaatttgcaatacagtcaagattgcaggcgtgccggaagatgctgtgcgg

SEQ ID NO: 62011 - DNA, 255 bp, Glycine max
  Peptide Sequence Number=SeqID_153696
atgaatatcgaggaatctattcatgttacctttgatgaatctaatgttatcttgtcaagaaagaatatgctagatgacattgcagattctttagaacatatgaatattgatgaacaagattccaaaggacatgataaaggaaacaatgaagattctcaagaagaagtcaaatccaataatgacttccaagagaatggaaagcttcaagagatcatcccctcgacaacattattggtgatatctcaaaaggggtaa

SEQ ID NO: 62012 - DNA, 276 bp, Glycine max
  Peptide Sequence Number=SeqID_153697
atggcttctccaccagcctcgcctcctcctcctcctccttctcctcctccttccgacacatcagcttcgccgtctaccgtgaaacggacacgcaaagcctcacgtctacgatccttgtctactagaccacctggtgctgagagaccagtggtccatgttgatcctgctactggcaacggtccccacaggaagaaattaagaacatatttggggattgtggcgcgtgataaggtggacgtcacgtacgagaactggaaggaggtctctactgcttag

SEQ ID NO: 62013 - DNA, 369 bp, Glycine max
  Peptide Sequence Number=SeqID_153698
atgaggattctttttttttataggccaaggttcaaaaagtctaaggttgtgtttcaatggggtcttttatcgtgggaacctaatcttgatatctggggcgaaacaaatttgggtgtcaaggtgtcgatttcaggccgagcttccatattgttccataaggcatgcgtgacaatgatgattcgaaaacaacgtgcaaaattagtcatggctacagccaggtgggcactcaagcatcccgtttatggcattgtgatactacggttgggaatttacacaaacagacccaacgtttccaagacaaagttcctaaatgaaaaattctacgcgtttccagaatttcaacagacactattgacaacaacgaaataa

SEQ ID NO: 62014 - DNA, 891 bp, Glycine max
  Peptide Sequence Number=SeqID_153699
atggcttcctcaccaaaagaaacttccgcttctggttcacccgctgtaccatcatctccgcaccaggaacaaccagaattcaacatccaacccatacaaataattcctggtcaagcttcagtccctgagaaactggttcccagaagacaacagggagtgaagattgctgaaaaccctagccctgcaacaagtcctagggaagtagatacggagatggacaagaaaatccgcagtatcatgttccaacatcttccaccccgaatgtttctgtgccggatgttgagaaaagatgttccaacatcttccgccccaaatgctgaagtcctctcttcctccagcaaagagagatcaacagaggaagatgatcaagccgcagaggagactcctgcaccacgggcaccagaacctgctccaggtgacctcattgacctagaagaggtagaatctgatgaggaacccattgccaacaaattggcacctggcattgcagaacgattacaaagccgaaaaggaaaaacccccattaagaggtcaggacgaatcaagactatggcacagaagaagagcactctgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcacggctgctggactactgaagact

SEQ ID NO: 62015 - DNA, 257 bp, Glycine max
  Peptide Sequence Number=SeqID_153700
ggtacatcctttgtggtacaagtagagggtacatctacttgggggttgttatactgagaacaagagagggtacatctcttgtggatcagttcaagtggagggtacatccacttggttattcaaagagaacaagggagggtacatcccttgtggatctttggcatgtaaaggattttacaaagttgaaagaaatctcaagaaccggttggttgcttggggactggacacaggcacggattatggccgaactagtataa

SEQ ID NO: 62016 - DNA, 480 bp, Glycine max
  Peptide Sequence Number=SeqID_153701
atgaacaacaccctcaaacaaacccgttccgtggcgggttcgctcacctcaccacaaagtgatacatacggtatcgtgtgcaccctcgtccccgatgaacaacgtatcgtcttctggccacagcattttggcaatatcccgcagtggataacccttgaaccacatatcttcgcgtggatggagcacttctgcgaaggctacaccggcggcatctggcagttttacacactcagcaacggtggggcgtttatggtaccagaaactaatgacaacgatgaaaaatggatgttgtttaacaacatgaacggcaacagtgcggagatgagcgcagacgctgccggggttgcggtctgcctcatcgcatacagccatcacgcctgtcgtactgaatgcaatgccatgacagaacactactaccgtctgcgggactatgcactcgtgcatgctgaatgccacgccattatgcgcattattgactga

SEQ ID NO: 62017 - DNA, 543 bp, Glycine max
  Peptide Sequence Number=SeqID_153702
atgtacccttccttgttctcttcgaaaccccagtggatgtaccctccactagaattgatccacaagagatatgtaccctctacttgtaccacaaaggatgtaccctccaatgtgttaagacaaagatctcgggctgttaaacctttgatactttctgaatggggatacaaaagaattctcaggcggttattttgtattagggaaagggaagaatcaaaagaattctcagattgtgtcattttgaattctttgacaagggagaagggagacacaaaagaattcaggcggttagttctttgttcttttggaaaagggagaagagagacacaaaaagaattcaggcggttagtccttggcgaattctttttggcaaagggtgaagagaatgaaaagatgaatagcacaacgtttcaaggtttggaaaaccagaaaacttcagaaagcttttggtacaaagaagaagaagaagaagttcaaagagattcaaggcttgtaaaggattgtaagagattgattggaaagtattcaagattgaatgaatga

SEQ ID NO: 62018 - DNA, 252 bp, Glycine max
  Peptide Sequence Number=SeqID_153703
atgttcatcatattcaacagtgctttgaaaggacttgatgatactccacagcctaaatccaaggctgctgcaaggtggattgtcgttaagtgtaatagacaaaaaggaagcactgagtgcggctattatgtcatgcactggatgtccaccatcatcttaggaagtttcaggaataactggaaagtgcccattggagctagagagattaaaggtgcttcgcatccagtgggcatgatattatctccgacttag

SEQ ID NO: 62019 - DNA, 411 bp, Glycine max
  Peptide Sequence Number=SeqID_153704
gattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcgatggggatggaattgttagggccgatgtttcctttttcgaagggcagaatctaaatataggtgtggacaaagtag

SEQ ID NO: 62020 - DNA, 351 bp, Glycine max
  Peptide Sequence Number=SeqID_153705
atgtaccctccactagaactgatccacaagagatgtgccctctcttgttctctgtcaacaacccaagtagatataccctctacttgtaccacaaaggatggatacaaaagaattctcaggcggttagtccttcgaacacttttgtataagggaatgagaagaatcaaaagaattctcagactgtgtcgttttgaattctttgacaagggagaagggagacacaaaagaattcaggcggttagtccttcgttcttttggaaaagggagaagagagacacaaaaagaattcaggcggttagtccttggcgaattctttttggcaaagggagaagagatgacaagaatgaatag

SEQ ID NO: 62021 - DNA, 235 bp, Glycine max
  Peptide Sequence Number=SeqID_153706
tttactcaatcccacagaatttttaggaaacattgtggttgaacatgattatgctgagtgcactggatctgctattcaagctttagttttgtttaagaagctatatccaaggcatagggagacagagataaagaattccattgccaatgcagttcatggtatggaagttggggagtttgctacatttatggcacttggacatttcactgctcttcccctcggttttaaattttaa

SEQ ID NO: 62022 - DNA, 402 bp, Glycine max
  Peptide Sequence Number=SeqID_153707
atgaggggcaccgtgcatgagcctcaataccctggtcttcagaggactacactccttgccaacagagggctgcacgccctcaccttaagaggactgtgtgtcctcactttcagaggactgcatgtccttaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagaaggctgcacgccctcacctttagaggactacacgtcctcgcccacagaggggttgcacgccctcacctttag

SEQ ID NO: 62023 - DNA, 332 bp, Glycine max
  Peptide Sequence Number=SeqID_153708
ctaagggggaaagagatcccttggtcaaagtagtatggggaagtgcttcgggtgaggatgccacctgggaacgagagggtcagatgcgtgatgcatatcctaccttattcgataccggtcataaattcccactatataagccaaatgttaacctagagcagctttttagaaaacacattttgttcctttcttcttttctgacgcacaagaaccctaatagagcaaccagaggaagagctctagagagcaccagagacgccaccattgctaacagagaatatttaagcgactacatcgaggtaagggatgagttactcacgcttgagaattag

SEQ ID NO: 62024 - DNA, 178 bp, Glycine max
  Peptide Sequence Number=SeqID_153709
ggaatgggaagaatcaaaagaattctctgactgtgtcgttttgaattctttgacaagggagaagggagaagagaatgaaaagatgaatagcacaagttttcaaggtttagaaaaccagaaaactttagaaagcttttggtacaaagaagaagaagaagttcaaagagattcaaggctt

SEQ ID NO: 62025 - DNA, 346 bp, Glycine max
  Peptide Sequence Number=SeqID_153710
atgactaggggcaatccaggcaatttacaaccctttgatcctgaaatagatagaacctttcatagattagttaggcatagtgtgcatcctgatcattctgtgcattttgagcattctgagtattctattgctagtgattctgaatattctgattttgagcattccactactaatttttatactgagaacatggctcaacctccacctcgtgagaggactcgtagggagatggttgcacctgatttcacttatgaaagcttgtgcattcaatatcctgatgaggctgttccatatgttctcaagactggactaatacatttgctgcccaagttggatggtcttgcag

SEQ ID NO: 62026 - DNA, 177 bp, Glycine max
  Peptide Sequence Number=SeqID_153711
atgtcagtgaaaaacctcgtcgaacgcctaggagtacatgacatgacaaactacacactagtaagtcagcttaaaggagcactcaaaccgggtgtatttgcccccaaggcctacactccgaagagtccgtcagggcctctccctccagattcaggtccaacccagaaaacattttag

SEQ ID NO: 62027 - DNA, 144 bp, Glycine max
  Peptide Sequence Number=SeqID_153712
tggcgtatcctctctctcctccttcatctattccactgtcatttatcttccaagaagcaaaggaatccattgatgaagaagatcctaggcctacaagctccaatggagcttacatcatgtgctatcaagagcatcttcatctag

SEQ ID NO: 62028 - DNA, 99 bp, Glycine max
  Peptide Sequence Number=SeqID_153713
gattcttgaacacaagggaagggttgtccctgtgtggttcagactttgtaaaaggagttttacaaagagagtggaaaatctcaagcttgaggactggac

SEQ ID NO: 62029 - DNA, 219 bp, Glycine max
  Peptide Sequence Number=SeqID_153714
atggcccgcaccaagaaaactgggcaaatgacttctgaggtagctaaggaaattgccaacaagattttggaggagcaggcctcacagagttcctttgtcacccatggacatcgggatgtactggctattgccattaggcaaccagaacaccctggttgtgtacgtgctgttggaccaactccaaggacctcccgcacatcttcttccatggctccctga

SEQ ID NO: 62030 - DNA, 831 bp, Glycine max
  Peptide Sequence Number=SeqID_153715
gcctcacgtgccaagcgcagtaccaatgccatccgtgtgggtagcagcccgattctggaaacgtataaccttgggttgaacgccagctgggaacctgacctgtgggggcgcatcagaaagcagattgaatccggtgaggcgtccttgcaggcggccagtgccgatgtggaggtggccaagctgtcgatcgtcgctaatctgctgcaagcctactttcagctcagggtgctggatacgcaactggtattactggatgacacattaaaagcgctgcagcgctcacagcaactcacgctcaaccgctatcgcgcgggcgtggccagcaaaaccgacgttaaccaggccgacgccttacacaaaaacacacaggtcgttgcgacggatacccgcttgcagcgcgcccagacggaacatgcgattgccttgctgctgggtaaagcaccagcagaagtcactattcccgcccatccttatcagatgcaagcccctttagcactgcctgcgatcccggccagtttgcctgcagctttgttggagcggcggccggatattgccgcggctgagtaccgagtggctgccgccaatgctgatatcggtgtggctaaaaccgcttttttccccagcctgaacctgacagctggcctgggctaccagagtaacgcatttagcaacctgattgcgagcccaagccgtgtctggtctatcgggccgctgattgcgctcaatgtgtttgacggcggattgcgcaaggcgcaaacacaatctgcgattgccagttatgacgccacggttgctcaatatcggcagaccgttttaagcgcttttcaggag

SEQ ID NO: 62031 - DNA, 240 bp, Glycine max
  Peptide Sequence Number=SeqID_153716
atggatagtgcaaaacacatgtctacaccgatgagcactaattgttacttagataaagatgaatctggtcagtctatagacatcaaacaatatcgagaaaaagtacaagtggaacttgtcaatttattggatcggctcttgtctcatggcatagtaagaaacaaaacagtgttgctttatctactgctgaagcggagtatatctctgccggtagttgttgtgcacagattttatggatga

SEQ ID NO: 62032 - DNA, 90 bp, Glycine max
  Peptide Sequence Number=SeqID_153717
atggtttggtgggctgcgggaaaaagaaagagttttcagaggagaaaagagaaaaacgaaaatgaggcgaagaggaggcacctgacttaa

SEQ ID NO: 62033 - DNA, 108 bp, Glycine max
  Peptide Sequence Number=SeqID_153718
atggagggtacatccacttggtttttcaaagagaacaagggagggcacggtttgtggccaaaccagtataaatcttcggttggtcttcttcttccctacactctttaa

SEQ ID NO: 62034 - DNA, 799 bp, Glycine max
  Peptide Sequence Number=SeqID_153719
atgaatactgaagccactcacgaccaacatgaagcactctccactggcgttcgtcttcgcaacgcccgtgaacaactcggactcagccagcaagccgttgcggaacgcttgtgcctgaaggtttccacggttcgcgatattgaagaagataaggcgcctgccgatctcgcttcgaccttcctgcgtggctatatccgttcctacgctcgcctcgtacatattccggaagaagaactgctgccgatgatggcgaagcaagcgccgattcgcgccgccaaagtggcgccgatgcagagcttctcgctgggtaaacgtcgcaaaaaacgcgacggttggctgatgagctttacctggctgattttgtttgtggttatcggcctgagcggcgcatggtggtggcaagaccacaaagcgcagcaggaagagatcaccagcatggccgatcaatccaccagcgatctgaacagtagcgatagcggcagccagtcaattccgctggataccagctcggcgaataatgcgccggatacgacggcagccaataccaatagcgcgccggtcgatacctccaccgcacctgcgccaagcgcgccagcggctacccccgcgccggtggataacaacgccgtggtcgctccttcgcaggctaacgtcgatacctccgccgccgcgccggctgcgccagccccgacctccgcattgccgaccgatcaggcgaatgccgcgacgactgcttccgctcaggatctggtgatgaactttagcgccgattgctggctggaagtgagcgatgcgaccg

SEQ ID NO: 62035 - DNA, 1115 bp, Glycine max
  Peptide Sequence Number=SeqID_153720
atggcgcaggcctggacagaagacgatttcggcagcagcgaaagcaaagtgattgttgccgcgccagtgattactgaactgaatacgccgcgcttcctggcaagcggcgatacttcacgcttaacgctggacctcaccaacctgaccgatcagccgcaaacgctgaacgtggcgttaaacgcgaccggcaaactgacgctggaaggggcgcagccgcagccggtgcgacttgccaccagcttccgggcgagacctttgccccgcagcagaagagctggaaaatcggtggtccgtccggcgttcccggcgcaagacggtgaattaccgggggccatgctgaatccgggtgagtcctggacagcgccggggcagcatatcaacggcttctctcctgcaacgctgcaggggcaactgctgctgagcggtaaaccaccgctcaatctggcgcgctatatccgcgagttgcaggcttatccttatggttgccttgagcaaaccaccagcggcctgttcccgtcgctctataccaacgcggcacagctgaaggcgcttggcatcaaaggtgatacggacgacaaacgccgtaccgccattgatattggcatctcccgtctgctgcagatgcagcgtgatgacggtggtttcgcgctgtgggataaaaacggtccggaagagtactggctgaccgcctatgtcactgacttcctggtgcgcgcaggcgagcagggttacagcgtgccggccgacgcggtcaataacgcgaatagccgtttgctgcgctatctgcaggacccgggcatgatgtccattcgctacagtgacgatacgcaggccagcaagttcgctgtgcaggcctatgccgcgctggtgctggcgcgtcagcaaaaagcaccgctgggtgcgctgcgtgaaatctgggatcgtcacgatcaggcggcttccggtctgccgctgatgcagctcggtatggcgcttaagctgatgggcgatgccccacgcagccaggaggcgctggatctggcgctcaaaacgccgcgtaacgacagtaaaacctggatggccgattacggcagcacgcttcgcgataacgcgctgatgctctcccttctcgagga

SEQ ID NO: 62036 - DNA, 452 bp, Glycine max
  Peptide Sequence Number=SeqID_153721
atggaccaattcttaaggcctgacctagcctatttcaaagcccaggctgagatatgggatgctatcaagtctagggtggaagaatatgtctcattctactacaagtcagataaggaacttcaaaaagaccccgagctccaagcttggtggaaagaacttgtagaggtgggtcatggggatttgaaggataagccatggtggcaaaagatgcaaactcgccaactattagcaggagattcatgcctgagaaaagggtctcctgaatatgatgcgttggctaagaaccctgagaaggagtttttgaagactattacaagcaagaaagagaccctcattgaccttacagttatagaaattttatcaaggcacacatctcatgagttctaccttgggcagagagatggtggtgactactggacttctgatgccgggccattagaggcctttaagag

SEQ ID NO: 62037 - DNA, 575 bp, Glycine max
  Peptide Sequence Number=SeqID_153722
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagcca

SEQ ID NO: 62038 - DNA, 201 bp, Glycine max
  Peptide Sequence Number=SeqID_153723
atggcggctgaacacgccaaggcagaggcggcgggcggtgggcagcggagagcttgtggtggcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 62039 - DNA, 201 bp, Glycine max
  Peptide Sequence Number=SeqID_153724
atgtctctcctttccctcattttcgttttttcccttctcctctcaaaacccttacttttttctcgcagcccaccaaacctgtctcagaaaaatgacgatcttggactcattcaccgttggatcgtcgtgaaatttgagcaccacgttcgcaacccaattccgagcattctaactgttgggaattttgatatcacgtcttga

SEQ ID NO: 62040 - DNA, 426 bp, Glycine max
  Peptide Sequence Number=SeqID_153725
atgaagggcaagtatattgttcaaagcttgttaaagaacttagaaaaaatcaagaacaagcttgttcgcacatcgttcgcgtgtatgacatccactccacaagcttgtggttacgtgagcctgaactactaccaatatatagatgttgtttatataaatgagcacatcttaaaagcttactccccacaatggtggcctcttgggaatgaagcggctattcctccttctaatgacgcatggacacttatccctgacccaactacaattcgtgcgaaaggtcggccaaaatcaacaaggataaggaatgagatggattgggtcgaaccatctgaccaccgaaaaaaatgcagtagatgtggagccgaagggcataacaggcgtcgatgtccaatgcaatctgagcgtgggagttgttcaaatcattga

SEQ ID NO: 62041 - DNA, 335 bp, Glycine max
  Peptide Sequence Number=SeqID_153726
gatcccgaggagctaccccccgagcctgttggggatgttcttgactttctagagggtgatgaggacccacttcctgaggtggattctcccgaggaagtcatgtcggcatctgaggcagactctacggaggatagtggcccgggggagatggcgatcagcggaggctcttcatcctacctgagatctttgcctcaacacattggagggtacatcctttgtggtacaagtagagagtacatctacttgggtttgactgagaacaagagagggtacatctcttgtggatcagttctagtggagggtacatccactaggttcaaagagaacaagggagg

SEQ ID NO: 62042 - DNA, 315 bp, Glycine max
  Peptide Sequence Number=SeqID_153727
atggctggagcaggtggtggtggtgacgagtatcatcagttggacggagctcaacgtctgttactggatgcgatgaatgcacagatgcaacgtttgctggaccgtaccaatgaggaggtctatggacgactagaagctttggagaaccaagccaatcagcatgctagacgaaatatagatgggaatagaggtaacaatggcggtaatgacggaccgaggcagaaccgggttgagggagtaaagctcaatgttcctcccttcaaaggtagaagtgatccagatgcctacctggactgggaaatgaagactgagcac

SEQ ID NO: 62043 - DNA, 115 bp, Glycine max
  Peptide Sequence Number=SeqID_153728
atgccggcagaatgctcctaccccaccatgcctggccctttaccttaccttaagaaagaaaagaaatgggggtatgaagcgtgggaaagaatgagagaagtgtctgatacaacag

SEQ ID NO: 62044 - DNA, 330 bp, Glycine max
  Peptide Sequence Number=SeqID_153729
atggggctccgaaaaaagtggagaatgaagaattggcgaacagcgctacacaataacttcgcgggactccagactcgttggtggaggacacatgaacagcgactaggcaataaattcatggggctccgaaaaaagtggagaatggagaattggcgaacagcgctacgcaataacttcgcggggctccagactcgatcggtggaggacacatgtacagcggtaggcaataaattcattgggctccgaaaaaagtggagaatggagaattggcgaacagcgctacgcaataacttcgcggtgactccagactcgaaggtggaggacacatga

SEQ ID NO: 62045 - DNA, 171 bp, Glycine max
  Peptide Sequence Number=SeqID_153730
atgcaatcctcccaaggaaagggaccaatcactagaaccatgagcaagaggctccaagaagattgggctagagctgctgaagaaggccctagggttctaatgaaccttagggtagggtaccctagaaatataggatttttcagcccttgtatttttgggcacctagactag

SEQ ID NO: 62046 - DNA, 255 bp, Glycine max
  Peptide Sequence Number=SeqID_153731
atgtactctctcttgttctcaatcataacaacccaagtagatgtaccctctacttgtaccacaaaggatgtaccttccaatgtgttaagacaaagttctcaggcggttagtccttcgaaactttgtgaaggggatacaaaagatatctcaggcgggagaagagagacacaaaaagaattcaggcggttagtccttggtgaattctttttggcaaagggagaagagaatgaaaagatgaataacacaagtttttga

SEQ ID NO: 62047 - DNA, 273 bp, Glycine max
  Peptide Sequence Number=SeqID_153732
atggtgactactgccgcgatccagcactccctccagcgcatgacaggtatcctagccgctcgtttggaggctcagtcgtccagatctcctatacaaggtctcgggagaacgtctcctggcaaccgactgggaaacgccgcatcaatgacgagattcgccgatcagatcgacaacgccaagagctcatggctaagaagcggcgcctcaatcaagatgactccgccgatctccgccgcaagctcatacatcaacgccacacacgccgagaggacc

SEQ ID NO: 62048 - DNA, 606 bp, Glycine max
  Peptide Sequence Number=SeqID_153733
atgcactcactgggagatttgaatctgctgaagattcaagtgatacagatagtgaaatcacttttgatgagcttgctatatcctatagagaactatgcatcaaaagtgaggagggagattcttcagcaagaagcacttgggaactcaaaggaagagtcgattgcaactattggactacaaaggaggcattcgagaaatctgaagatgaaggaggaagaattgcttgggaagaagttggaaagatccagagaggacttgggtttaatcataaagtcatctggcagaataaccatgacagaatttgttcctgccaaaaacagcactggagccacgatgacaacattggtctcgactaggatcatggaacgcagcagaaaaagagcaaaagaaagaatctggaggtgtcactatgtgaagaaagaaacatcaggaaaggaagtgaacaccagaaaaggtcagatgaaaagcccagtcacagcaaaggaattcaatgccatggatgtgaaggctatgggcacatcaaagccgaatgtcccactcatcccaagaagcagaggaaaggactttctgtatgtcggtctgatgatacagagagtgaacaagaaa

SEQ ID NO: 62049 - DNA, 267 bp, Glycine max
  Peptide Sequence Number=SeqID_153734
atggtacatctcttgtggatcagttctagtggagggtacatccacttggttgttcaaagagaacaagggagggtacatcccttgtggatctttgcttgtaaaggactttacaaggttgaaaagaaatctcaaggaccacaggttgcttggggactggatgtaggcacgagttgttgccgaactaacatgcaaagtgggttccaatctaaaccgtttgatgtagaaatgagagatagcttggaggatatgattcatgaccttggataa

SEQ ID NO: 62050 - DNA, 410 bp, Glycine max
  Peptide Sequence Number=SeqID_153735
agaattcaagggactaaccgcctaagaattctttgtcctaacacattggagggtacatcctttgtggcacaagtagagggtacatctacttgggttgttatactgagaacaagagagggtacatctcttgtggatcagttcaagtggtggatacatccacttggttattcaaagagaacaagggagggtacatcccttgtggatctttggcttgtaaaggattttacaaggttgaaagaaatctcaagaaccattggttgcttgggaactgaatgtaggcacgggttgttgccgaaccagtataggtcaaatctaaaatcatttcaagatcatgatgaagatcaagccaacttatgtctcatgaaaaaatctcatgagaacaacaaggaaggatctgtaaggaagaagtg

SEQ ID NO: 62051 - DNA, 441 bp, Glycine max
  Peptide Sequence Number=SeqID_153736
atggaagaatatgcagtagaatccttcagtactttacaagaaatatcttctaagcagagtaggaaagatcaccaaagtattacggacaccattcgccccacaaaaaaggcgaatgtaaaaaaggcaaaaatcaataaaaatagcgcacctcctcctccatctcctcctcgtgtagaaaaaaatggatctaagaaagcaaacatgagtggagatcagaacatcccaccacctccgcctccggcgagcacttcttttatccaggcagaattccctcagggaattaatgaattccgaaacaaggtggcaaaaaattttaacggtagtgtatttaaaggagatgaaggccggctccaatctaatgtattcatttcaataaatgccgaagggacagtagaaaaagtagtggcagatggaaaaaacaaactttttaatgacgagagc

SEQ ID NO: 62052 - DNA, 339 bp, Glycine max
  Peptide Sequence Number=SeqID_153737
atgtcgtcaccttcaaaggactacacgtcctcgccttcagaaggttacatgccctcgccttcagaggactacatatcctcgccttcagagggctgcacgccctcaccttcagaggactacacaggacaacaaatcctctccttgaaaggacttcacgtcctcgccttcagatggctacatgtcctcgactttagaggactgcacgtccttgcctttagagaactgcacgtcctcgccttcagagggctgcatgcccttgccttcagaggactacacgtcctcgcttttagagggctccacatatgcgccttcggtggacttaaggtcctctgcctttaa

SEQ ID NO: 62053 - DNA, 249 bp, Glycine max
  Peptide Sequence Number=SeqID_153738
atgtatctagaaggggtaaaggcacgtgtggttctatttggaaatcgcgatgaacgcgctaaacgcgcctcgcattcatccctgctagtgaacgcaagtgatgagcccgctaagtgcgtctgtgcgctaagcctgacctgtccggctaagtgccactatgcttctatggcatctaagaaaaggaaggcaccttctacacctacccaggccagatttgatagatccaggttcacatcccaagaggcttga

SEQ ID NO: 62054 - DNA, 351 bp, Glycine max
  Peptide Sequence Number=SeqID_153739
atggagagggttaccattactggaaaacccaaatgcaaaattttcattgaagcaaatagacttaaacatttgggaagccatagaagtggaccttatgtacccaccatggtggctggaaatacaacaatagagaaacctagagaagagtggtttgaagaagaaagaagattagtgcagtacaatttaaaggctaaaaacattattacttctgccctaggaatggatgaatatttcagggtttcaaaattgatgaagacaaatgaaagtatacaagatatgcagaaaagattcacacatatagttaatcatcttgcatcattaggaagaacttttcaaaagaagatctcataa

SEQ ID NO: 62055 - DNA, 801 bp, Glycine max
  Peptide Sequence Number=SeqID_153740
atgcgcccgcagttccgctacaacctgatttcgattaaagccgtatttaccggcgtgatcatgtcgagcatcgtgtttcgtattttgaacggcgaaggggcgattatcgaagtcggcaagttaagcaatgcgccggtgaataccctgtggctgtatctggtgctgggcatgattttcggctgtttcgggccattgtttaataccctggtgctgcgaacgcaggatatgttccagcgcctccacggcggcaatatcaaaaaatgggtgttgattggcgggcttatcggcggcctttgcggcctgctgggcctgatgcagccaacggcggtaggcggcggttttagccttatcccgatcgccgctgccggtaacttctcggttgggctgctgctgttcatctttattgctcgcgtcattaccacgctgctgtgcttctcttccggcgcgccgggagggattttcgccccgatgctggcgctggggacgctgctgggtacggcgttcggcatggctgccatcccgctgtttccctcctatcatctggatgccggtaccttcgctatcgccgggatgggggcgttgctggcggcttcggtacgcgcgccgctcaccggaattgtactggtgctggagatgaccgataactatcagctcattttgccaatgattattacctgccttggggcaacactattggcgcagttcctcggagcgtaccctggcgaaacagaaggccgaagaggcggcgaaagcgcagcaggtaccccgggagaatacttgaacgatttaccagggtattag

SEQ ID NO: 62056 - DNA, 486 bp, Glycine max
  Peptide Sequence Number=SeqID_153741
atggagagaagtatgatagatgctgccagtggtggagcccttggagacataacccctgctgaagctagaaatttaattgagaagatggcttccaactcccagcaattcagtgccagaaatgatgctattgtcattagaggagtgcatgaagtagccacgaattcatcttcatcaagtgagactaagaagcttgaaggtaaactagatgccttggttaacctggtaatccaactggcaatgaataaaaaatctgcacctatcgccagactttgtggtttatgctcctctgccgaccaccacacagacctttgcccttctgggcaacaatctgaagcaattgaacagcctaaagcttatgttgcaaacatctacaacagacctcctcaacctcagcagcaaaatcagccacaacagaataactatgacctctccagcaataggtacaatcccgaatggaggaatcatcccaacgtgggatcctctaga

SEQ ID NO: 62057 - DNA, 155 bp, Glycine max
  Peptide Sequence Number=SeqID_153742
agccctacaatgctcaaaggggacaccccgaaggcttctccgtgacaaagcacacgttgcgttcgagtttgtttttctcggagaaaagaaaggttgatggagccttggttggggggatggcctttgtggataactgggcggtgggtaaggagaag

SEQ ID NO: 62058 - DNA, 270 bp, Glycine max
  Peptide Sequence Number=SeqID_153743
atggcagcagaatggagaaggaagcagagagagaggagaagccacttcaaggagaagatgagtcaagaagaagctcaccaccataggaggccatggataagagcttggagaaaaaaggagttgaatgaagggagaggaagagaagagcacgaaatgttgtgctctaaaagagctatgaaatctgaaatatggttcagcccactaatccaagatcaagtccaagattctccactaagtgtgcttaggtgtcatgaggcatgtaaagcatga

SEQ ID NO: 62059 - DNA, 777 bp, Glycine max
  Peptide Sequence Number=SeqID_153744
atggctaccgcaccaaaagaaacttcagctcctggttcatcctctgtaccatcatctccatcatccaccaaagcaccatcacaccaggaacgacctgaattcaatatccaacccatccaaatgattcctggttcagcccctgttcctgaaaaactggttcccaaaagacaacagggagtgaagatttctgaaaaccctagccctgcaacaagtcctagggaagtagacccggagatggataagaagatccgcagtattgtgagtagcattctgaaaaatgcgtctgtccctgatgctgatgaagatgttccaacatcctccaccccgaatgtgtctgtccctgatgctgacaaagatgttccaacatcttccaccccaaatgctgaagtcccctcttcatccagtaaagaggaatcaacagaggaagaggatcaagccacagagaagacccctgcaccacgggcaccagaacctgctccaggtgacctcattgaccttgaagaagtagaatctgatgaggaaccctttgccaacaggttagcacctggcattgcagaaagacttcaaagcagaaagggaaaaacccccatcactaggtctggacgaatcaaaactatggcacagaagaagagcactccaatcacttctaccacatccagatggagcaaagttgcaattccttccaagaagaggaaagaaatttcctcatctgattctgactatggtgtcgaactagatgttcccgacatcaagagggccaagaaatcagggaaaaag

SEQ ID NO: 62060 - DNA, 231 bp, Glycine max
  Peptide Sequence Number=SeqID_153745
atggcagcggaatggagatggatgagagaaaggagacgccacttcaaggagaagatgagtctagaagaagctcaccaccataggaggtcatggataagagcttggaggaagaaggagatgaatgaagggagaggaagagaagatcacgaaattttatgctctaaaagagctctgaaatctgaacccactaatccaagatcaagtccaagattctccactaagtgtgcttag

SEQ ID NO: 62061 - DNA, 378 bp, Glycine max
  Peptide Sequence Number=SeqID_153746
cgtgacgactcccgcgggacaccgtctccgggcccccgggagtcgcacttaacagatttgagtttccttggcgcacgaagcgccggggtttgtgtttgtcgcgaggacgaggaggccgggcgcacgggggcgccgtggtcatcccctccctcccgacggttcagtggacttctcacaacgtcgcgggcagcgaaccgctcacgtcgccgcaatccgaacacttcaccggaccattcaatcggtaggagcgacgggcgattacccggacctgtcggccaaggctatagactcgttgaatacatcagtgtagcgcgcgtgcggcccagaacatctaagggcatcacagacctgttattgcctcaaacttccgtggcctaa

SEQ ID NO: 62062 - DNA, 768 bp, Glycine max
  Peptide Sequence Number=SeqID_153747
atggcccgcaccaagaagacagaggagatgacgactgaggccgcaaaggaaatcgctgagaagattaattcgtttgaggagcaggccacacagggattgttcgtcccccatggacatcaggatgttcaggccgctgctattggatgtccagagcaccctggacgtgtccgtgctgctggagccggtgtcaccatcaagcaatactttggatcggctccacgaacgtcccgcagtgcttcctccctatctcctgacgaattacagcagctgactcagcagatcagggaccagctagaggagtccatcacagagaaagtgacgaggcaggtcatggcatccttcagccagcttcagtcacagatgcaatctcatggacctcctgagcctctctggttggtcctggtccctccgatcctcgggtgcggcttctacatagaagcagatcctgcccgcctagtttccgtggggagagtttatgagggatccactcttgttcataacactcctttgttgcctgaccaagtaaaggtgagtgcggacgaggttaaagatgcagatgctccagttcctatacccactgatgatgtttccttagtggggcaggcacttcacaccttccttgcttggccgacacatctggtcaagtctttatcacaccaggtagctgtgtctccgccaaaaccacctctgaagcccgacccgaaggtcgatgatccgctttatctgatgacattgaccatcccagagcttttcttgaggccttatcag

SEQ ID NO: 62063 - DNA, 300 bp, Glycine max
  Peptide Sequence Number=SeqID_153748
atgaagaaacaacaatggaagagaagcagaagacaaaggagaagaggtgagaggaggcaccatccactagggaataagccatggaagaaggagcttcaccaccaagatgagccttggataagaagcttggaaggatgcttcaatggaggaaaagaaagagggagagaaagagagatgggggggagcacgaaattgaaggaaaaaaagagggagagaagtggaactttgaagtatgtctcacaagactctcattcatcaaagttaccacaagtgttacacatgcttctatttatagactag

SEQ ID NO: 62064 - DNA, 258 bp, Glycine max
  Peptide Sequence Number=SeqID_153749
atggttgagtcagaaagactctcttacatcagaaacaaccaaaaaaaacttcgagttgacaagttttgtagcttacaacagtcattggatgatggaagtaggagatgcctaaataaagtcatgtgggcttcccaaatctggtttattactttaacctgcaatccaaactggcctaaaatccatagattgctgaatttgttgaatctgaaagcagcagataggccagacataatctccagtcttcaaactaaagtatga

SEQ ID NO: 62065 - DNA, 207 bp, Glycine max
  Peptide Sequence Number=SeqID_153750
atgtctcttgccactctatttggaaagttacaggaacacgagatgaaattattgagattacgccaacatgaagaaaatgacaagaaaaagaaaggaattgctcttaaagcatcatcttcaatccaagaagaaagtgataaggaaaatgatctagatgatgatgatgatctaagcctttttgtaaaaagattcaacaagtttcttaaa

SEQ ID NO: 62066 - DNA, 367 bp, Glycine max
  Peptide Sequence Number=SeqID_153751
atggttgagagagagatgatcactatgatggtagacactttgccagtgttctactatgagaagctaaatcgaggtagggttgaaaagagggaaaagttcgattacgtttcctccacgagtgcgaatgccaaaagaatcggggcaacgggggcaaaaaggaaggaaggagatgcccatgccgtctcttcaacacccgcgtgggtcaaacccccgcagacacctcatggtacccatcagtacgcgcaacatcacccgagcttctcgactcataccgggaacgcctctagttcagcacctgtgcagcctaaggcacccacccagagggaagctccccaagtgccaactccgaacacaactcgcccggcca

SEQ ID NO: 62067 - DNA, 269 bp, Glycine max
  Peptide Sequence Number=SeqID_153752
atggtagccataaccctagccaaggttcatcaacctccatttctccgagaaaacgactcgaacgcaacgtgtgcttgtcacggagaagccccggggcgttccattgagcattgtagggctctgaagcgtaaggtgcaaggtctaattgatatgggctggctgaaatttgaggagaatcgcgtgattttcaactttcaccggaagtgggtgctagccattggtctgtttgctcaagcgacctgtgctcctgagtttggacttccaagacc

SEQ ID NO: 62068 - DNA, 521 bp, Glycine max
  Peptide Sequence Number=SeqID_153753
ccaattcaattgaacatgtttatagatgggctgagaccacaaaccaagcagtggttgtaccatttgtggtggtgctcatgaatccagcaattgtattcctttggaagaacaaacacaggaagttagttacatgggaaatcaacaaaggcaaggatacaaccaaggaggattctcaggtttctagcaaggtccctacaatcagcaaggacaatggagatcacaccctgagaactaccaaactggaagaaaccctggctcaattcatgcaagtgaccatgtccaaccataagagtactgagttagccctgaaaaacattgagattcaggtgggtcaactggccaagcagttagctgagaagtcatccgacagattttgggcaaatactgagaagaatcccaaagaagagtgtaaagctgttgtaacaagaagctggaagcttgtggcggctgaggatgaggatgttgttgctttgaaggagcaagttgccttgaaggacaccactgttaaaaagaagaataag

SEQ ID NO: 62069 - DNA, 280 bp, Glycine max
  Peptide Sequence Number=SeqID_153754
atggagaagtctgaaaagaaaaatattaatgaaaagaaattgaagaaagcatacattacatgggatgaaaatgatttggaatcttctgaagattcagaaaatgaagaaataaacctctgccttatggcaaaaagttatgaaagtgatgaagaggaacccttgtggaaaaagtggtacatagatagcggatgctcaaaacatatgacgagagacgaatcaaaattcacacatatctctcccaagaaaagcggacatgtaacttatggtgacaacaacaaag

SEQ ID NO: 62070 - DNA, 129 bp, Glycine max
  Peptide Sequence Number=SeqID_153755
atggctactctagttgtttcaaattcaacttcacctgttgaagatgccgatgaggcttttcaaaagtccttcgaagctttgaatggtggttgcaactttctttatttcatcatcgcattcaataattaa

SEQ ID NO: 62071 - DNA, 162 bp, Glycine max
  Peptide Sequence Number=SeqID_153756
atgagtcaagaagaagttcacaccataggaagccagaataagagtttgaaggtaggagaagatgagtcgagggagagggagagaaggagtacggaattttgtgcctcaaatgagcccactaatccaagatcaattccaagattctccactaagtgtgcttag

SEQ ID NO: 62072 - DNA, 306 bp, Glycine max
  Peptide Sequence Number=SeqID_153757
atggcattagcgtgtgatttttgtagggaaacaacctatgggacaattaggtttagaataggtagcaaaatacctttggcaatttacactttggggcgtggtagcaaaatacttggatgtattagaaataccagaatgtgcacgtatgcaatttttgatagccaaagtgctttgagtatgcatgtatgtaaatttagcaaaggaaatgcatgtgatgtaggtagcaaatacgccttggaagtacatataagtgatctaggaaatggccccgaggaagcttgcctcaaagaggtccaggaaggataa

SEQ ID NO: 62073 - DNA, 549 bp, Glycine max
  Peptide Sequence Number=SeqID_153758
atggtcgccattttgcctaaggaaaatcttgttgtctggttttattccttgcataataggccaaacaactacctaaaaggaataattaacagtgctttgaaaggacttgacgatattccacaacctaaatccaaggctggtgctaggtggattgttgttaaagaactttcaggaataattaagaaacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 62074 - DNA, 480 bp, Glycine max
  Peptide Sequence Number=SeqID_153759
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatagcgtacatcctttgtggtacaagtagtgcgtacatctacttgggttgttatactgagaacaagagagggtacatctcttgtggatcagttcaagtggagcgtacatccacttggttgttcaaagagaataagggagg

SEQ ID NO: 62075 - DNA, 219 bp, Glycine max
  Peptide Sequence Number=SeqID_153760
atgatgggagatgcatcaaagttcactcatatttctcccaagaaaagtgcacatgtgacttatggcgacaacaataaagatccttcctcgcgcttagccactaagtgttgcgtgtggcggacgatcgctaagccagcatattggcttagcgaggaggtgaaaaacaacactttgccaaatcgcctaattcacctgaaattgagagaaattgattattaa

SEQ ID NO: 62076 - DNA, 270 bp, Glycine max
  Peptide Sequence Number=SeqID_153761
atggctcgcacccatattccagtggaagcaaagatcgattctcctcaaatttcagccagcccgcatcaattggaccttgcaccttacgcttcagggccctacaatgctcaaaggaattccccggggcttctccatgacaagcacacgttgcgttcgagtcgttttttcggagaaatggaggttgaggaacctgggttggggttatggctatcattgaatcatcgagtggatatgggagcaagtcatcataggacaccggaattagggtga

SEQ ID NO: 62077 - DNA, 438 bp, Glycine max
  Peptide Sequence Number=SeqID_153762
attcattccaaaaaaagaaataggcttgagcacaagaggttgcatgatttggtgtttgtcaaatacaaccaacaattaaggcaaagatataatgcaagagatgaaattaatccaatttctcttaatgatattgatgcttcgagggttggagagtataggatgtatactaggcggaaaaagcaaaaaacaacaagtgttgttgctgcacaaacttctaaaaaacatgcaatggttgttggatcttcatcaaggaagcaaaaagaagtccaagaaaatgatgaggatctagattttgaggagaatattaatcttgaatctgaagaagaagaaatcatggtcaattttgaggcgtctgatggggaagagggagagggagatgctccattaccatatgataataacgaagatgattatgttgggattggagaagatgattag

SEQ ID NO: 62078 - DNA, 542 bp, Glycine max
  Peptide Sequence Number=SeqID_153763
tgttgcttgcgctaagcactgcccccttgggctaagcgttattcgttgcgatacgcataaggctaagccagtgctgctcactaagccattatacactgacaacattctcagccgaaatattcttccggagagaaatgtgaagctttatcatactgagtttgacgagttcaaggtggagttggagaggcataatcataatcttcacaaacgcctcgctaacctccaggatggaagcacaaacgtggctctggttaaggaattctatgctaatttatacaccatagaggaccaagctccaaagcaagccagagagattgaagctaggctttgtattccctacaaggagtttgttttgaatgctgaaggccagccatggaaacttctcagaaaagatctgatgacactggcccaaacatggagtgtcttctcttactctaacctagctcccacatcccacacctcagatttgaatatggatagagctaggttggtctatggcttggtgactaacatggacatgaacatcagagcccttatctcag

SEQ ID NO: 62079 - DNA, 531 bp, Glycine max
  Peptide Sequence Number=SeqID_153764
atgaagagaaagagcactgcttctagacctgtaactcagtatgataccaggcgattccaatctttggaagcttggaatagatacacggacaacattctcagctggaatatccttctggagagaaatgtgcagatttatcatactgaatttgacgagtttaaagtgaagctggagaggcataatctacacaaacgcctcaccaacctccaggatggaaacatagacatggttgtggttaaggaattctatgctaatttatacaccccagaggaccaagctccaaagcaagccaaagtaagaggacacctgatcaaaatagatgcagacagcctgcatgagtttcttcagactctagtggtattagaggagggggaatctttacccacttactctagattttgcaggttgaggtctaatcctcaggagattgaagccaggctttgtatttcccgcaaggggtttgttctgaatgttgagggccaaccatggaaactccttagaaaggatctgactatactggcccagacatag

SEQ ID NO: 62080 - DNA, 366 bp, Glycine max
  Peptide Sequence Number=SeqID_153765
atgcctcccgaagaactggagcaactgactcaacaaatcagggaccagctggaggagtcgatcacaaaaaaagtgactcagcagttgatgttatccttcaaccagatgcagtcccagttgcaatcacagatccaatcacatggacttgcacggcctttggagcctgaggttggtccctcaactgctcgtgttagcacaaaggggagttgtgttgatccctcaccgaccgatccagagacgggtgactcagacaaatgccggttgtacatcgaagacaatccttctcgcttggttgccctaggaagagtttatgagggatccacaatggttcacacatccctttgttgcatggccaagtcaaggtag

SEQ ID NO: 62081 - DNA, 351 bp, Glycine max
  Peptide Sequence Number=SeqID_153766
atgccttatgctaacctactaccatctttgattagcaaccagatggccttcaaacacaaggtacaaagcttgattgacgtgggatggttgacgttccaagaggatagtccgaatgtaaggactaatccactcgccagtcatggaggctcgacggttaatgcagtggaagagtgggagcctcaggggctaaagcagatgggagacgtgataacctatagaaggttcattttggaagcacaatgtgaatttggtatgatttgccttgatggggaccagggagatttttgtttaatgcattcgggggcatcacatgatgtggagacgtgcccaatggcagaagagttgttatag

SEQ ID NO: 62082 - DNA, 270 bp, Glycine max
  Peptide Sequence Number=SeqID_153767
atgggttctccacctgtctccactcctcctcctcctccttctcctcctcctcatcctacttcggacgcatcggcttcgccgtctgtcgtgaagcaggcacgcaaagcctcatgtctacgatcgttgtccactagaccacctggtgctgagagaccagtggtgcatgctgatcctgctaccgggaaggccgatggtccccacaggaagaaattaagaacatatttggggattgtggcgcgtgataaggtggacatcacctacgagaactag

SEQ ID NO: 62083 - DNA, 162 bp, Glycine max
  Peptide Sequence Number=SeqID_153768
atgactaatgcaaactgtccgcaagaatcattgcattcagtctcaaaagagaatctaagacaaatattgacatcaacagttgtttgtatagcatattacattcttgacatacaagagtatgggattctagtgtgggtagtaaaagagaaatccctcccactg

SEQ ID NO: 62084 - DNA, 302 bp, Glycine max
  Peptide Sequence Number=SeqID_153769
gattcacaagcgattcccctcaaatttcagccaccctgcatcaattagaccttgcaccttatgcttcagggttgtacaatgctcaatggaatgccccggggcccctgcatgataagcacatgtttcattcaagacgtatcctcgaaaaaatgaaggtcgaggaaccttggctggggttatggcaaccattgaatttatcaagtgatgtttggcattcgtcgtgtggtaggcaggtgtcataccctaatttcgtctggggaccattgtttgatggcatgcaacctttgcttgaccgcttcgag

SEQ ID NO: 62085 - DNA, 138 bp, Glycine max
  Peptide Sequence Number=SeqID_153770
atggatgtgaaaacaacctttcttaatggtgatttagaggatgaggtttttatgaaacaacctgaaggcttctcctctagcaatgatgatattttacttacagcctatgatccgggtttgctacatgaggtgaaataa

SEQ ID NO: 62086 - DNA, 271 bp, Glycine max
  Peptide Sequence Number=SeqID_153771
atgccacccaagtttgaccatattgtggtagccatcgaggagtccaaaaatcttgaagagcttagcctaaaggaattgcaaggatctttggaatctcatgagaagaagatgatgacatttgaacaggtactgctaatggtaactactcaaattgaaggggcaagtgataattgttggtacctagacacagtgctgaaggaatttggaagatcccttatcaaaacaaaggatggaggtcagtcttgcatcactgatgtactctttgtaccag

SEQ ID NO: 62087 - DNA, 390 bp, Glycine max
  Peptide Sequence Number=SeqID_153772
gctgtggaaagcctccagcgtttccgctaccggggtttgcggatccggccagtgggaaaaatagaggtcgatatagtcggtattgaggcggcgcagggagtcgtctaccgcctgctggatccaggctttgctgagtcccttatggccgggaaggccgagatcggagccgactttggtgaagattttgaccttatcgcgcatgccgggacgcgcctgcagccagcggccaataatggtttcggattcgccgccctggttgccctctgcccagcgggaataaacatccgccgtatcgatagcgtcaaagccgtggtcaacaaaagcatcaagaagggcaaaactggttttttcatcaatggtccagccaaagacgttaccgccaaacactaa

SEQ ID NO: 62088 - DNA, 636 bp, Glycine max
  Peptide Sequence Number=SeqID_153773
atgaactcgatttttactgaagaaaatctgctggcattcaccaccgcggcgcgttttggcagcttcagcaaggcggccgatgagctggggttaaccacctcagccatcagctataccatcaaacggatggaagccgggctggacgtggtgctgtttacccgcaacacccgcagcattgaactgacggaatctggttactatctgtttcgcaaggccaccgatctgcttaatgatttccatgcgataaagcgcagcattgatactatctcgcagggcattgaagcgagggtgcgcatctgcatcaatcaactgctatatacgccgcgccataccgcccgcctgctgcaggtgttgaaaaaacagtttcccacctgccagataaccgttaccaccgaggtatacaacggcgtctgggattcgatcatcaataaccaggcgaatattgctatcggcgcgccggatacgctacttgacggcggcggaatcgattataccgagatcggcgcgatccgctgggtgtttgctattgccccggatcatccgctggcgtttatgcccgaacctatttcagaaagccagttacgcctctatcccaatatcatggttgaggacaccgccagtacgatcaacaaaaag

SEQ ID NO: 62089 - DNA, 279 bp, Glycine max
  Peptide Sequence Number=SeqID_153774
atgtctcagaaaaacaacgatcttggactgattcaccgttggatcgttgtgaaatttgagcaccacgttcgaaaccatattccgagaattctcaccgtttggaattgcaaaaacatggagagagaaaaaggaatcgcaccaagacaatacttatggaggcttcaatcccttctctgtctcacggacgtttgggaactctatcggagtaatcggagtaaaaattggaggaatctcagggaatcgctagagatgccactatcgttgtcgggagacacgtga

SEQ ID NO: 62090 - DNA, 357 bp, Glycine max
  Peptide Sequence Number=SeqID_153775
atgagtgagatagaaagatttggaggtttgggaatggaggaacgtcgcaaggaggaaggggctgcgcatggattgctggaaaatgtgatatttatagagcaggacgcgtggaggaggcagcctactggtaatcgattacatgaatactataatcgattacaggccatttgttctagtgtaatcgattacagtattcatgtatacgatcaagaaggataccatagtcagataattgttgcttcatccataaaatctgtgcacaacaactgccggcagaaatatattgcgcttcagcagtggataaggcaacactgttttgtttcttactatgccatgagacaagagcggatccaatga

SEQ ID NO: 62091 - DNA, 373 bp, Glycine max
  Peptide Sequence Number=SeqID_153776
atggataaccatgagcatgcaaatcatcgtgatacagcacaagccaggataaagaataaaggtatcaggcagcacaaagttaatgacgaggctcagaatattgattgctgtgtttcagtttcttcacctgaaaaccaaaattatatgtcctcagctaatgaccccgcaattaatagagaaggatattctggtcttggtgatcagctcatgcagtgtagtcactgtaatgcaaatatgtggtatgatgaaagagtctcaaaagataaaagaactacaaatccaagattcagtttatgttgtggaaatgacaaagttgaacttccattgttacagaatccacctaaatatctctaccaacttttgtatgatcatg

SEQ ID NO: 62092 - DNA, 558 bp, Glycine max
  Peptide Sequence Number=SeqID_153777
atgaccaccctgactcagatctggatgactttgctgctcagcaacatccagcccagcgatcataattccgacctccccctgccgaagtgccagctggtgtacgccatcctaacacggatgagcattcacgtggctcagttaatcgctgatgccatctatctatttgtaggtatggcgcctaccaagcaccctctggacccggataagtccaacagggccctgggatttcctgctttgatcacaggactttgcctgtcgttcggagtccccgtcgcacctagcaaggtgattcggccgcccatcacccgagctttcattgagaagtattgcacacagagacaggcccaaagggatgctccgcaggtcgcagactcgccgccacctcatcaggctggcccagctggatcctttgatacggagcagtatttgcggcatttggttcgccagcaggcggccaaccaccgggctcatgtacagacccatgattgtctttatcagatgagtctcagcctgcagagccagggctttacttcttttccgtgccctactccggactag

SEQ ID NO: 62093 - DNA, 825 bp, Glycine max
  Peptide Sequence Number=SeqID_153778
atgaggggagcgccaaccgaagaaagtctctcgcctttccttgtgaggaatctaggcgcacaaagtctcaaggtgatacaaagagtccacaaggcgtggagaagtccgttgaggaaagacaaggagcttaggggcatccgtaatggcgtcatcggaggttatcatggatggctaagaattcacacgcgggggttagattggctctccaagttgaaagttattggtgaggaggacttcgaagctccggaggaagatgaagaagtccgagctctaaaattagagctagggaaggcaagactcgccaaggagaagttcaagtcagctgctacacacatccggaaggagtgcaccgagttacaagaggaaaacgtggccactgcaagagcccttgaacaagaaaccaaaagggcccgcaaggaggaatatggccgagagaaattccgaggagcattgtggggtagcaacaatgagctcaagctccgaagagaggagagagatcggtcacgggtgcatgacatgatcttaaaagaagagttagttgcttgcgcgaggtccaaaaggagtttggctcaacacttggaagccacgaagcaaagcatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttaaccttgaatggaagtcaagacctcccgcgtctattagccaaagcaaaagccatggccgaa

SEQ ID NO: 62094 - DNA, 231 bp, Glycine max
  Peptide Sequence Number=SeqID_153779
atggctcaaggattgtgctgttatttgtccttacaagagatgaaacaagcgaccaagaattttgatgagtcaaatgtgataggggtaggagggtttggaaaggtttacaagggtgttattgataatgggttcaaagtgtctatcaaaagaccggatccgcaatcaaggtcatgttactacacccttgaaaggattttctgggaccaggagttcaatttccacttcatttag

SEQ ID NO: 62095 - DNA, 612 bp, Glycine max
  Peptide Sequence Number=SeqID_153780
atggcttctagaaagagaaagagcattggtacaaggcccacatctcagtatgacacaaggagattctcttcattagatgcttggactagatacactgataatgttctgggaagaaacattttacctgagaggaaagtagagctatatcacactgagctagatgactttaaggttgagctggagaggcgtaatttccatagacgcctcaccaattttgcaaatgggagcatagacctggctttggtgaaagagttctatgcaaatttatacagttctgaggaccgtccaccaaagcagtccagagtcagaggtcatttggtgaaaattgatgttgacagtctcaacatattcctggagacacctgtggtattagctgagggagagactctacccgcctactccagatactacaggtgtggagtgtccttttatactccatgtcgcaacgtgcccttttgcgggcgagcgaaggcgaagctcacgggtgcgctttccaaaggaggaaagatgcacggagtcgccaccaacgcttatttgtggaaaatgtcagaaaagcagaaaaaaaccggtcgaaatgaaaattctaagttcggaagttgtatttacgcttga

SEQ ID NO: 62096 - DNA, 396 bp, Glycine max
  Peptide Sequence Number=SeqID_153781
atggcattgaagaaaaagcacagccgagttatggcaaacctgactttgttaagcaaaatgtctcagtatgcctacactttgaaagttgatgagaaaagcaacgtgtacaactttggagtggttcttttaaagcttgtaataggcaggaaactggttggcgagttgggtgatggtgtggacattgtgcaatgggcggtggagcggccaactatgtgcaaagttgttcaaattctgaccgagcttccaaaaccaccaagctcaaaacaaggagacttaacaatcatagaatcctctttgtcattatcaaacagtttagagtctccaaccacggcatcaaaggaacccaaagatcaacatcatcctcaattgccaccaaccgatctacttagcatttga

SEQ ID NO: 62097 - DNA, 144 bp, Glycine max
  Peptide Sequence Number=SeqID_153782
atggcctcctatggtggtgagcttcttctagactcaaaggaatccattgatgaagaagatcctaggcctacaagctccagtggagcttacatcatgtggtatcaagagcattttcatctaggatctatcatttttcattcataa

SEQ ID NO: 62098 - DNA, 519 bp, Glycine max
  Peptide Sequence Number=SeqID_153783
atgcatcattcacatacatctatgcttttcacaacaatccttgaagtcagaactgtaatcattgttatcaaaaggaaagaacgcgctttacagtgcccttaccgaacgtgtgctagagctagagtaatgggtgaaatagaggaggtgcaagagcagatgaaggccaatatggaggccatgaaagagaaaatgaccacaatgatggaggccatgatgagcataaagaagataatggaggtcaatgtggctgtagttgtcgcaaccagcactattgctgaggtggacccgacttccccgtttggcctcaaccaaataaatcatccaacctcggatatggtaggacagggaggcaaggagttgggaagtacaggcgacccccattttgtgcaagttcagaacaagcaagccttcccgccatatggtttgcctcccaactatacaccacccaatgtggtacacactcccgatgagaatgtcaataactccactcccatactcattgagagccagcaaccttaa

SEQ ID NO: 62099 - DNA, 114 bp, Glycine max
  Peptide Sequence Number=SeqID_153784
atgtatgtgcctgagttaaacagtatcagaggcaaagaagttaacatagacaatgaaaggcttgagaagggagattatagtgaagtcaaaggaatcactacagcccaggtctaa

SEQ ID NO: 62100 - DNA, 114 bp, Glycine max
  Peptide Sequence Number=SeqID_153785
atgaagatgctcttgataccacatgatatgaatggcagcggaatggagaaggaaaagagagaggagacgccacttcaaggagaagatgagtctagaagaagctcaccaccatag

SEQ ID NO: 62101 - DNA, 654 bp, Glycine max
  Peptide Sequence Number=SeqID_153786
atggttggagtactgagaaaatgtttggaggaaaaagcaagaatcttggctggtagaggcaaatgggccccgttcatagacatcctcgcacttttgatcttcggaggagtcctctttccaaatgtggacgggttggtggacctagcagcgatcaatgcttttctcgcctttcatgactacaaggaaagcccggttgtcgctatcctagccgatctatatgacaccttcgaccgaagatgtgaaaagagcagtacaaggattgttttctgtactccggccctctacgtatggttggcttcgcaccttttccgccaagaggtgatacatgcttgcccactagaaagccaccgttcatgcacagagaaaagagaggcaagttgggaccgactcttagcaagcaaagaaggagtgtctgtcaactggttcccccgatggaaagaaagaagaaccggggttcttatttcgtgcggaggatttccaaatgttcccttgatagggacaaggggttgcatcagttacaatctcgttcttgttataagacaacttgcctaccctatgagaggggcaccactagaggaagagctcgcacctattattgcacggggtttcaataacaccaacgtggaggcgcttcagaaggtctgcaaggcatga

SEQ ID NO: 62102 - DNA, 249 bp, Glycine max
  Peptide Sequence Number=SeqID_153787
atgcagtgcaggccacagctgaatgggatatccttcagtaacattggccagcagcaaaatcagatgttggcactacttggaaaatggaggtgggatatgcttcagcaaagtaacaagttatggtccaagataatgcattccaagtatggtggatggagatcattggtggaaggcagtagaaggaataatgagtcagatgaattctatcctccaagatggcactacttggagggtgggatgcggggataa

SEQ ID NO: 62103 - DNA, 396 bp, Glycine max
  Peptide Sequence Number=SeqID_153788
atgtattgtcggaagacgggggcatacgcaaaagatgaggaactactgatacatttcttccaagaaggtcttactggggtagctgttacctggataggatacaactatagaacatatgcaaaaagggggcatgaatctttcaaagaatacacccaaaggtggaaagatctggtagcccaagtggcacccccaatgacgaaaagggagatgataatcatgatggtagacacatttgtagaagcaaagcttcatggtgaatcaaaggtgttggccataagctcaaagaccaatcaaagaaaaactcaagtgaatcaagaacaattcaagagttcaagatataatcaagaagaattcaagcctcaagaagaaagtttagagtcaagaatcaagatttaa

SEQ ID NO: 62104 - DNA, 573 bp, Glycine max
  Peptide Sequence Number=SeqID_153789
aaagtgtttgtcagaggaaaatgtgttagattctcccctgctgtaatcaacaaatacctgggcagaccaactgaaggagtggtggatattgctgtttctgagcatcaaactgccaaggaaatcactaccaagcaagggaagctaagtgtgaagtatgcaatcctgcataggattgggactgcaaactgggtaccccaccaatcatacttccactgttgccacagtcaacatcccaatattttaaacaacattgactctgtgaagaagagagaatctcctctatccctgcattacaaactgtttgaggggatacatgtcccagacattgtctcgacatcagggaaagctgctacttcaggtgctgtgtccaaggatgatttgattgctgaactcaaggacacatgcaaagtgctggaggcaaccatcaaagccaacacagagaagaaaatggagctggaacgcctgatcaaaagactctcagacaatggcattgatgatggagaagcagttgaggaagaagaagatgcagcagaggatacagagtcagatgatgattctgatgccaccccatga

SEQ ID NO: 62105 - DNA, 1410 bp, Glycine max
  Peptide Sequence Number=SeqID_153790
atgaaatacgtgctcatcagcggcggagtggtcagtggcctcggcaaaggcgtcaccgccagcagcataggcgtcgtgctcaaagcctgtggccttcgcgtcacttccatcaaaatcgatccgtacttgaacatcgacgctggcaccatgtctcccttcgagcacggtgaggtttttgttctcgacgacggcggagaggttgatttggatttgggaaattacgagcgcttcctcgatgtcacgcttaccaaagataacaacatcactactggaaaaatttaccagtctgttcttgagaaggaacgtaaaggcgattatctcgggaaaactgttcaggtggttccgcacatcactgatgctattaaagattggattgaaacggttgctgtgattcccgtggacgggaaggagggtcctgctgatgtttgtgtgattgagctgggaggcactgtgggtgatattgaatctatgccatttattgaggctctacggcaattgtcctttcaagtagggcctgataacttctgtctcatccatgttagcctgataccagtgttgggtgtagtgggcgagcaaaaaacaaagcctacacaacatagtgtcagggagctgcgagcattgggattgacacctcatcttttaacaagtcgctctgctgagcctcttctagaaagtaccaaggaaaaactctcaaaattttgccatgttccagttgagaatattctgaacatccatgatgtaccaaacatttggcacattcccctgttactgagaaaccaaaatgctcaccattcaattctgcagcagcttaacttactcagccaagctacacctcctgatttacagcagtggacagagatggctgagacctatgataatcttactgaatctgtgaggattgcaatggtgggaaagtatgtgggtctaacagattcatatttatctgttgtaaaggcccttctgcatgcttgtgttgcacgctctttcaagccatcaattgactggattgcagcttctgaccttgaagatgacagtgaaaaatcaacaccagaagcacatgctgcggcctggaagactttgaagagcgcagattgtgtcttggttcctgggggatttggagatcgtggtgtgagaggtatgatgctagctgccaaatatgcaagagaaaacagtgttccttacctggggatttgcctgggaatgcaaatttctgtaattgagtttgctagatcggttttgggttgggaaagagcaaacagtgtagagtttgatgcccaaacaccgaatcctgttgtgattttcatgccagagggttcacggacgcatatgggaagtaccatgaggcttggatctcgaagaacactcttacagacatctgattgtatcacttccaagctgtatgtgatgtag

SEQ ID NO: 62106 - DNA, 444 bp, Glycine max
  Peptide Sequence Number=SeqID_153791
atgtctactgagaaaggcaatgctgatatttcagacaattctgttcaaccaccatccagtgaaaacaatcttgaaaaatggcacttcggaagagcactggcatacagagcagtttacggttctaatcacagaaaaagtagaggtaatgcttccaagatatcaccaagcaggctcagcaagcgtcgggttgagatagtgagcgggaaaagctacggctgtagtcagagctacatggcggcgattccgagcgaggtgactcgggcgagtcacagcggagcagctacggcggcgaagccttggagttttggtggcccagagtcaaggcggagaaagaggattgccaagtataaggtttacgcggttgagggaaaggttaaggctacgctccgggatgggatccgatggatcaaacatacgtgttctcggatcgtccatggatactag

SEQ ID NO: 62107 - DNA, 150 bp, Glycine max
  Peptide Sequence Number=SeqID_153792
atgacaaagtattctagccaagtcgatgacaaatccaaatatgataacattgtgatggagttatttgtagttagccgtgtattgggcaagccatctaggcaaccgcctaaggccccatttctttatccaactgttacggtctgtgtgtaa

SEQ ID NO: 62108 - DNA, 909 bp, Glycine max
  Peptide Sequence Number=SeqID_153793
atggttgcgccttgtccaacatccatgatggtaagaaccaagaaaacaaaggccatgggagttccgacaatagacctttcaatggaaaggtccaagttgtcggaactggtggtgaaagcatgtgaggaatatggtttcttcaaggtggtgaaccacagtgtgcaaaaagaggtcattgcaagattggaagaggagggaaaggagtttttctccaaaacctcctcggagaagcgccaagctggccctgccaatccttttggctatggttgcagaaatattggccccaatggcgatatgggtcacctcgagtatctcctccttcataccaaccctctttccatatctgagagatccaaaaccatagcaaatgaccctactaagttcagttgtgccgtgaatgattacatagaagcagttaaagaactaacatgtgaggttctcgatatggtggaggagggtttgtgggtccaagacaagttctcactcagcaagctcatcagagacgtccatagtgactcactcctaaggatcaatcaataccctcccgtgagcctaaagggcaccaagaattgggacacgtccaaacttgaggcacatcaactccagagccaaaataataataacaacaacaacaatattggctttggagagcattctgaccctcagatcttgaccatcatgcggtccaacaacgttgatggccttcagatttccacccacgatggcttgtggatccctgtcccccctgaccccaatgaattcttcgttatggttggtgatgccttgcagggtgttgacgaacacaacaaaggccagaatgtcaatgatgtactttgcagcaccaccgctgaattggtggatcactccactgccgaagatggtgacaccccacaatccaagtctctataa

SEQ ID NO: 62109 - DNA, 174 bp, Glycine max
  Peptide Sequence Number=SeqID_153794
atggttgagttggaagagaatgccgtgttcaacatttctatgacgtgtgctttttatataagcggacaccgatgcctaatgcgttgtttcaataatcaaatctggaatggaattgctgatgacgttacgcttctgacgtcattgctttgcgctttcaccacatacgtaacgtaa

SEQ ID NO: 62110 - DNA, 1179 bp, Glycine max
  Peptide Sequence Number=SeqID_153795
atggcatcggcgggtgtagcacctgcttctggagtaagagatgtgaatgcaaattcggttgctgttgaaaggttgcctgatgagatgaatggcatgaaaattagggatgaaagggaaatggaagcaactgtggtagatggaaatgggactgaaacaggacatataattgttactaccattggtggtaaaaatggccagccaaagcagacaataagctatatggctgagcgagttgttggaaatggatcatttggtgtagttttccaggcaaagtgcttggagacaggggaaactgtggctataaagaaggttcttcaagacaagagatacaagaaccgggaactgcaaaccatgcgtcttctggaccatcccaatgttgtaactttgaagcattgtttcttttcaacaactgaaaaagacgagctttatcttaatttggtacttgagtatgttcctgagactgtccaccgagttatcagacattacaacaaaatgaatcaaagaatgcctttgatatatgtgaaactctatttttaccagatatgtagagctctagcttatattcacaactgtattggagtgtctcacagggacataaaacctcaaaatttactggtcaatcctcacactcaccagctaaagatttgtgactttgggagtgcaaaagtcttggtcaaaggggaaccaaacatatcttacatctgctctaggtactatagagcacctgaacttatatttggtgcaactgagtacaccacggccattgatatttggtcagctggttgtgtacttggtgaactaatgcttggccagcctctattccctggtgagagtggagtagatcagcttgttgaaattatcaagatattcataatagttcccttgttatcttttcatacttctgaagagatctttcacaagcgcttacctcctgaggctgtggatctcgtctcaaggctactgcaatactctccaaatcttcgatgcacagctctggaggccttggttcatccattctttgatgaactgcgtgatccaaatacccgcctaccaaatgggcgttaccttcccccactctttaacttcagagccaatgagcttaaaggagtgcctccaggcatgctggtgaaactgattccatctcatgcaagaaagcagtgtgccttgtttgcgtcatag

SEQ ID NO: 62111 - DNA, 849 bp, Glycine max
  Peptide Sequence Number=SeqID_153796
ctggaccgcagagatggtcgtgtctctaacagagacgaagcttcacaacttcctcgtccaacaatcaacacacaacaactcattagtaactttgaacaaaaagggttgtctgcagatgaaatggtaacactctctggagcacattctattggtgtctcacattgttcctccttctccgaccgcttgtactctttcaatgccacgtttcctcaagacccttctatggacactaaatttgccacgtcgttgaaaagcaagtgtccaccaaggagtgataacacggtggagcttgatgcttcctcgcctaaccgtttggacaacaactactacacgatgctcaataaccatcgtggtttgttgacctcagatcagactttgttgaccagcccctcaacgaggccaatggtgctaaccaatgctaaacatggttcgacatgggcacgcaagtttgctaaggcaatgtggaattatgcaccaacaattagaggccactcactaaggttgaataagcaacaccatgaacacggcattggaattagagtggtacgattttgtgtgttttggcattgttggtttggccttcctgggtgccatatgggtgctttggatgcacgaaggggcctcccaaagcaaattgggaaccttggaagagaaccttctggtgggtctacaagacagtactggagtggtcgtgaatgtggttctgagagacagagtcataggtcaggtgaggagcaccccccagttatggaccagttgttggcgaggactgcaccctttgttcctcttgatcacgcgtttcctttcctttgtggtcatggccgttttgctaccattggatgttcgtga

SEQ ID NO: 62112 - DNA, 3363 bp, Glycine max
  Peptide Sequence Number=SeqID_153797
atggaagctagatttggagctgaggcttatcatttttgcggtgtgggtgcttcctcggatttgaggggtgtggggaagaggtcctcagagtgggatttgaatgattggagatgggatggtgatctgttcatcgctagccggctgaatccggtggtgccggcggacggtgttggagtgggacggcagtttttccccaccgggtccgggactgggatcctggtggccggaggtccatccaacagttcttccacctctgaggaagtagatccaagggatcccaaggggaacaaggaaggggacaagaaaaggagagttattgtgctggaggatgatggtttgaatgaggaagggggtactcttagtttaaagcttggtggccatgcttctgcagtggtggatagggaagttgcaagctgggacggtacgaatgggaagaaaagtagagtgtcgggaagtacttcaaatcgagctgtttgtcaggtggaggactgcagtgctgatctgagcaaagctaaggattatcacaggcgacataaagtttgtgagatgcactccaaggccagtagggcgcttgtgggaaatgcaatgcagagattctgtcaacaatgcagtaggtttcacctgcttcaagagtttgatgaaggaaagagaagctgccgaagacgtttggcagggcataataaacgaagaaggaaaacaaatcatgaagctgttcctaatggaatagagacatgcatggaggaaattatctccttcctcaagtttctattccacttcatgttgaagaatttggtttgggttgtggttgagaatagcgccatggcggagcaggagcctccaggaagatcgtctagctggttagaggagagcaaggaaaatgatttgaggtcagatcagactacagatcaggatctactaactcatattctgaggagtcttgctagtcagaatggtgagcaagggagcaagaacatagctaaccttttgcgagaaccagagaatttgttgagagaagatggttcatcaaggaagtcagaaatgatgtctactttattctccaatggttctcaaggctctccaactgatacaagacaacatgaaactgtatctattgctaaaatgcagcaacaagtgatgcatgcacatgatgctagggctgctgatcagcaaatcacatcttctataaagcccagcatgtcaaacagtcctccagcctactcagaagccagagacagtaccgctggacagatcaagatgaataattttgatttgaatgacatatatattgactcagatgatggtatggaagatttagaaagattgcctgtctctacaaatcttgtgactagctctcttgattacccatgggcacaacaagattcccatcagtcaagtccacctcaaacaagtggaaattctgattctgcatctgcccagtctccttctagtttcagtggagaagctcagagtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggctttgtgggaggaactttgctatgatctgacttccagtttgaataggctgttggatgtctcagatgatactttttggagaaacggatgggttcacatcagggtgcagcatcagatggccttcatttttaatggtcaagttgtcatagatacctccttacctttcagaagtaataattatagcaagattttgactgttagtccaattgctgcaccagcatcaaagagagctcaattttctgttaagggtgtcaacctgatacgccctgccactaggatgttgtttgaatatatctatacttttgttgaactggcatggtatatgaccattaaaccttccctcaggttaatgtgtgctttagaagggaaatatctggtctgtgaagatgctcatatgtcaatggatcaaagctccaaagagcctgatgaacttcagtgtgtccagttttcatgctctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggactggaaaaattaaagccaaaaatcaagccatggattttattcatgaaatgggttggcttcttcacagaagccagttgaaattaaggatggttcaattgaactctagtgaggatctctttccattgaaacggttcaagtggcttattgagttttccatggatcatgattggtgtgcagcagtgagaaaactgttgaacctactgcttgatggaactgtaaatacaggagatcatccttccttgtatctcgcgctttcagagatgggtctccttcacaaagctgtaaggagaaacagcaagcagttagtggagtgtcttttgagatatgttcctgagaatatttctgataaactaggacctgaagacaaggcactggttgatggcgagaatcagaccttcttgtttagacctgatgttgttggtcctgctggtttgacaccactccatatagcagccgggaaagatggttctgaggatgtacttgatgctttgactaatgatccttgcatggtgggaattgaagcatggaaaaatgctcgtgacagcacaggctcgacacctgaggattatgcccgtttacgtggccattatgcttacattcacttagtgcagaaaaaaattaataagagacaaggagcagctcatgtggtggttgagattccaagcaatacgacggagagcaatacaaacgagaagcaaaatgagttatccactacctttgagattggaaaggctgaagtaatacgtggccaagggcactgtaagctttgtgacaagagaatttcttgcagaactgcagtaggcaggtctttggtatacagacctgcaatgctctcaatggtggcaatagccgctgtctgtgtctgtgtggcccttctgtttaaaagctcccccgaagtgattgtggaaagatatgcgaaatgcgatctgcctgagttggagaagaaaaaactgagtctgccccctggaaaagctctctttgtatttgtgaagaatactttgcctcaaactgctaatatgatggactctgtgtatagatcattcaaggatgaggatggatttctttacatgtattatagcaccgagaaaaccttcggttcgtacattatgtaa

SEQ ID NO: 62113 - DNA, 429 bp, Glycine max
  Peptide Sequence Number=SeqID_153798
atgagcaattcctctgctggaacctcatcaaaaccaagaacagcttcctcacaaccatcagaaacttcgtccaagcgcaaaagaggagttttccaaaaagaattgcagcacatgatgtatggctttggagatgatcctaatccacttcctgaaagtgtggctcttatggaggacattgttgtggagtatgtcacagaactggtacataaagcccaagatattggatctcagagggggaagctatcagttgaggatttcctctatttgattcgcaagatccattatatactgcaggattcgccaaaacttaaccgctgtacagaactactttctatgaatgaagagctgaaacaagcaagaaaggtttttgaatcagacgaagagaaactgaggaaggtttttgaggtggatgactcagttgaaggatga

SEQ ID NO: 62114 - DNA, 1433 bp, Glycine max
  Peptide Sequence Number=SeqID_153799
cgctggagctgagagcgaggtgtctgctatatctgagaaggttcaaggacgtggcggatatgcttcaggactacattccgagcctgagaatggcgaacaacgacgactctggttcttctgtttcttcggatagttcgctttcgagggaaggtgtcaagcttctcccttcctccgattccgatcagagtttcaagtgcttctctgtctctgacttgaataagaaggttatggcagggctgtgtaaaacttgcaacaacgaagggtattggagatacttggttctggggaaagcatgttgccacctaggcctaatggaagacgccatggtccttctccaaaccggcaaacgtctagccaccgccgccttccgccgagagagcgtttgctggtccgacgacagcttctccctctccaaccccctcttctccggcgacacccccaccaccccacccccggagtccgaagccgtcacccaactcctcgctcacattaagctcctcctccgccgccgcgccgccgccctcgccgccattgatgccggcctccactctgaagccatccgccacttctccaaaatcctcgagggccgccgcggcgcccctcagggcttcctcgcagagtgctacatgcacagagcctccgcaaaccgctccgccgggcgaatcgccgactcaatcgccgactgcaaccgaaccctcgccctggaccccaccagcatccaagccctcgaaacccgagcctcactcttcgaatccattcgctgcttcccagactccctccacgacctcgaacacctcaagctcctctacaacaccatcctccgcgaccgcaagctcgcgggccccacctggaagcagttgcgccaccacaacaacctgcgctacagagaaatcccaggaaagctctgcgccctcaccgtaaaaacacaagaactcaaacagaggatcgcttccggggacaccgggaacgtcgactactactcgctcatcggattgcggcgcggttgtgggcgttcggagctgcagagggctcatttgttgctgtgtctgaaacacaagcccgacaaggccacgtgtttcgtcgaacggtgcgagctggcggacgagctcgacctcgactcgattaaggaaagggggaaaatgtcggcgctgttgctctacaggctgctccagaagggttacacaaacgtgatgggaaccatcatggatgaggaagccgctgagaaacagaggaagaaggttctagaagctcaagtattgatgagtaatgagaatttggaagacaagaagtgcaacgtttcctcgccttcgacggcgaacccctctgtctatcagggagtgttttgccgcgatattgcggtggttgggaacttgctttcgcaatcggggttcaaccgctccattccggtgaagtacgaggcgttgagctgctga

SEQ ID NO: 62115 - DNA, 333 bp, Glycine max
  Peptide Sequence Number=SeqID_153800
atggcttccgagtggaggccggcgtccagggcggcgagggcggcggcacggcggcggaggaggagctttatgtgggcgaggagttgggtgacggcttcggactccaggagtggggcgcggggtggggtggtgggggtgggggtgtcgccggagaagagggagttggagagggagaagctgtcgtcggaccagcacacgctctcgcggcggaatgcggcggtggctaggcgtttgccggtttggagaaggaccattgcgtcttccattaggcctaggtggcaacatgctttccccagaaccaagtatctgttggtaaatagaatagaaaattag

SEQ ID NO: 62116 - DNA, 441 bp, Glycine max
  Peptide Sequence Number=SeqID_153801
atgcaaaataaacaagtgatacgaaggtgtgaccttgctattgctaaatggttcattgatgcatctattccatttaatgcagctaattcagcatattttcagcctatgatcgatgatctttgtagcatgagtccaagatacaaggctccaagtatgcattgttgtcgttgggatccacagcttcacaaaaatctccatgcttcaggttattggttaaagcctgcttgccggtttaatgaggaagaatttgaacaacatatgactacaacaactggtctgttggatgtcattgaaagatatgctcacagagatagtcctttaaatttggatgatgatgatgaagaagcacaaggcaatcccatggaaaacatgaatttaaatgaaagcaatgttgatcatggagttacaatgggagattgttttgagttctttaatgaataa

SEQ ID NO: 62117 - DNA, 2163 bp, Glycine max
  Peptide Sequence Number=SeqID_153802
atggtgggagaagaagtagtaccaatggacgacaaagcgaagaggatgcgagatctgctatcgagtttctactcccctgacccttccatctccaacaacacctccaaacacgcttctctcgacgacatcaattctacttccttcgatcccgatcagtacatgaacatcctggcacacaagtccaatttggaaggcctgctccaacgccacgttgaaatggcagctgaaatcaagaatctcgacaccgacttgcaaatgctggtttacgagaattacaacaagttcatcagtgctacagacactataaagaggatgaaaagtaacatttccgggatggagacgaatatggagcagcttcttgagaagataatgtctgtgcagtcgagaagtgacagtgtcaacacttctctatttgacaaaagggagcatattgagaaactacatcggacttgtaatcttcttcgtaaagttcagttcatatatgacctacccgatagactaagcaagtgcatcaagtcggaggcctatgcagatgcagtcaggttttacattggagcaatgccaatttttaaggttgtggcatatggagattcttcattccgggattgtaaacaagcttctgaagaagcaatagctgttgtagtaaaaaacttgcaggggaagctattttcagattctgaatcaatacaagtgagagctgatgcagcagtgcttcttaagcagttggattttccggtgaacaatttgaaggcaaagttatttgaaaagttagaacaatctattacagacattcgactgaaccctgaagaaataaataatccttcaggggaccgttctactcatgaggcagctatacatgaatttgtggaggcagtttgtgcatttcgtgtaatatttcctgattctgaagaacaattggttaaagttgctgaagatttggttaccaagaactttgtaattgctgaggaatatgtaaagacacggatttccccagaagatctacttggtgttcttcattccctcttacaaatcctgaaaaaggaaggagcagaacagtgcactcttgatgttgttcttgatgcaagtacaaaagcagttcttcaaggaggactgaatgtgttgctggactttcgcaaaattttagatgatgactctgggatcctagttagattaagagagttaatcattgattgggttcaagaaggacttcaagaattttttaggcaacttgaggatcagttccttctgttttcaggaagaaatcattcatctattcaagtacacggtttggcagagggaactcaaggtgataaagcttttgctggccttgtcctagtgctggcacaattgtctgctttcattgaacaaaccgtcatcccaaaagtcactgaggcaagggaaatagctgcttccttttctggtggtagtgttagaggctatgaatctggacctgcctttgttcctggagaaatatgtcgaaaatttcggtcagctggtgaaaaattcttgcacctgtacataaatatgagaaatcagagggtatcacttctcctgaagaagaggtttacaacccctaattgggttaagcataaggaaccaagagaagttcatatgtttgttgatctatttcttcaagagcttgaaattatagttaacgaagtgaagcagattttgcctcaaggtagacgtaagcaccacaggactgatagtaatggaagtagtgcttcatcaaggagcaatcccttgcgggaggagaaactggttaggtcaaatactcaaagggcaaggagccagcttttggaaacgcatcttgcaaaattgtttaagcagaaagttgaaattttcacaaaagtagaatatacacaggagtctgttgttacaactttagttaaattgggccttaaaagttttcaagaatttgtccgactccagacttttaaccgaagtggattccagcaaattcaattggatatccagttcgtaaggatccctttaagagaaatagttgaagatgaagctgcaatcgacttcttgctagatgaggtgattgttgctactgctgaacggtgtctagatccgattccattggagcctcccatattggacaaacttatacgagcaaagttggctaaaaccgaggagcaaaatacaatttcttcataa

SEQ ID NO: 62118 - DNA, 540 bp, Glycine max
  Peptide Sequence Number=SeqID_153803
atgacttggaatgttgtgggttctaagttatattatagactgaccatttttctgttgtcagctaatgattcaagtgcgcagaatgactggaagggtgcttggtggcatagcagcttcacagttcactcaggattcgtagaggatgagagtccatatgcagataatggaaaaaagggcacttacttttttgaattctcgaggcctttgaggactatggatcatcttcaacaggacgtgcaatttaacatcggtggatccagtaagatgtctgttgcattctggtatccagtagatggtcaaccgtggcatggttccgggcactactctatttactgtgattgggttcccattgacatatctgttggtaattctttgagtggcaagtcagttgatgcagcatcaagtagctcgtggaatgttgctagtgccttttctgttatactatcagtagcagcactttgcgtgtctgtttttgtgagctatagggtgttcagccccaagagtgtctcttttacaccaatagagaacaacaacctttaa

SEQ ID NO: 62119 - DNA, 183 bp, Glycine max
  Peptide Sequence Number=SeqID_153804
atggattttgatgagttgtttgatctgaatggagtgctaatccagacccaagtcacaaaaaggagaaatatgaagataatgagtgaaaagaagtcaatccatgtcactgatggagaaataggaagggagcccaaaaaacccaacacctattaccaaatgtgcgactgtggtggaaattcatga

SEQ ID NO: 62120 - DNA, 1260 bp, Glycine max
  Peptide Sequence Number=SeqID_153805
atgcacaggctgccaaaggcgaatacttcgagcggcaccggcgtgacgttcaacctgcgggtagcggctggcggcgtactccagcgtggcgatatcggccagaatcagcgcatcggcaccgttctgtgcggcgacgtcaatggcgctttgccagcggttaaggccgtcaggatgggcgaaggtgttgatcgccacgtgcagtttacgccggtgctgatgcaggaagcgcgcggcttctgccagtttcttatcggtaaaattgaggccagcaaagtggcgggcgttggtgtcatctttacaggccgacgtacaccgcgtcagcgccgtgctccaccgccgatttcagcgcaggcagtgaaagcgggattgccagggcggaatggagaattttcgcacagacacggggcgatttccttgatcccggttgaggcgaaagccgacggatggccggaattcctcgctttaccggtgtcgctaacaccattcgccgtgaaaaaaacggttttgcaacaactcctaaactggcaatttcgtcatgctttggctgaaggtgagttagactttctgcaagggcgctatctcggcattgagatcgcggacgtcaatctgcgctggatcaccacgctgcaggacgggcgcctgaccgtttcgcgcgacgccgaagcagatgtctggtttcgtggcgaagccaacgatctgctgctgatagcagcacgcaaagccgaccccgatatgttgttctttcagcgccgtctggtgattgagggcgacacggagctgggactggaggtgaagaatctgatggatgccatagaactggacgccatgcccacgccattgcgcacggggttgctgcagctggctgcttttgttgaggcaggaatgacacaggacgcgaaggccgctgaggcgcgcgcggggatctcatgcatcgacagcctgttaaagcgcagttttgccaccgcagccgaagcggaactggtacagcagctgcgtgaagatggtttactcacgctgggcgtggtggccaccgatgacgaaggccaggtgctgggttatgccgccttcagtccggtgacgttgcagggcgaggatcgtaactgggtggcgctggcgccactggcggttgatgcctcggtgcgcagtcagggcattgctaaacagctggtgtatgaagggctcgattcgctcaatgagttcagctacagcgccgtggtggtgctgggcgatccgcagttctacaattcggctcggctttga

SEQ ID NO: 62121 - DNA, 900 bp, Glycine max
  Peptide Sequence Number=SeqID_153806
atgcccaccatgcttctgccccgtacgctgctggccgttttgtgttccctgacgttttccacgcaggccgcaccggcaggcgatctgccgctgatgccgtggccacagcaggtgacgcagcccgcaggcgatggcgcgtttaccctgacgccgcaattttcgctgcacatcaccggcgatcacctggaaggggccgaagcgcgctggcgcgcccgcattgcgcggcaaaccggctgggcgctgctgcccgccagcccggccagcgatcgtcccgccattcagatccggattgccgacgcggtcgatccgctaccgcaaccggacagcgacgaaagctaccgtctggaggtcagcagcagtggcgtactgctgcaggcacctacccgttttggcgcgatgcgcggcatggaaaccctgctgcagctgatcgccaacaccgccagcggcacgcaaattccctttgtcaccactgacgatcggccgcgcttcccgtggcgcggcgtgctgatcgacccggtgcgccacttcctgccgctggaaaccctcaagcggcagattgatggtatcgccgcggcgcgcatgaacgtgttccactggcacctgaccgacgatcagggctggcgctttgcttccagtcactatccgcagctgcagcagcaggccagtgatggcctgttctacagccagcagcaaatgcgcgagctggtgcactatgccacccagcgcggcgtgcgcgtggtgccggaaatcgatctgcccggccatgcttccgccctggccgtagcgatgccggagctgatgagcgcgccggggccatatgccatggagcgcggctggggcgtgtttaacccttgctcgatcccagcaatgaagcggtgtttcgctttattgatacgctga

SEQ ID NO: 62122 - DNA, 622 bp, Glycine max
  Peptide Sequence Number=SeqID_153807
atggcatacgaagcattgctggaagaacagcgcgaagagacgcgcctgatcattgaagagttgctggaagacggcagcgatccggatgcgctttacaccatcgagcatcatctctcctgcaacaacttcgactcgctggaaaaggccgcggttgacgcgttcaagctgggctatgaagtcaccgagccggaagagctggagctggaagacggtagcaccgtgatgtgcgtcgacatcctgagcgaatcggcgctgaagccggaactgattgacgcgcaggtcgagcagctggtgaatctggtcgggaaatacaacgtcgattacgacggctggggcacctactttgaagatccggatgccgaagatgaagacgacggcgaagagatcgacgacgaagacgatgacgaccccattcaccagtttttacagtgccgcacgccgcaggcgtggattgatgaagcgcgcaagccggaaaatctcacgctgctgcttaccgatcacatggtatgcgagttgaaagcggcgcagaccgcagtgtggctgatccgcaaatacgtcgcggataaacccagtggtgacgcgatcctggcgtggctgcagccttacgaagattttattttcg

SEQ ID NO: 62123 - DNA, 222 bp, Glycine max
  Peptide Sequence Number=SeqID_153808
atgagtgccattacattgaggtcgggaaagcagtgtcaaggacctcaaccagcaacatcttcctcatccgcaaatgaacctgcccaacttcactctactccagaaaaagatgatgacaaaaatttaaagaagaagcagcatatccttcttcctttccctctaagagcaattttcaacaaaaaaatggaaagaggcggagaaggagatcttcgaaacatttag

SEQ ID NO: 62124 - DNA, 270 bp, Glycine max
  Peptide Sequence Number=SeqID_153809
atggtagccataatcccagccaaggttcctcaacctccatttttccgagggtacgactcgaacacaatgtgtgctcatcatggaggagccccggggcattccattgagcattgtatgaccctgaagcttacaatgctaaaatggatgaatttgacatccctgtctctctcatcctttcacatacacatctttgattattcaactttcactggaatgtgggtgcaagccatcggtctgtttgctcaagtgacctgcgctcttgagttttga

SEQ ID NO: 62125 - DNA, 333 bp, Glycine max
  Peptide Sequence Number=SeqID_153810
ctaagggggaaagagattcccttggtcaaagtagtatggggaagtgcttcgggcgaggatgccacctgggaactagagggtcagattggtgatgcatatcctaccttattcgataccggtcataaattcccactatataagccaaatgttaacctagagcagctttttggaaaacacattctgttcctttcttcttttctgacgcacaagaaccctaacaaagcaatcagaggaggagctctagagagcaccagagacgccaccattgctaatagagaatatttaagcgactacatcgaggtaagggatgagttactcacacttagggattag

SEQ ID NO: 62126 - DNA, 368 bp, Glycine max
  Peptide Sequence Number=SeqID_153811
ggcagaagattcatcttctactccaaaatgctatgaatgcaatcaacctggacatctgagggttgattgcccaatattcaagaaaagaatagagaaatctgaaaagaaagttgttaatgaaaagaaggaaaagaatgcctacattacatgggatgacaatgatatggactcatctgaagatttagaaaatgaaattgtaaatctgagtctaatggccaagagttatgaaagcgatgaagaggtatccttgaagaagagttggtacatatatagcggatgctctaaacatatgacgggagatgcatcaaagttcactcatatctctcccaataaaagcggacatgtgacttatggcgacaacaataaag

SEQ ID NO: 62127 - DNA, 378 bp, Glycine max
  Peptide Sequence Number=SeqID_153812
atgaagttcccctctcttcgactcaccaatgtgaaaggtgtgcatgagtacataatgcaaatgcgagatatttcagctcgacttaagaaactggaggttgatatgtttgagtccttcctggaagaagaaaggcttgtaatggggatgagtgagagtgcattgttgataactgcttgtgggaagaacaaaacatctaagtctcaagctaataagaaggggaatggtaaaataccacctcaagattatattaagaagggtatgaaaaacctaaggaaaccagtgagaagtaagcaaagaattttatcaggcaataagctaggctcacctatggaggctattgaaacttgcattttaactttaagtagtgatttattttga

SEQ ID NO: 62128 - DNA, 264 bp, Glycine max
  Peptide Sequence Number=SeqID_153813
atggtagccataagcctagccgaggttcatcaacctccatttctccaagaatacgactcgaacgcaacgtgtgcttgtcacggagaagccccggggcgttccattgagcattgtagggctctgaagcgtaagattttcaactttcaccggaagtgggtgcaagccattggtctgtttgctcaagcgacctgtgctcctgatttggacttccaagaccgttcatcagagattactcgtcttgcacgcttggtggggatgccgtaa

SEQ ID NO: 62129 - DNA, 378 bp, Glycine max
  Peptide Sequence Number=SeqID_153814
atggcctctaggaagaggaaatctactgcctctagaccccaggagccctatgacaccactagattcatatctgagggcgcctgggagaaatatgcacagaacgttcactcctggaacatccttccagagaggaacgttagggtgagagggaagctaataaagtttgatactgagtcactgaacatgttcttggatacccccgtggttttggagccaggggagtgctacgccacctacaccaggttctacagtactcacccagaccctcaggagcttgcttccaagctctgtattctagggcgcagttttgttctgaacgatgaaggagcgccctggaagctcttgaggaaggacctcaccactttggcgcaaacctag

SEQ ID NO: 62130 - DNA, 384 bp, Glycine max
  Peptide Sequence Number=SeqID_153815
atgatttgtggttcaaatgttgatatatctggtcgcttacttgttggatcctttatttttgaatgtcgtatcatgcattacattctctatcgtgtgttgcttcctcattctactaaccttgctcaagccactgaggaagacttaattttgatgtgggcattgcaaactggacgccaaattgactgggcacatcttgttcgtaactgtatgcacaaggcattacgtgcaaatgcccctctaccatatccccatctggttactctatttttgaagcacttcaaagtcccttttactaatgaaccatctatcaaggttaagcgttcatttacaataggagtggttgtagttgcttcttttggttataagaaagatcttgatggatag

SEQ ID NO: 62131 - DNA, 258 bp, Glycine max
  Peptide Sequence Number=SeqID_153816
gcggctaaccacagggcgcacgtgcagactcatgactctctctaccaacttagcctcagcctgcagagccagggttttgcttcttttccatgccctactccggatcaattcagggtagaggtcacatggcccggagattggcctgaggcccaggcaagggaggcacccgcagaggctcccggtgaggcagatgaggcccgcgaggacgaggagatgaccgatttgcttgatttcttgggagggagcagagccacatga

SEQ ID NO: 62132 - DNA, 417 bp, Glycine max
  Peptide Sequence Number=SeqID_153817
atgctctgcaatgaccatgctgacatgattggtagattgcttgctgggtcatttacttttgagtgtcgcatcatgcactatattatttgtcaaattttgcttcctaagtccactaaccttgcccaagtctctgaggaggatataatcttgttgtgggcccttcaaacttgtcatcagatcgactgggcccatcttgttcggtaccggatgcataagacattacgggccaatgcaccttgccatatccccatcttgttaccctttttcttcagcatttcaatgtccctttggatgatgaaccttttgtcaaagttaaacggtctttttccattgaaagacatggatggtcagtgggtgcgcaagcaagacctgccacctcccattccagatgagcatacaccgtctccaccaccataa

SEQ ID NO: 62133 - DNA, 345 bp, Glycine max
  Peptide Sequence Number=SeqID_153818
atgttagaatggttttctcctttagcttggtggcgtatgaagctaaaacagattctagacattgaaagacaaagaggaatcccaaaagatcacataggaaatctgaatgctaatgacagtcaaattcacatagagatttatgttccagatcctgagtttcaaaaagcagaagatttagctgatgacaattctgcattagaaaaggacttggaatattacaatgctcaattgatggaggaattgttacacaggaagcgatatccttatcatcacccagtgtatggaagtctcacccagtcagaagtgcaacattacaacttgtcattatccaccagatcagattag

SEQ ID NO: 62134 - DNA, 456 bp, Glycine max
  Peptide Sequence Number=SeqID_153819
atggagagaagtatgatagatgctgccagtggtggagcccttggagacatgacccctgctgaagccagaaatttaattgagaagatggcttccaactcccagcaattcagtgccagaaatgatgttattgtcattagaggagtgcatgaagtagccacgaattcatcttcatcaggtgagactaagaagtttgaaggtaaactagatgccttggttaacctgactctatggtttatgctcctctgccgaccccatacagacctttgcccttctgtgcaacaatctgaagcaattgaacagcctgaagcttatgttgtaaacatctacaacagacctcctcaacctcagcagcaaaatcagccacaacagaacaattatgacctctccagcaacagatacaatcccgagtcgaggaaccatcccaaccttagatggttgaatccttcacaacagtag

SEQ ID NO: 62135 - DNA, 333 bp, Glycine max
  Peptide Sequence Number=SeqID_153820
atgacatgcctttccaaagacaacccgataaggagacattcctatgggtgctttgtaggcagtccgatgtgcccagagagcatcatcaagcctggcaaaattgattgcaataacataaatgagataagggaagagagaatgcaaacacagttttatactggttcagccacaacccgtgcctacgtccagtactcaagcaacccacttgagatttccactatctttgtaaaatccattacaaagtctgaaccacacagggacaacccatcccttgtgttcaggaatcctttacaacaagagactcacaatctcttaaccaatctcattgaataa

SEQ ID NO: 62136 - DNA, 525 bp, Glycine max
  Peptide Sequence Number=SeqID_153821
atgactagaggcaatccatttgacttacaaccctttgatagattagttaggcatcattttgtaccttttgagcatcctgagcattctgttattggtgagtctgagcattttgtggttgataattttgaacatcctgattttgagcattatagttttgaacattctgattttgaacattttgagaacatggcacaacctccacctcgagagaggactctaaaggaaatggctgcacctgatttcacctatgaaagcttgtgcatccaataccatgataaggatgtcccatatgttcttaaaactggactaatccatttgcatccaaagtttcatggccttgcagatgaagacccgcacaaacatctgaaagaattccatattgtctgcttcaccatgaaacccccagatgtccaggaggatcacatatttctgaaggcttttcctcattctttagagggagtggcaaaggactggctatattaccttgctccaaggtccatcatgaactgggatgacctcaagaga

SEQ ID NO: 62137 - DNA, 261 bp, Glycine max
  Peptide Sequence Number=SeqID_153822
atggtaatcgattacatgttgaaaattcaaattcaaaacatttttcaacagctatttctcaaccctgtcttctgccttgttagattcttctttgacatcatcaaaatcatgtatacatacattcacaaatcagacctcacgaggaaatgggcccttgcagccgatcaggacggtgtcgaggacactgtctatgagaaatacggcatcaacaaggaaaagtgggcccaattttgccagactcgcagagacccttcttgggag

SEQ ID NO: 62138 - DNA, 543 bp, Glycine max
  Peptide Sequence Number=SeqID_153823
atgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcgcgggcccgatgatacgcggagataccttacggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 62139 - DNA, 227 bp, Glycine max
  Peptide Sequence Number=SeqID_153824
aatatgacaaaggtgatgacaaaaagctcaaaggtcaatcaaagaatgagttcaagatagaatcaagaacacttcaagattcaagaggaaagtttatttcaagaatcaagattcaagagatcaagatttcaagaatcaagattcaagagatcaagattcaagactcaagaatcaagagaaagcttaatcaagataagtatgaaaaggttttctcaaaatttgagtag

SEQ ID NO: 62140 - DNA, 306 bp, Glycine max
  Peptide Sequence Number=SeqID_153825
atgaatttattgcctagcgctgttcatgtgtcctccacccacgagtctggagccccgcgaattcattgcctagcgctgttcagcaattctccgattctccactcttattcggagacccatgaatttcattgcctagcgctattcatgtgtcctccaccacgagtctggagtcccgcgaattcattgcctagcgctgttcgccaattctccattctcactcttattcggagacccatgaattcattgcctagcgctgttcatgtgtcctccaccatcaagtctggagccccgcgaattcattcctag

SEQ ID NO: 62141 - DNA, 342 bp, Glycine max
  Peptide Sequence Number=SeqID_153826
atgttacaaaaccttacggattacgtaatcatcccttttttgcattccggaacgttacggaactttgcggattgcgcactaacacttccttttaatttccggcatgtcactgaacttcacggattgtgctacaacgcttttcttttggcttccggcatgtcacggaacttcacaaattgcctaatgatgggtgccaagtacctcaaaatggtcaaacaaaagttgcatgccaccaagcaaaggtccccggacgaaattaggacaacctcaccagacatagcttcactaataagacaacaattcttgttgaattcaattttgaagcccttgtcacaaagttga

SEQ ID NO: 62142 - DNA, 420 bp, Glycine max
  Peptide Sequence Number=SeqID_153827
atgctttgctctgtggcttctaagtgttgggccaaactcctcttggatcttgagcaagcagctaactcctcctttaagaccatgccatgtactcgtgactggtctctttcctccctccgaagcttgagctcattgttgctgcccaacaaagctccttggaatttatcccggccatgctcttccttgcgagccctcttggtttctcgtttgagggctcttgcggtagccgcattttcctctcgtaactcggcacactctttctggatgtttgtagcgactaacttgaatttttctttggcgagtcttgcctttcctagctctgtttttagagcttggcattcctcatcctcttccggagcttcgaagttctcctcgttgataattttcaacttggagagccaatctaaccctcgtgtatga

SEQ ID NO: 62143 - DNA, 632 bp, Glycine max
  Peptide Sequence Number=SeqID_153828
atgtcttcttcctctagttatgactacgatctccatgatgatgacgagatggactttctgcgtgatcggtacaaggaggacaacataaactatgatgtgtttttgagtttcagaggggaagacacgcgtgcttctttcacttcacatctctatacggctcttcacaacttgggaatctttgttttcaaggatgatgagacacttccaaggggaaataaaatttcaccctcgctgcggttagcaattgaagagtctcgactttctgttgttattttctctagaaactatgcagagtcgcggtggtgtttgaaagagttgcagaaaataatggagtgtcacagaacaacagggcaagtggtagtgccagtgttctatgatgtagatccctctgaagtacgtcatcaaacaggccactttggaaaagcatttcgaaaccttgagaacaaacttttaaaaggggaagaggaagaggaagagctacaacgatggtggaagacgcttgctgaggccgctggcatctcagggctttctgtagtccgaaattgcaatggtcaaagtgagattttggataagatagatctcctcgtggagcattggagggagacactttgtgacgttgctggcatcttggg

SEQ ID NO: 62144 - DNA, 509 bp, Glycine max
  Peptide Sequence Number=SeqID_153829
cgcctcgtccacgccgacccgctgctgccgttctcatcaccggtgggcctctccctttctctcttcctccctctttttcacttcggccgccgtcgtcgacacggtgtgtcgccgtcgcgtgcgcgcgctgtttgccgccgccgacgcaccctctcgggaccgcctccatcgcctcgccgtcgccaccgtggaaccgccgtcctccgccgccctccgcgccggatgccgccgccctcctccgcccggccgaagaccgtcctccccctcctctctgttctgtgaggtcggctactggggcccacatgccagccggacaccctgccctctctccctcccttcccaacggggtccacccgtcagccaccctctcccttctctctctcctctcctccccgggcccacgtattgaccccgtcgcagcgccgttcgttctcgaagtcgtcgtcgaggttcctcgtggggctgagcaagggcagtggcacccttctttgatcatattgaacctttga

SEQ ID NO: 62145 - DNA, 369 bp, Glycine max
  Peptide Sequence Number=SeqID_153830
atggttgcctgcagactacagagagatagaggctgccttatgcatacctggctgagggttcatcttgaacacagagggccatcctgggaagattctcaagaaggatctgactacactagctcagccagaggagttgtctcttatagcctcacttttgagcgcctgagcccgatcattaacttggcctacatcaggaagaactattggaaccccgaggatgtaacagtttctattcgaggggctaggagggcgagggcaaggccagctgagcttccttctacttctgcagctcctactccagcatccacttcaacagccctttctgtcctagttcagacagattctcagtgcttcgaagctatgctttag

SEQ ID NO: 62146 - DNA, 249 bp, Glycine max
  Peptide Sequence Number=SeqID_153831
atggtagccataaccctagccaaggttcatcaacctccatttctccgagaatacgactcgaacgcaacgtgtgtttgtcacggagaagccccggggcgttccattgagcattgtagggctctgaagcgtaaggatttgcaagtgcaagccattggtcaagcgacctgtgctcctgagtttggacttccaagaccgttcaatcagagattactcgtcttgcacgttggtggggttgccgtaaaacaatga

SEQ ID NO: 62147 - DNA, 50 bp, Glycine max
  Peptide Sequence Number=SeqID_153832
atagtggaactctcaagcaggttgcttggggactggacttaggcacaagg

SEQ ID NO: 62148 - DNA, 294 bp, Glycine max
  Peptide Sequence Number=SeqID_153833
atgattatgaggagccaagacatttatagtagccaagatgaggctactacgtcaccttcctctagtgaaagtgaagaagcaaaaggggaagaatctagtgaagaattctacccccatgaagaaggacaacctttaatggttaaggaggagtgtaaggaggtaagtgcctcctccaagaggaataatcaacataaaaatacagaaaaaggggttcccacgaaccctaagagaataaaggtcattcctgattggcccactccaccaagtataaagggaaatctggggctgccatga

SEQ ID NO: 62149 - DNA, 237 bp, Glycine max
  Peptide Sequence Number=SeqID_153834
atgaggtccttcaatggtgattttccaccatggagatgcaacggaaggaaaaggaaaagaggagaggggaggcaccatccactagggaataagccatggaagaaggagtttcaccaccaagaatgtgccttggataagaagcttgaagatgatgctttaatggaggaaaagaaagagagggagaaagagagagaagggagcacgaaattgaaggaagaaaagagggagagaagttaa

SEQ ID NO: 62150 - DNA, 447 bp, Glycine max
  Peptide Sequence Number=SeqID_153835
atgaatgcttatggtgacaagcaatccgacttggggatcattgacaaggtattgagaaccttgacaccaagattcgatcatatagtggtggcaattgagcaaggccagaatcttgaagaaatgaagattgaagaattgcaaggaattcttgaagctcaagagatgaggctcaatgaaagaaattcacaaagatcagctgagcaagctatgcaagcccaaacaaccaaagggaacaactatgatggtggcaagaataagaaggaaagggaaagtggaagaacaataagtggaaggggtcaagtgaaggctccagcaattctgaaaatcataaccagaatgaagaaacagataagaaagatgaatgcaaaagtaaaagggttccaagaaatgcagatgaggctcaattggcacaagatgaagattctgactctgataaggtgttactaa

SEQ ID NO: 62151 - DNA, 177 bp, Glycine max
  Peptide Sequence Number=SeqID_153836
atggcttcctcgaatggaaattttccagcatccatgcctattctcaaaggcaagaactatgatgattggtgtgctcaaatgaagaaaattagatctgctgatactgcaaagaaggcatgggatactctagagaaatcctatgcaggggatagcaaactcaagaaggtgaagttgtag

SEQ ID NO: 62152 - DNA, 237 bp, Glycine max
  Peptide Sequence Number=SeqID_153837
atggagaattgcactaaccaatcactaggcttggctccaaagtggtgggtgggggatgcaggaaagaaaacgcaattcgttgggctccgaaaaaggggtagagattggagaattgcagcaagcagtccgcatgcatggctcctaacccgtgggtggagcatgaacgaaaacgcaattcatggggctccgaaaaagggtagagaatggagaattgcactaagcaatcactacgcatga

SEQ ID NO: 62153 - DNA, 354 bp, Glycine max
  Peptide Sequence Number=SeqID_153838
atgatcatcatcaaaacatcaaagtcatttgcttctacaggaagaggcggagaatttcaacttaatggtgtaaagaaaggaaagaaggatagaaaacaaaagaaggcctacatagcgtgggaagataatgcgtctacatcctctaactcttctagtgacgaagttgcaaatgtatgcttaatggcaaagtcaatagataactcatcaacgattgaaggaattgaggtaaatcctgaacttggagaagttttggaagcatttaatgaaatacatgaagaagctcaaaggcttggtgttttgaacaaaagtgatctaaaattgcatatcactaaatttggcttcaactcaaagtga

SEQ ID NO: 62154 - DNA, 619 bp, Glycine max
  Peptide Sequence Number=SeqID_153839
atggttgccgcccagctcgcccaggcgagccaggttgcttcctccagaagcaacagccttctggaggaatcttctggagggcccaagaagtttcacaaattgcctaatgatggtgccaagcaccttacaaggaccaaaaaaaggtgtgagaaaaacagtgcacggattgtttgttgtttacccgctctctgtgtgtggttggtttcacacctattccaacaagacacaagacacccgtgtccgcttcaaagttatcgctcatgcgccggaaaaggaagaatcgattgggaccaacatttggcggggatagggggcaacgcaatcaattggtttcctcgttggaaggaaggcaaggaaggagttcttttctcgtgtggggactaccctaatgttccattgatagggactaggggttgtattaattataatcccgcacttgccataagacagctagggtaccccatgaggggagcgccaatggaagggagtctctcacctttccttgtgaaagatttaggcacgcaaggtctcaaggttatacaaagaacccacaaggcgtggaggagtctattgaggaaagacaaggagcttaggggcatccgtaacggcgtcatcggag

SEQ ID NO: 62155 - DNA, 243 bp, Glycine max
  Peptide Sequence Number=SeqID_153840
atgatgacaaaggtgatgacaaaaagctcaaacatcaatcaaagaacaactcaaaacaattcaagagttcaagataagaatcaagaagaattcaagactcaagaagaaattttagagtcaagaatcaagattcaaggttcaagacctcaagaatcaagatcaagattcaagactcaaaattcaagaatcaagagaaggcttaatcaagataagtatgaaaattttttctcaaaaattgagtag

SEQ ID NO: 62156 - DNA, 525 bp, Glycine max
  Peptide Sequence Number=SeqID_153841
aagaataattatgacctttcaagcaatagctacaatccatgttggaggaatcatccaaatctgagatggacaagtcctccacaacaacaacagtctgtccctcattttcagaatgatgctgatccaagcaagccatatgttcctcttccaatacaacaacatcagtcacaacaaagacaacaagcaactgaggctcctcctcaaccttccttagaagagttagtgaggcaaatgaccatccagaatatgcaatttcagcaagagacaagagcctccattcagagtctgacaaatcagatggggcagatggctactcagttaaaccaagctcagtcccaaaattctgacaaattgccttcacaaactgtgcaaaatctgaaaaatgtgagtgccatcaccttgaggtctggcaaccaaattcaagtgcctccaccagtagcagcacctacacctgaacctatcaagcttcattctacacctgaaaaagaggatgagatagttgcactaaagagaaatcttccttaa

SEQ ID NO: 62157 - DNA, 309 bp, Glycine max
  Peptide Sequence Number=SeqID_153842
atggcagtgcagttaatccatgatcacgtggtgatggagtgcctagagggagtttgggagaccctcgaaggcaatgagaggtgccgattccgtgacacaattcgactcactgctaatttattagtacatccggaggaacccgcacgcacgcttcagcagcctgtggagtgtgaatcattgtttcaagattcactaaagaccaagccttgccttaaaacaaagtgttttcaagacatgcaaggctctggtaatcgattaccaggaagtgtaatcgattaccagaagacagggttgagaaatagctgttga

SEQ ID NO: 62158 - DNA, 192 bp, Glycine max
  Peptide Sequence Number=SeqID_153843
atgtgggagcgagccattggtcagtttgctcaagtgacctatgctcctgagtttgggacttccaagaccgttcaatcagagattactcgtcttgcacgttggtgggggtgccgtaaaacgaagagaagtgagttatcaagaataggatgttggacaaatggcctcagttaccttaagaaaaaggggggttga

SEQ ID NO: 62159 - DNA, 300 bp, Glycine max
  Peptide Sequence Number=SeqID_153844
atggtgaaaccaagaaacattctgctagcattgaaggatcacaatgtcaatagttgtacaacaatcaaacaaatatacaatgcaagaagtgcatatcgttcttccattagaggcagtgatactaaaatgcaacatctgatgaagcttcttgaacgggatcagtatattcattggcatagattaaaggatgaagatgttatagtacctacaaaacaaacagggatgacattctctgctggttttgcatatttggagggtgaacatgtttcacatcgtcaagaatgtcaaggcaaaatgtaa

SEQ ID NO: 62160 - DNA, 417 bp, Glycine max
  Peptide Sequence Number=SeqID_153845
atgtcaagatttacacgcgattctcctcaaatttcagccatcccatttcaattagaccttgcaccttacacttcagagccctacaatgctcaatggaacgccccggggcttctccgtgacaagcacacgttgcgttcgagtcgtattcttggagaaatggaggttgatgaacctcggctagggctttctcgctgcaaaattcatttcttggttggtgttttggtttatgctaaaggtggtgtttgtcattggaaatgcagtaggaatggcagtcacagcacgggcttctccttcatcctcaccctcttcatttgccgcagttttctcattcgtccaagcaggatgactaaatttgcctcttttcagacccacatcgatcctttcactggcaaagaccaaatccgcaaagctttgaag

SEQ ID NO: 62161 - DNA, 234 bp, Glycine max
  Peptide Sequence Number=SeqID_153846
atggagggtgctaataccttcctcaaacgtaaatacaactcccgaacttggaaatattcatttatgaccggtttccttcggtttttccgacgttttccacaaataaacgtcggtggcgactccgcgcatctttcctcctttggaaagcgcacctgtgagcctcgcctcgctcgcccgcaaaagggtaggttgcgacagttggcgactccactggggactgtttttgtgagttag

SEQ ID NO: 62162 - DNA, 291 bp, Glycine max
  Peptide Sequence Number=SeqID_153847
atggcagccgctgagtgtatgactagaggaaatccatctgacttacaaccctttgatcctgagatagataggacatttcatagattagttacacatcatttagtaccttttgagcatcctgagcattctgttattggtgattttgagcattatagttttgagcattctgattttgaacattctgagaacatggcacaccctccaccccatgagaggactctaagggaattggctgcacctgatttcacctacgaaagcttgtgcatccaatatcttgttgaggatttctaa

SEQ ID NO: 62163 - DNA, 258 bp, Glycine max
  Peptide Sequence Number=SeqID_153848
atgtaccctccacgtgaactgatccacaagagatgtaccctctcttgtaccacaaaggatgtatcctccaatgtgttaagacaaagaattcttaagcgggaaagggaagaatcaaaagaattcttagactgtgtccttttgaattctcttgaaaagggagaagggagacacaaaagaattcaggcggttagtccttcgttcttttggaaaagggagaagagagacacaaaaagaattcaggcgattagtccttgttga

SEQ ID NO: 62164 - DNA, 282 bp, Glycine max
  Peptide Sequence Number=SeqID_153849
atgttttcacagcatttgattttcctttttgtagaaaagaaagaggggaacgagcaacaatttgaagagcggctacgcaagaagcttgcacttgaggagggaaggatatttgcagctaatgaacaaggtcttgatgatgctccacagcctaaatcaaaggctcctgctaggtggattgtcgtcaagtgtaatagacaaaatggaactactgagtgcggctactatgtcatgcactggatgtccaccatcattttaggaagttttagaaataattgggaagcg

SEQ ID NO: 62165 - DNA, 384 bp, Glycine max
  Peptide Sequence Number=SeqID_153850
atgtacaaagataattggacccaaccttggcccatgggctcagaaatctaccctaaggttcatgagaaccctagggccttcttcagcagctctagcccaatcttcttggagcctcttgctcatggttctattgattggtcccttcctagggaggattgcatcaatatgttgataattataaaccaatataaggataaggtaaacctggctgctagtcatgggcagatgctggaagatgaacaggcaaaggtattggctctgcatattgaaagggaagcgaaagaaagggtgatagagttattgcatggggaagctatgaaatggatgaatagattcgatctcactctgaatgaaagtcaagagcttccaagggttgttatctag

SEQ ID NO: 62166 - DNA, 500 bp, Glycine max
  Peptide Sequence Number=SeqID_153851
agagagtgtgtgcatcccaagtgagcgtgagacacttttgaagtttaagaataatctgaatgatccttcaaataggctttggtcttggaatcataatcataccaactgttgccactggtatggagtcctctgccacaacgtcacttcccatcttcttcagcttcacctcaactcttcaccttctactgctttctatcgttactatgatggctacgattgggaaggttataggggattccagtttggtggagagataagtccttgtttggctgatttaaagcatttgaattacttggacttgagcgccaatgattttgaaggtatggcaattccttctttccttgggacaatgacttccttgactcacctcgacctctcgtatactggattcatctggaagattccatttcagattgggaatctctccaatttggtctatcttgaccttggaagtgattttttggagcctctgtttgctgaaaatttagaatgggtatcaa

SEQ ID NO: 62167 - DNA, 123 bp, Glycine max
  Peptide Sequence Number=SeqID_153852
atgacgtattgtaatcgattacaggtattggtaatcgattacaggcccaataagccttctggctgcctgttcatgtgtaatcgattacactggatggtaatcgattaccagagcctatcctaa

SEQ ID NO: 62168 - DNA, 324 bp, Glycine max
  Peptide Sequence Number=SeqID_153853
atggatgcacctggtttggagcattataattttgagcattctgattctgagcattctgattttgaacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggaattaatgaaacattgggcttaatccggattttggttgtggacttgaagagggcaaataaagcagcgcttaccttagttaatttctaa

SEQ ID NO: 62169 - DNA, 328 bp, Glycine max
  Peptide Sequence Number=SeqID_153854
atgactagaggaaatccatctgacttacaactctttgatcctgagatagataggacatttcatagattagttagacatcatttagtaccttttgagcatcctgagcattctgatattggtgattttgagcattataattttgaacattctgattttgtacattctgagaatatggcacaacctccaccccgtgagaggactctaggggaaatggctgcacctgatttcacctacgaaagcttgtgcatccaataccctgatgaggatgtcccatatgttcttaaaactggaatgatccatttgcttagaaagtttcatggccttgcag

SEQ ID NO: 62170 - DNA, 171 bp, Glycine max
  Peptide Sequence Number=SeqID_153855
atgacgagagtgatgagcaaaatgatggcaacagcgacgaagtctatttcgctgaagcctttgggaagagacggcaccgcgaggcgccatttggtggaggagattctaattgtggtgcctaggtacgccgtcaagcctctggcaacggagaagttatgtagcttatcatga

SEQ ID NO: 62171 - DNA, 222 bp, Glycine max
  Peptide Sequence Number=SeqID_153856
gcgaggctcacgagtgcgctttccaaaggaggaaagatgcgcggagtcgccaccaacatttatttgtggaaaacgtcgggaaaatcgaaggaaaccggtcaaaatgaaaattctaagttcgggagttgtatttacgtcgacaaaagcggggcttttgctcctacgtaccctccatcaaagaggaaatcagacatacgtagttcttccttatgcgtgaatcaa

SEQ ID NO: 62172 - DNA, 201 bp, Glycine max
  Peptide Sequence Number=SeqID_153857
atgaagttcatgaatgattggctcttggcaagtaggagattgttgggaataaatgtagaagcaaagcttcatggtgaatcaaaggtgattcaaagagatgacgacaaaggtggtgacaaaaagctcaaagatcaatcaagaaaaattcaagagttcaagataagaatcaagaagaattcaagactcaagaagaaaatctag

SEQ ID NO: 62173 - DNA, 514 bp, Glycine max
  Peptide Sequence Number=SeqID_153858
ttcttcaagggaaggttgcagaggagcctcaactgtttgttgtttctggggttgttgctattgttgttgttgctgctggattggtggaggaacgtatggtctgcttaggccagcagtattctgaaaataaggttgggatgattcctccacccaggattgaacctgttgctggagaggtcataattgttctgttgtggctgattttgttgcggaggttgaggaggtctattgaagatgttttgccgcataagcttcaggctgttcaattgcttcagattgctgcacataagggcaaaggtctgtgtggtgggtcggcagaggagcataaaccacagagtctggcgacagatgaattcgtggctacttcatgcactcctctaatgacaatagcatcacttctggcactaaattgctgggagtttgaagtcatcttctcaattaaatttctggcttcagcaggggtcatgtctctaagggctccaccactggcagcatctatcatacttctctccat

SEQ ID NO: 62174 - DNA, 75 bp, Glycine max
  Peptide Sequence Number=SeqID_153859
atgaagaaagagtgtcccaagtacgccacatggcgtgtaaagaaagggttgcctatggagtcgactgccaagtga

SEQ ID NO: 62175 - DNA, 450 bp, Glycine max
  Peptide Sequence Number=SeqID_153860
atgtaccctcccttgttctctttgaaaccctccactagaactgatccacaagagatgtaccctctcttattcttagtcaaacccaaggaaagggaagaatcaaaagaattctcagactgtgtcgttttgaattctttgacaaggaagaaggaagacacaaaagaattcaggcggttagtcctttgttcttttggaaaagggagaagagagacacaaaaagaattcaggcggttagtccttggcgaattctttttggcaaagggagaagagaatgaaaagatgaatagcacaagttttcaaggtttggaaaaccagaaaacttcagaaagcttttggtacaaagaagaagaagaagttcaaagagaatcaaggcttgtaaagggttgtaagaaattgattggaaaagtattcaagattcttgaaatgcaaaacaaagccttgcttttatag

SEQ ID NO: 62176 - DNA, 156 bp, Glycine max
  Peptide Sequence Number=SeqID_153861
atgaagaagctgaaactacttgaccgtcagattatggcccgatcttctcccaggatcaagagaaagctcttcgccttccccttattgatattgattagggtagggctagatgacagaaaggagccagaaggagcaagcttcgtctatgcggactga

SEQ ID NO: 62177 - DNA, 491 bp, Glycine max
  Peptide Sequence Number=SeqID_153862
actctgaagaaacgatcaagaagattaaggtgaaagttaagggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaagcctcaattttattttaagataaatgaagctggtgcaaaacggtattgcaaattgagtatgggaagaaaatgggctgcaaataggcaaagcttatggaatgaattcaacgatccaaccaaaacaagagatgaaatcataaaaaatgtgccgataggcatagataaagatcaatgggctcgttttgttcatgatcgtcataaaccatccacattggtacaattagattgttttaattattga

SEQ ID NO: 62178 - DNA, 97 bp, Glycine max
  Peptide Sequence Number=SeqID_153863
aacttgtaaaaggaatttacaagatagtggaactctcaagcgggttgcttggggactggacgtaggcgcgggaagtggccgaatcagtataaatcaa

SEQ ID NO: 62179 - DNA, 835 bp, Glycine max
  Peptide Sequence Number=SeqID_153864
atgatgttgggccgcgttcttcatcgtcgccatgtcgatcacgaagcggtagcgcacatcgttcttcgccatgcgttcccaggcttcgttgacgttcttgatgtcgatcatctccacatcgctgacgatgccgtgctcggcacagaagtccatcatttcctgggtctcggccatgccgccgatcgccgagccggtcaggtgcttgcggccgaagatcacgctgccaccggtcagcggcgggtccagttcggtcagtacgccgaccaggcacatggtcgcctcgcgcttgagcaggcccatgtacgggttggtgtcatggccgaccgggatggtgttgagcaggaagtcgaagctgccggcgtgcgccttcatctgcgcggcatcgcgcgagaccagtacctcatcggcgcccaggcgcttggcatcggcacccttttccggggtggtggtgatcatcaccacgtgcgcgcccagtgccttggcgaacttcacgcccatgtggccgaggccacccagaccgatcacgccaaccttctggcccgggccgaccttccagtggcgcagcggcgaccaggtggtgatgccggcgcacagcagcggggcggccgccttcaggtcgagggtgtcggataccttcaccacgaagcgctgctcgaccaccacgtggtcggaatagccgccgtaggtcggtgcgccgctttcgcgttcacggccgttgtaggtccaggtcgcgccttcggcgcagtactgctccaggtcgtgctcgcaggcgtcgcagtggcggcacgagtcgaccatgcagtccacgccggcgtggtcgccgaccttgaagcgg

SEQ ID NO: 62180 - DNA, 193 bp, Glycine max
  Peptide Sequence Number=SeqID_153865
atggcccgatcatttatcaaaggccaatcttcggtagaagagaaggagttcattttggccacggtactagaaaatggaatcctaaaaatgtcaccttatatatctgcaaagcgtaagggtattcatattacaaatcttattagaactgctcgggttttatcagaagcttgtgatttagtttttgatgcagcaa

SEQ ID NO: 62181 - DNA, 156 bp, Glycine max
  Peptide Sequence Number=SeqID_153866
atgtttgttggaattgccggtttgggaagattccttgatggtcattggattgagtcccagcctggaggtcagacccagaaggaggttgaggatttcttagtgtggctctggaagagccagtctggctcctttgcctatacttcgtcctccccttag

SEQ ID NO: 62182 - DNA, 144 bp, Glycine max
  Peptide Sequence Number=SeqID_153867
ccctacaatgctcaacggaatgccccggggcttctccgtgacaagcacacgttgcgttcgagtcgtattctcggagaaatggaggttgatgaaccttgggtgatgttcgtcattggaagtgcggtagacagactttgtggttga

SEQ ID NO: 62183 - DNA, 231 bp, Glycine max
  Peptide Sequence Number=SeqID_153868
atggaggtgtcgcaacaagcccttttgcgggtgtgcgaggcgaggctcacgtgtgcgctttccaaaggaggaaagatgcgcggagtcgccaccaatgtttatttgtggaaaacgtcggcaaaaccgaaggaaaccgatcaaaacgaaaattctaagttcaggagttgtcgacaaaagcggggctcttgctcctacgtaccctccatcgaagaggaaatcagacctacgtag

SEQ ID NO: 62184 - DNA, 332 bp, Glycine max
  misc_feature (32)..(32): n is a, c, g, or t
  Peptide Sequence Number=SeqID_153869
tggatgtaccctccactagaactgatccacanagagatgtaccctactcttgttcttagtcaaacccaagtagatgtaccctctacttgtaccacaaaggatgtaccctccaatgtgttaagacaaagatctcaggcggttaaacctttgatactttgtgaatggggatacaaaagaattctcaggcgggagaagggagacacaaaagaattcaggaggttagtccttcgttcttttggaaaagggagaagagagacacaaaaagaattcagaaaacttcagaaagcttttggtacaaagaagaagaagaagttcaaagagattgaaggctt

SEQ ID NO: 62185 - DNA, 680 bp, Glycine max
  Peptide Sequence Number=SeqID_153870
atgacctctcggtttagccaacgcatacgtctgcgtcacctgcacgcctttgtcgccaccgcgcagcaggggacgctggtgcgcgccgcacagcaattgggcctcacgcagcccgccctctccaaaacgctcaatgaactggaaagcctggccggcgagcgcctgttttcgcgcagccggcagggggcggaactgaccgccgccggaacgcgtttcctgcaggatgccagccgcgttttggatgcgctgaatgtgttggggcgcacgcttgcctcggacagcgaggcgctgccggcgccgctgcatatcggcgcgctgcccaccacgctggtgagcctggtcgcaccggtcgtggtggggttgcagcagcaatcccccggctggcgcatgcaggttacgacgctggccaacgatgcgctgatgatggcggtgagatcggggcaattaacgttaggcatcgggcgcatgtcagacccctcccgcatggaagggctcaacttcgagctgctgtaccatgaaacgctgcggctggtggttgctcctcatcatccgctgttgcattcggatgtctcgctggcggaggcgttgagctggccattggtgctctccccgcgaggtaccgtgccgcgtcagaatgcggaggcgctcattgtcagccatgggctggcggtgccggaagg

SEQ ID NO: 62186 - DNA, 275 bp, Glycine max
  Peptide Sequence Number=SeqID_153871
cacaattcgcagaattagaagcttttgcccaattcgtttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacagacattcactggggaagcagaagtccttttgaaggaagctattcaagaacagatggaactctttttactacaggaacag

SEQ ID NO: 62187 - DNA, 132 bp, Glycine max
  Peptide Sequence Number=SeqID_153872
atgaaggttgaaggcatagggagcatgaagatgaagcttcatgatgccttgaagaggaaccatgatagcaaagtgaggaagaaaatgaagttttttaatgttatggaagtgttgggagatacttccgtttga

SEQ ID NO: 62188 - DNA, 237 bp, Glycine max
  Peptide Sequence Number=SeqID_153873
atgaggtccttcaatggtgattttccaccatggagatacagtggaaggcaaaggagaagaggagaggggaggcaccatccactagggaataagccattgaagaaggagcttcaccaccaagaatgtgccttggataagaagcttgaagatgatgctttaatggaggaaaagaaagaaagagagaaagagagaggggggagcacgaaattgaaggaagaaaagaggaagagaagttga

SEQ ID NO: 62189 - DNA, 324 bp, Glycine max
  Peptide Sequence Number=SeqID_153874
atgatgataacaaaagatgatgacaaaggtaatgacaaaaagctcaaagatcaatcaaagaacaactcaagtgaatcaaagatcaatcaaagaacaactcaagtcaatcaagaagaattcaagactcaagaagaaagttatgagtcaagaatcaagattcaaggttcaagatctcaaaaatcaagatcaagattcaagactcaagattcaagaatcaagagaaggcttaatcaagataagtatgaaaaggtttttctcaaaaattcaatagcacatggtttttctcaaaaacatgtttaccaaagagtttttactctctggtaa

SEQ ID NO: 62190 - DNA, 480 bp, Glycine max
  Peptide Sequence Number=SeqID_153875
atggcggtggttaatgccgttgagtccgataggccgcgtaggtctaaacctttaagggatgtggcaaccctaggaggtttatctttgaggccctacaaaagggagcggatgatagatcaaggtcgactggaagttgacagtgaaggaagagaggagcagcacatatgcatgcagtccacggatgggagcgttgttgtaaagcccaaacccttggtgatatacttcaccaagggcaaagcttcgcaaaagcccggacaccctttggcagctaaacctgtccctttcccgtaccaaaatagccacgcagtcccatggaggtatacacctccgagggggaaggaagaagaagtcaccgacgtcagctcgttgtcggctaaggtaacaaatatcacgggaccgagtggtgtgacccgtagcggtcgtgtgtttgcacccccggacctaccagtccaacccgcgaacgtcaaggggaaagcaaag

SEQ ID NO: 62191 - DNA, 488 bp, Glycine max
  Peptide Sequence Number=SeqID_153876
atgtccaaatcttgtggatttgggatgaccggccctctcgatgagtcgatttcttgctttctcataagggtggacccttgggtacttgtacctatcgcctttagaggactacacatcctcgccttcagaggactgcacgtcctcaccttgagaggactacacgtcctcgcctttagaggactacacgtcctcaccaacagagggctgcacgccctcaccttgagaggactacacgtcctcaccttcgtagggctacacgccctcacctttagaggactacacgtcctcgccaacagagggctacatgccctcacctttagaggattacacatcctcgccaacagagggctgcacgccctcaccttgagaggactacacgccctcacctccagaggactatacatcctcgccttgagagggttgcacgctctcacctttagagggctacgtgtcctcattttcagtgtgctccacatccgcaccttaag

SEQ ID NO: 62192 - DNA, 448 bp, Glycine max
  Peptide Sequence Number=SeqID_153877
gcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggctgatcttccccaagagctcacatcgacgggaaggtttggcacctcgatgtcggctcttcgccacctgggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaag

SEQ ID NO: 62193 - DNA, 441 bp, Glycine max
  Peptide Sequence Number=SeqID_153878
atggcagaaccatcgaagaagcgcaagggttcttcaagtagaagccaacagcactccaaggctcaggatattccaattccttcctccatttcctcctcctcattgttctcatcggaagaacaacgtatacggtacacaaacctcttctcctctcattctatcactgaccctaagttcatagatatggatttcttttctgatgagagtttcgaatgcattcaagcatttcaaaactcaaatctcattccctttatgtctttaaaactacctgtgtattctgaattggaaaaagccttttgtcgcaacctacccttcggcgggagggcgacgcgagggttcacgggtgcgtcttccatgggaggaagatgcgcggagtcgccaccaacgtttattcgaggaaaacgtcaaaaaaactggaaagctatggtctacgaactttaa

SEQ ID NO: 62194 - DNA, 705 bp, Glycine max
  Peptide Sequence Number=SeqID_153879
atgtggttgaaaggggtgaagacccctgtggttctgtctagaaatcgcgatgaacgcgctaagcgtgcctgtgcgcttagcctgttcatcgcaactgttaaaattttggatttccagatgaacgcgctaagcagaccatgtcgcactaagcgcatggcatctaagaagaggaaagctccttctacacctacccaggccagatttgatagatccaggttcacatcccaagaggctagggagagatatacagacattgttgtgcctcgcaagctactaccagagaggaatgtggtagtttattacacagagtttgatgagttcaaggaggaactcgagaggagacattgggatgagaagatgactgatttttctgacagtagcatatacattgctattgtaaaggagttttacgccaacctctatgaccccgaggataaatcacctaagcagacccctgtagtgctggaagagggggagaacttgtgtacttattccaaatttgcactcctgaggcctgatcctcagaagttggctactaagctttttatcccagggaggggattcaagcttaatgctgatgggcagcctttgaagattttgatgaagaacatgaccattctagctcagacatggagcgttctctccttttctaacctcattcctacctcccacacatctgatgtcaccttggacagagccaagtga

SEQ ID NO: 62195 - DNA, 204 bp, Glycine max
  Peptide Sequence Number=SeqID_153880
atggtcttcttgaccagacatgaagagtctataaaaagggtacatctacttgggttgttgactaagaacaagagagggtacatctcttgtggatcagttctagtggagggtacatccactaagttcaaagagaacaagggagggtacatcccttgtggatctttgcttgtaaaggaattttacaaggttgaaaagaaatcttaa

SEQ ID NO: 62196 - DNA, 267 bp, Glycine max
  Peptide Sequence Number=SeqID_153881
atgtgggaggaagttgttgagaaatttctgaagaaatacttccccgagtcaaagactgcagaagggaaagctgctatttcatcatttcaccagtttcctaatgaatccttgagtgaagcatgggagaggttttggggttgtaccatttgtggtggtgctcatgaatccagcaattgtattcctttggaagaacaaacacaggaagttagttacatgggaaatcaacaaaggcaaggatacaaccaaggaggattctcaggtttctag

SEQ ID NO: 62197 - DNA, 825 bp, Glycine max
  Peptide Sequence Number=SeqID_153882
atggataagaagatccgcagtattgtgagtaacattctgaaaaatgcctctgttcctgatgctgatgaagatgttccaacatcttccaccccaaatgcttctgtgcctgatgttgagaaagatgttccaacatcttccgccccaaatgccgaagtcctctcttcctccagcaaagagagatcaatagaggaagatgatcaagccgcagaggagactcctgcaccacgggcaccagaacctgctccagaacgattacaaagccgaaaaggaaaaacccccattaagagatcaggacgaatcaagactatggcacagaagaagagcactccgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcacggctgctggaccgctgaagactgtcaccaagttgggagattgccatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtg

SEQ ID NO: 62198 - DNA, 471 bp, Glycine max
  Peptide Sequence Number=SeqID_153883
gtcgaggatgttgatgaagagaaggagaaggaagaaaaaaagaaaaagaagattaaggaagtgtcacatgaatgctccttggtgaacaagcacaagcccatttggatgagaaagcctgaggagatgacaaaggaggagtattctgccataatgaacagcagttcaatcagtttaataaggagtatgacaaaggaggagtattctgccaagattcatttattattcacggagatatcaagtcttccaacattcttcttgatgccagctggacggcaagagtatctgattttggatgggaagtttatgagaaacagacaacgtataattgagaacactgatcctgagtacgttattcgaggtgcattgttagcagagagtgatgtgcatgggcttggagttgtactgtttgaacttctaacaggaaagagacctacatttcgtgtacggggaagatggaggcacccttattaa

SEQ ID NO: 62199 - DNA, 252 bp, Glycine max
  Peptide Sequence Number=SeqID_153884
atgtcaggatttacacgcaattctcctcaaatttcagccagcccgtatcaattagacttcacactttatgcttcggggtcatacaatgctcaatggaatgccccagggctcctccacgataagcacacgttgcattcgagtcgtatcctcagaaaagtggaggttgatgaaccttggctagggttatggctaccattgaattatcaagtggtcttcgtcattggaagtgcggtagacagactttgtggttga

SEQ ID NO: 62200 - DNA, 183 bp, Glycine max
  Peptide Sequence Number=SeqID_153885
atggtagccataaccccagccaaggttcatcaacctccatttttccgaggatacggctcacacacaacatgtgcttatcatggaggagccccggggcattccattgagcattgtagggccttgaagcgtaaggatcttcaagtttatgccgttattgtaaaccaccgttacaatgctgaataa

SEQ ID NO: 62201 - DNA, 181 bp, Glycine max
  Peptide Sequence Number=SeqID_153886
atggatatcgtgcgcgccatgcgtctgctcgtgccaccggcctggcagaacaacccggatatggatccagagctgcgtgcgttcttcgactttaactccatgcacatggagccgtgggacggcccggcgggcatcgtgatgtcagacggtcgttttgctgcctgtaacctggaccgtaacg

SEQ ID NO: 62202 - DNA, 537 bp, Glycine max
  Peptide Sequence Number=SeqID_153887
atgcagttgccgcaattagtcaatatgtttggcgcagatctccagcgccgccatggcgaaaagatccataaactcacgctgcacggcggattcagctgccctaaccgcgacggcacgttggggcgcggcggctgtacgttttgcaacgtcgcttcattcgccgatgaggcgatgcagcggcaaagtatcgccgaacagctggcgcagcaggccgcgcgggtcgaccgggcgcggcgctatctggcctattttcaggcctataccagcacctatgcggaggtcgaactgctggcgtcgatgtatcggcaggcgttggcgcagagcgacatggtcggcctgtgcgtcggcactcgcccggactgcgtgccgtccgcagcattggatctgctgacggggtatcgcgaagagggttatgaagtgtggctggaactggggctgcagacggcgcacgataaaacgctcaaacgcatcaaccgcggccatgatttccgctgctatcagcagaccgcgcaacgggctcggcagcgcgggctgaag

SEQ ID NO: 62203 - DNA, 243 bp, Glycine max
  Peptide Sequence Number=SeqID_153888
atggattcattctatggccacttcaaagggcagcggggtcttagacaaggggatcctctctccccttatctgtttgtgctttgtttggagtacttttccagaaatatgagcagcctcaaggatgatgccaattttaaatttcattcaaactgtgcagatgttatgccactatgctcccttgctttccaagattactggcctgatttagggatggagcaggaagtctttatcttatgcaggtaa

SEQ ID NO: 62204 - DNA, 156 bp, Glycine max
  Peptide Sequence Number=SeqID_153889
atgactctaagacaacatggattaagcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 62205 - DNA, 297 bp, Glycine max
  Peptide Sequence Number=SeqID_153890
atgtcaggatttgcatgtgattctcctcaaatttcagccagctcgcatcaattagaccttgcaccttacgcttccgagtcctacaatgctcaatggaacgccccagggcttctccgtgacaagcacacgttgcgttcgagtcgtattctcagagaaatggagtttgatgaaccttggctagggttatggctaccattgaattatcacctcgctataccaaaggcatgcaggcaaatggaaacatcgagtggcgcctcatccgcatttctaggcacgaaatcgagttttgttgggtga

SEQ ID NO: 62206 - DNA, 604 bp, Glycine max
  Peptide Sequence Number=SeqID_153891
ttctgaggaccgtccaccaaagcagtccagagtcagaggtcatttggtgaagattgatgctgacagtctcaacacattcctggagatacctgtggtattagctgagggagagactctacccgcatactccagatactgcaggaaggatttgactacactagctcaggtgtggagtgtcctctcatactccaacttgtcccccacatcacatacctctgatctgatagcggacagagctaggctgatctttggcctagtctctcgcttggatatgaacataggagcgttgatctctggccagatgacctctatagcccagtctaacacgtctagacttgggttccctgctcttatcaccgcattatatagggccagaggggttgtctctgacagccttacctttgagcgcctgagcctggtcattaacttggcctacatcaggaagaactattggaatcccgacgatctaacagtttctatccgaggggctaggagggcgagggcaaggccagctgagcttccttcaacttctgcagcttctactccagcatccacttcagtcagccctttctgtcctaactcagacaaattctcagcactttga

SEQ ID NO: 62207 - DNA, 1257 bp, Glycine max
  Peptide Sequence Number=SeqID_153892
atgctgacaaagtgcgcgtcgtcgcgcgtcagaaagctggtggcgaagatcatcagattcggcagcaacacgaacagcgtcagccagccgacgatcagtgccacaatggctttctgcagacgattacgcatccgtttcatacggcagcaccacctcccagtttggcacccagctgaccgccattttctggttcagcgagtggtcaaaatccggatcgtcctcattaaagaactcgctgacggtgagcagcttgccgttctccagttcgacggtggattccagcgtcatgcctttgtagttgcgttcgcgcacatagccgatcaggttttcgttgcggctgtcgtgatcgatctcctcgacgcgcaaatcttcaggtcgcagcagcacatgcagccgatcgccgggtttgaccgggaacgggcagtgaatatcacactcgcggccttcgacgcgagcccgtacctgcggcgcctgcgcgctgccgatcacttctgcatcaaacacgttgatttcgccaatgaagcgcgccacaaacaggttcgcgggctcttcgtagatctcgcgcggcgtgccgtcctgctcgatgcgcccgtcgcgcattaccacgatgcgatcggacatggtcagcgcttcttcctgatcgtgcgtgacaaacacaaacgtgatgcccagcttgcgctgcagtgctttcagctcgttttgcatctggcggcgcagtttgtaatccagcgcggagagcgactcatcaagcagcagcactttgggccggttgaccactgcgcgcgcaatcgccacgcgctgctgctggccaccggagagctggtgcggccggcgcgcggcaaagctttccagctgcaccatcgccagcgcctcgttgacgcgctgcgtcagctctgccgccggggttttctgcatgcgcaggccaaacgcgacgttttcaaacaccgacatgtgcggaaacagggcgtagctctgaaacacggtattgatatggcgatgctcggcgggcgtttcagtgatgtcgctctcatccagatggatacgtccgctgtcggcgttttccagcccggcgatcaggcgcagaatcgtggtcttaccgcagccggaggggccaagcagggtgataaattcgccatgaccgatggtcaggtcgaaatccgggatgatggttttgccatcgaaagctttactgatgccagaaagcgtaaccagcgcctgctgcgcgcgtgtttgcgtcattttagtcactcagtctga

SEQ ID NO: 62208 - DNA, 1047 bp, Glycine max
  Peptide Sequence Number=SeqID_153893
atgcgccaaccgcgccgccgccttcgactcgcccgctacaaaaagaaccgccgcaaagtgcatcagcgctttcgccagcgcatctttgagcgcgatcgtcaggttgaacttgccgcccatccgcagccgcacgtggtggtgctgaccggtgccggaatttcggcagaatccggcattcgcacgttccgcgcggaagatggcctgtgggaagagcatcgcgtggaagatgtggcgacgcccgaaggctttcgccgcgatccggcgctggtgcagggcttctacaatgcgcgccggcgtcagctgcagcagccagaaattcagcctaacgcggcacacaaagcgctggccgaactggagcaggtgctgggcgataatttcctgctggttacgcagaatatcgataacctgcacgagcgcgccggcagccagcgcgtgctgcatatgcacggtgagttactgaaggtgcgctgtgagcacagcggtcaggtgctggcgtggacggaggacgtcggtccggacgatcgctgtacctgctgccagttcccgtcgcggctgcgtccgcacgtggtgtggtttggtgaaatgccgctcggcatggaggagatttatcaggcgctggaacaggccgatctgtttattgccatcggtacctcaggccacgtctacccggcggcaggatttgtgcacgaggcgaaactgcagggtgcgcataccgtggagctgaatctggcccccagtcaggtcggtaatgaattcgctgaagcgcattacggcttagccagcgaagtggtgcccgaattcgtgcatacttttttgcgcggcttgctaaatccggcacgcatgaaccctctcccaatgccgaatccagcacgaatgaaccctctccctctgggagagggcagggtgagggccaggccgcaccgaatccccacctcagaacctcaccgtcccgctttcagcttctggaacagcgtttcgtactgcacgctggcggcaccgacatcgttctgccactcgccgtttttgatcacgtcagccggcggatag

SEQ ID NO: 62209 - DNA, 1200 bp, Glycine max
  Peptide Sequence Number=SeqID_153894
atgtatcaaccagtcgcgttattcatcggtttgcgctacatgcgtggacgtgcttcagaccgtttcggtcgtttcgtctcctggctctcgactattggtatcacgctcggcgtgctggcactggtgacagtgctgtcggtgatgaacggctttgagcgcgagctggaaggcaacattcttggcctgatgccgcaggcgctggtgaccagcgacaccggcagcatcaatccgcagcagatgcgcgcgcaggatctcaaactgcagggtgtgacgcgtattgcgccgctaaccaccgccgatgtggtgttgcagagtgcgcgcaacgtgtcggtgggcgtgatgctgggtatcaaccctgacgaaccggatccgctgacgccttatctggtcaacacccagcagagcgtgctgcagccgggccagtataaggtcattctcggtgaactgctggcctcgcagctgggcgtgaagcgcggcgatcagctgcgcctgatggtgccatcggtcagtcagtttaccccggtggggcgcgtgccgagccagcgcatctttaccgttgccggtacctacgcggccaatagcgaagtcgatggctatcagattctggtgaaccagcaggatgcctcgcgcgtgatgcgctatccgctcggcaacattaccggctggcgcctgtggctggataagccgctgaatgtcgatgcgctgagccagcagccgctgccgcaggggctgacatggaaagactggcgcgaacgcaagggcgacctgttccaggcggtgcgcatggagaaaaacatgatggggctgctgctcagcctgatcattgccgtcgccgccttcaatatcattacctcgctgggcctgctgatcatggagaagcaggcggaagtggcgatcctgcaaacccagggcttaacgcggcggcaaatcgtcgcggtatttatggtgcagggcgccagcgccggtattatcggcgcgctgctcggtacgctgctgggcgtgctgctggccagccagctcaacaatttaatgccggtgatcggcctgttccttgatggcgccgcgctgccggtggatatcaatgtctggcaggtgatcactattgcgctggtctcgatggccgtggcgctgctctctaccctctatccgtcatggcgcgctgccgccgttcaacccgctgaggctttacgttatgagtaa

SEQ ID NO: 62210 - DNA, 1896 bp, Glycine max
  Peptide Sequence Number=SeqID_153895
atggagcatggcgagtacgcgacgcgcggcgcgctgctcgacctgttcccgatgggcagcgatcagccttaccgcatcgatttctttgatgatgagatcgacagcctgcgcctgtttgacgtcgactcacagcgcacgctggaggcggtgagcgccatcaacctgctgccggcgcatgaatttcccaccgacaaagcggccattgagctgttccgcagccgctggcgtgaaaccttcgacgtgcggcgcgaacccgagcacgtctatcagcaggtgagcaaaggcacgctgccggccgggattgagtactggcagccgctgttttttgagcaggaactgcctaccctgtttagctatctgcccgccagcacgctggtgctgaacagcggcgatctgcacgccagcgctgagcgtttctggcaggatgctcacgcacgctatgaaaatcgccgcatcgatcctatgcgtccgctgctggaaccggccacgctgtggctgcgcccggatgcactgctcagcgagctgaaaaactggccgcgcatgcagctcagcgctgagacgctgccggagaaagccgcgaacagtaatctgggctatcagccattgccggagctgacggtgcaggcgcaggccaaagcgccgctcgatctgctgcgccagttcctcgaacagtttacaggtcaggtgattttctcggtagaaagcgaaggtcgtcgcgagagcctgcaggagctgctgtcccgcatcaaactgcgcccgcagccgattgatcgcttcgagcaggccgatgagcagccgtacagcctgatgattggcgccagcgagcgcggttttatcgacacccagcgccagcgcgcgctgatttgcgaaagcgatctgctcggcgagcgcgtcagccggcggcgtcaggacaatcgccgcaccatcaatccggatgtactgattcgtaacctcgccgaactgcacccgggccagccggtggtgcatcttgaacacggtgtgggccgctacatcggcctgaccacgctggaagccggcggtatcgtcgccgaccgttacgccggcggcgccgatgaaaatgcgccgctgcacaaactgggcagcgatgcctggtcacgcgcgcggcagaaagcggcggagaaagtccgtgacgtggccgctgaactgctggacatctacgcccagcgcgcggccaaggccggctttgcctttaagcacgaccgcgagcagtatcagctgttctgcgaaggttttccgtttgaaaccacgccggatcaggcgcaggcaattaacgccgtgctcagcgatatgtgccagccgctggccatggaccgcctggtgtgcggcgatgttggctttggtaaaaccgaagtggcgatgcgcgctgccttccttgcggtggagaacggcaaacaggtggcggtgctggtgccaaccaccctgctggcgcagcagcattacgacaacttccgcgaccgcttcgccaactggccggtgcgcattgagatgctgtcgcgcttccgcagcgccaaagagcaggcgcaggtgctggaacaggccagcgagggcaaaattgatattctgatcggcacccacaagctgctgatgagcgatttgaagtggcgcgatctcggtttgctgatcgtcgatgaagagcaccgtttcggcgtgcgtcacaaagagcgcattaaagcgatgcgcgctgacgtcgatattctgacgctcaccgcaacgccgattccgcgtactctgaacatggcgatgagcggcatgcgcgatctgtcgattatcgccacgccaccggcgcgccgtctggcggtgaaaaccttcgtgcgcgagtatgacagcctggtggtgcgcgaagcgatcctgcgtgaagtgctgcgcggcggccag

SEQ ID NO: 62211 - DNA, 570 bp, Glycine max
  Peptide Sequence Number=SeqID_153896
gaggacattcctgtgaataaatcaatgttagcgggtattggaatcggcgtagcagcagcgttgggcgtggccgccgtcgccagcatggatgtttttgatcgtggcccgcagtatgctcaggtgctttcggcaacgccaatcaaagagagcattaagcaacctcgtcaggagtgccgcaacgttaccctcacgcaccgtcgtccggtgcaggatgagaaccgcatcgccggttccgtactgggtgccgtggccggtggggtgattggtcaccagttcggcggtggccgcggccgggatatcgcgaccgtagccggtgcgctggcaggcggctacggcggtaaccaggtgcagggtgcgctgcaggatcgtgacacttacaccaccagcgagcagcgctgcaaaaccgtgtacgataaacaggaaaaaatgctgggttatgacgtgacctataaaataggcgaccagcagggcaaaatccgcatggagaatgaccctggcacccgcatcccgctcgaccgtaatggctaccgcaccgtacgcagcagcgcgtcacatagcgctgctgcgtga

SEQ ID NO: 62212 - DNA, 108 bp, Glycine max
  Peptide Sequence Number=SeqID_153897
atgatcatcttgggctaccttccggggtggggatcaaacatggacagcagaaaccgatcaaggtacttaggaacggatgcaagtggggatggggtcacgatcgactga

SEQ ID NO: 62213 - DNA, 351 bp, Glycine max
  Peptide Sequence Number=SeqID_153898
atgaaccacctgcaatcactgatgaaagtagctcagttgatgttgcgctatataagcggtgggaggtgggagcgatcaaaccgactcaacgtgatgttcattaagactaaaatctcaactcgaatacgtggttctattgatcagcatgaaaaggaagaagaaagccttgtaatggagacaggtgagagtgcattgttgacaactgcttatgggaagaataaagcaactaagtctcaagctaatcataaggggaatggtaaaataccacctcaagttgatattaagaaggtggcaaagtgtttcttttgcaagaagaaggaacatatgaagaagaattgcctcagattctag

SEQ ID NO: 62214 - DNA, 231 bp, Glycine max
  Peptide Sequence Number=SeqID_153899
atggcagcggaatggagaaggaagagagagaggcgacgccacttcaaggataagatgagtctagaagaagctcaccaccataggaggccatggataagagcttggaggaagaaggagatgaatgaagggagagggagagaagagcacgaaattttgtgctctaaacgagctttgaaatctgaacccactaatccaagatcaattccaagattctccactaagtgtgcttag

SEQ ID NO: 62215 - DNA, 336 bp, Glycine max
  Peptide Sequence Number=SeqID_153900
atggattcctcgagtcacagtccattcagaggtctaggcaatcacagtttgagtctgaaagttccactgcagcggacactggcggatggtggtcatcctgcccaaggaacacctagttgtctgtgctatcaaaagggtcttgatgatgctccacagcctaaatcaaaggcttctgctaggtggattgtcgtcaagatgtccaccatcattttaggaactttaaggaataattgggaagcgtattttaacgatcctagaccattggagccagagagattaaaagcattgcggatccagtgggcacagttttatctccgagttggagatcagacctag

SEQ ID NO: 62216 - DNA, 393 bp, Glycine max
  Peptide Sequence Number=SeqID_153901
atggagacgtgtttgggagtagaggaattgttacagcggatgatagatcaaggtcgactggaagtcggcagtgaaggaaaagaggagcagcatatatgcatgcagtccacggatgggagcagtgttgcgaagcccaaacccttggtgatatacttcactaaaagtgcagcttcgcaaaagcccggacaccccttagtagccaaacctgttcctttcccgtaccaaaatagccacgcagtcccatggagatatacacctccgagggagaaggaagaagaagccacccacgtcagctcgttgtcagctaaagtaacgaatatcacgggactaagtggtgtgacccgtagtggtcgtgtgttcgcgcctccggacctaccagtccaacccgcggac

SEQ ID NO: 62217 - DNA, 291 bp, Glycine max
  Peptide Sequence Number=SeqID_153902
agggtacatttacttgggttgttgactgagaacaagagagggtacatctcttgtggatcagttctagtggagggtacttccactaggttcaaagagaacaagggagggttattccaagatcatgatgaagaccaagtcaacttgtgtctcatgacaaaatctgatgagaataacaaagaagattctgtaaggaagaaatggtacatagacagtggatgttccaagtacatgacgagtgatgtatccaaattcacaactatttctcccaagaaaagtggacatgttacatag

SEQ ID NO: 62218 - DNA, 228 bp, Glycine max
  Peptide Sequence Number=SeqID_153903
atgaggaaagttgcctatgttttgaacaccgatattccggtggtacctgaggatgctgagaaggaaaagtatgatactgaggaagctgggactaaaaagtatgttgttagccgctacctcaagtatcaaatgactgatgataaatcagtagagtctcaatcccatgagatacagaaaattgctcatgatatcatatcagagggtatggcattggatgagcaatttcag

SEQ ID NO: 62219 - DNA, 357 bp, Glycine max
  Peptide Sequence Number=SeqID_153904
atggataccttagagccctacactggggcaatgaaagcctcaagtaaacctagggggcagattagaagttcccacccaattggttccctgctacgaaagacaacgattggtacctcaaagccctacactggggtaatgagggtcatcgtgcatgatcctcaagcgaacctaggggcagatcaaaagttctcacccatcgatgtttttgaacaaaaaaagggggacaaaccctggaatttatatggattgattaaacgtcaaacggctccattgttgtcactccaaaatggtcaagtgactaaatcaaacagaacatacactctgagggagttcccggagagatttgcaaaaagatag

SEQ ID NO: 62220 - DNA, 348 bp, Glycine max
  Peptide Sequence Number=SeqID_153905
atggatatgaacttggggtccctcatcgcagctgcccctaaccctgctccctctacatcagctccatctacttctgctcttcctccaccaccagcagctccagttcttccagcccaggagcctcagcaggaccaagtggacaacattctagaggcctcagagcccactccacctgagcctttcatttttgagactgatccagttattgttcaggaggatgttgcagtactagagccatctcctcagcctgagcctgagtcatcagcactagtgttggacctacgtctttctcaggatccatcatctgcaccagcactggacctgaatgagcatgcacaagatcattga

SEQ ID NO: 62221 - DNA, 503 bp, Glycine max
  Peptide Sequence Number=SeqID_153906
gtcatgtgacatgcacccttgtatcatccagaggcggcgggcccgatgatacgcggagataccttacggttattcgcacccttttgtcatccagaggcggtgggcccgatgacaagcagagaccaaaggcggcggacccgatgacaagcagagaccaagtttggtcattctgcacccttgtatcatccagaggcggcgggcccgatgatacgcagagaccaaagaccaagtttggtcattctgcacccttgtatcatccagaggcggcgggcccgatgatacgcggagataccttacggttattcgcacccttttgtcatccagaggcggcgggcccgatgacaagcagagaccaaacgcccgggaacaacaagtcatttacatgcggaaatttcatgatcgcccgcgactctcgtcaaccgagaggagcgaaattagtgtcatacactgattttcggggacctttgcttgatgacatgcgaccattctttggtccttgtgag

SEQ ID NO: 62222 - DNA, 114 bp, Glycine max
  Peptide Sequence Number=SeqID_153907
atgaagatgctcttgataccacatgatatgaatgacatcggaatggagaagaaagagagaaaggagatgtcacttcaaggagaagatgagtctagaagaagctcaccaccgtag

SEQ ID NO: 62223 - DNA, 271 bp, Glycine max
  Peptide Sequence Number=SeqID_153908
gaatttacaagatagtggaactctcaagcgggttgcttggggactagacgtaggcacaagggagactaagagatttctaacgaaaaatttcgaaatgaaagatcttagggaagcttcttttgtgttaggtattaagatactacgagatcgctctcaaggtatcctaagtgatgaggacaaggcaaggaataagggcaaggaacctttagaaggacttggaggacctatggcaagggctagaacaaagaaggtcaaggaagctcttcaacaa

SEQ ID NO: 62224 - DNA, 325 bp, Glycine max
  Peptide Sequence Number=SeqID_153909
ggaatgggaagaatcaaaagaattcttagactgtgtcgttttgaattctttgacaagggagaagggagacacaaaagaattcaggcggttagtcctttgttcttttggaaaagggagaagagagacacaaaaagaattcaggcggttagtccttggcggattctttttgacaaagggagaagagaatgaaaagatgaatagcacaagttttgaaggtttggaaaaccagaaaacttcagaaagcttttggtacaaagaggaagaagatgttcaaagatattcaaagagattcaaggcttgtaaaggattgtataagattgattag

SEQ ID NO: 62225 - DNA, 213 bp, Glycine max
  Peptide Sequence Number=SeqID_153910
atggctctgaagaagctctccacgaagaggtctagaaaggacgctactgaagaaggctctagtgtctccttggagtttgatagtcaccggttctggagtgctgagcaccagcagcgcttcgaggccatcaagggatggtcgttccacagggagagattccctcagccaattgttgggcgacccgctgattttggaggaggaccagcaatgtga

SEQ ID NO: 62226 - DNA, 129 bp, Glycine max
  Peptide Sequence Number=SeqID_153911
aggcttaaaaaggcaagagaacgaactgcattttctgtgttttttctggaaaatgtgatgaactcgctaagcgagcatgcagcgctaagcgagcatgcagcgctaagcgagttcatcgatattcattga

SEQ ID NO: 62227 - DNA, 360 bp, Glycine max
  Peptide Sequence Number=SeqID_153912
gttccactgcagcggacactggcagatggtggtcatcctgcccaaggaacacctagttgtctgcctaaatcaaaggctcctgctaggtggattgtcgtcaagtgtaatagacaaaaaggaagtactgagtgcggctactatgtgatgcactggatgtccaccatcattttaggaacttttaggaataattgggaagcgtattttaacgatcctagaccattggaggcaaagagattaaaggcattgcgggtccagtgggcacagttttatctccgagttagagatcaggcctatgatttagggacattatctttagctttagtttactttggtttaacatttttgacattttctatgtaa

SEQ ID NO: 62228 - DNA, 274 bp, Glycine max
  Peptide Sequence Number=SeqID_153913
atcctgtgatgatcttgaacttgtgttcgaaggagcagaaaataggtggatgactatgaagaatctcatgctagaggacacgggaacacaacgctctgataggattgagaaatgctctcaggaacggaagcttcgcgcacactccagatatcttctcgaagatcccaacggtaagatcatggacaagtgtcttttgaagctgaagaccaaatttcgagaagatccaacgattaacgaaggctgtgaagcatttttaacgaggcagctcatgtag

SEQ ID NO: 62229 - DNA, 258 bp, Glycine max
  Peptide Sequence Number=SeqID_153914
atgctttgcgtaatcgattacaatgatttgggtacatcctttgtggtacaagtagaaggtacatctacttgggttgttgtgactaagaacaagagagggtacatctcttgtggatcagttctagtggagggtacatccactaggttgttcaaagagaacaagggagagtacatcccttgtggatctttgcttgtaaaggaatttacaaggttgaaaagaaatctcaagaaccgcaggtcacttggggactggatgtag

SEQ ID NO: 62230 - DNA, 560 bp, Glycine max
  Peptide Sequence Number=SeqID_153915
cactgttcgccaattcgccattctcaatcttattcggagacccatgaattcattgcctagcgctgttcatgtgtcctccaccatcgagtctggagccccgcgaatagattgcctaacgctgttcaccaattctccattgtccacttttattcggagacgcatgaattcattgcctagcgttgttcatgtgtcctccaccatcgagtctggagccccgcgaattgattgcctagcgctgttcgccaattctccattgtccaatcttattcggagacccatgaattcattgcctagcgctgttcatgtgtcctccaccatcgacgctgttcatgcgtcctccaccatcgagtctggagccccgcaaattgattgcctagcactgttcgccaattctccattctccaatcttattcggagacccatgaattcattgcctagcgctgttcatgtgtcctccaccatcgatgctgttcatatgtcctccgttatcaagcacggaacctccggtgactgggaaatatggttttttgttattttccggatcggttccttcgccaaac

SEQ ID NO: 62231 - DNA, 282 bp, Glycine max
  Peptide Sequence Number=SeqID_153916
atgatagaacatgaggaacaaggaattaaagtgaattcaccaaacaaaaagataaaggaagcaaaagaacatcacctagacgaagatgctctgataccacatgatgtagctccatgtggagcttctaggccttggatcttcttcataaatggagtcctttgcttcttgaatatcatggaagaggaatggagaaggaagaaagatgattggagatgccaattcaaggagaagatgagtccagaagaagatcaccaccataggaagccacagataagagcttga

SEQ ID NO: 62232 - DNA, 151 bp, Glycine max
  Peptide Sequence Number=SeqID_153917
gaatttacaagatagtggaactctcaagcgggttgcttggggactggacgtaggcacaagggcaatcatgaaactcagctccaaactcgaaagtggaggacacatgaacagccctaagcaagaacattcatgtggctccggaaaaggatga

SEQ ID NO: 62233 - DNA, 489 bp, Glycine max
  Peptide Sequence Number=SeqID_153918
atgtgttcagtacaggattctttggacaagaaggcgtcacagggatcgttcatcccccatggacgtcaggatatccagactgctgtcatttggcgaccagagcaccctggccgtgttcgtgctgttggagccagtggacttgcactacctccagagccagaggttggtccctcaggtcctcgtgtcagcacaaaggagagttgtgttgctccctcaaggaacgatccagggacgggtgactcaaacaaatgcgggctatacattgaagaaaatccttcctgcctggttgccctaggaagactttatgagggatccacaacagttcacaacatccctttgttgcatgaccaagtcaaggttggtgttgaggaggttaaagatgcagagactctcgttcttgtacccattgacaaggttaccttagtggggcaggcacttaacaccttccttgcttggccaacacatcttgtgaagcgtttatcagaacag

SEQ ID NO: 62234 - DNA, 480 bp, Glycine max
  Peptide Sequence Number=SeqID_153919
atggacatagattatgctataaggaaagatgaaccacctgcaatcactgatgaaagtagtccaactgatgttgtgctatataagcggtgggagcgatccaaccgactcagtgtgatgttcattaagaccaaaatctcggctaggatacgtgctaatattaagaaggtggcaaagtatttcttttgcaagaagaagggatacatgaagaagaattgccccatattccaaaaatggcttgagaagaaagacacattgtttgagttattttataattctaaatgtgttgggaatggtatcttgtctggtggtctttatcttcttggtttacaaaattatgccacttatagttcaatgcatgttcaaattggtattaaaagattaggacatacctccattgagaggattaaagggttagtgaaagatggggtacccaatacttcgattttgctgactttaagacttgtgtcgattgcattaagg

SEQ ID NO: 62235 - DNA, 120 bp, Glycine max
  Peptide Sequence Number=SeqID_153920
atggaggaaaaacgtggaggaggctttggctgcgcagcagctctgatttcgaccaataagcctactggtaatcgattacaggatgttgtaatcgattacaggctgcctgttcatgtgtaa

SEQ ID NO: 62236 - DNA, 189 bp, Glycine max
  Peptide Sequence Number=SeqID_153921
atgaagaatggagaaaccatttatgaacttcaaacaagattcacccacattgtgaatcaccttcttggtcttggaaaaacgtatgaagatgctccatgtggagcttataggccttggattttcttcatcaatggagtcctttacttcttgaagatcaatggcagcggaatggagaaagaggaagggtga

SEQ ID NO: 62237 - DNA, 351 bp, Glycine max
  Peptide Sequence Number=SeqID_153922
atgatcggaagttttcaacaacaacaacaaatgtcagttctagaattatacgtagaaaaggatgttgctggtggttctatatttcatgctgcaaattctgttacgtcatgtggacataatgtatctcatcatgagtcggaactgccaagaaatataagcaatttacatgatgatgaagatgatgatgatgatgattatcttgcgtcagtaactttttatcatattaccactttcgtgaagacgatgaaacagtgcaccgacatcgcgcttgaaccagtttcaattgttcacccaactgaaggtgtaccaggaattcaaaatccattttggaataatgctttacatttataa

SEQ ID NO: 62238 - DNA, 420 bp, Glycine max
  Peptide Sequence Number=SeqID_153923
atgtgggtgtcgagggagcggtttccggcatatttcaggcgggaggagaaagagaagagcgattttaggcaggaggatgacaaagagaagagggagggcaagttgttgccgcttgttgccggaccaccgcaaggagaggaacactttaattggagtggaatctttgaaactcaactcgaggatttagtagagaacggagccttcgaccttcccttcacggtttcttcaagtcttgcaaaccctttctccctcaccagcaagaccttcttgtcactgttgtctccttgtcatgacactgcagtttgcgacctgtcaccgtcgtctccttgtcagcatcagtcgttacgtgtcatcattggcgctgttgaacctacaactggttcacgagttggggttcgtcactgctgtcacgagattgag

SEQ ID NO: 62239 - DNA, 54 bp, Glycine max
  Peptide Sequence Number=SeqID_153924
cgcacccgtgagcctcgtctcgctcgcccacaaaagggcacgttgcgacagtga

SEQ ID NO: 62240 - DNA, 489 bp, Glycine max
  Peptide Sequence Number=SeqID_153925
atggaaaaatccgacaagacaaatttcaaagaaaagaaagaaaagaaagtatacatcacttgggaagataatgacttggattcttcaagtgatttagaaaatgaaatcataaatctaggtctcatggcgaaagactatgaaagcggagaagagttggctatctcaacactcataaccattgggtcatcttacatagggttgattgtcttgaagtcatttgttgtgaaggcagtggccccaccccccacaaaacctctagctatggtgtttataacccaccccggttggtcgagggttctctcttccctctccctcgagcaactctggctcctacgcctttttgactggcctgcatgttcacaatctctacctcatctaaactcaggcactacattcctctgtcaagtggccacgattgcggagtgtactgcgtataacatggctcttgtggcagctgatccctcttctcgtcatctcgagccttgttag

SEQ ID NO: 62241 - DNA, 336 bp, Glycine max
  Peptide Sequence Number=SeqID_153926
atgactaactacctaagatatcttttgttttcccttacaaagattcaagggactaaccgcctaaaaattctttgtcttaacacattggagggtacatcctttgtggtacaagtagagggtatatctacttgggttattactgagaacaagagaggatacatctcttgtggatcagttcaagtggagggtacatccaattggctgttcaaagagaacaagggagggtacatcccttgtggatctttgcttgtaagggattttacaaggttattggaaatctcaagaaccggtggttgcttagggactggacgtaggcatgggttgtggctgaactag

SEQ ID NO: 62242 - DNA, 692 bp, Glycine max
  Peptide Sequence Number=SeqID_153927
acaaaggacgagctcactttaagtcaatgttacaagactatggcattgaaccatgtatagaacattatacttgcatggtttggcttcttggaagatcaggtcaatttgatgaagcagttaagctcattggagaaattccatttcagcctagtgttatggtgtggcgtgcattacttggtgcttgtgttatccataagaatcttgatctgggaaaagtttgtgcacagcgtgtacttgagatggagccccaagatgatgcaacccacgttcttctgtcaaacatgtatgccactgcaaagagatgggacaatgttgcttatgttaggaaaaatatgaaaaagaaaaaagtgaaaaaggaaccgggcttgagctgggttgagaaccaaggtgtggttcactatttcactgtgggagacacctctcatcctaacattaaactaatctttgcaatgcttgaatggttatacaagaaaaccagggatgcagggtatgttcctgattgcagtgttgttttgcttgatgtggaggatgatgaaaaggaacgtctcttgtggatgcatagtgaaagactagccctggcttttggactgattcaaattccatctgggtgttctattcgtatcattaaaaatcttcgaatttgtgtagattgtcatgctgtgtttgctcctgtggtgactactggtaactga

SEQ ID NO: 62243 - DNA, 402 bp, Glycine max
  Peptide Sequence Number=SeqID_153928
atggcagacgaagagaacaattggattgcaaaatttcagtttcgaattgcatcggatcttcccgttgttgttgtcctaaataaggaatttgcttccacaattgacttgagatcttaccatgccggtatatgttgcactgagatagaaagggagtgtttgttcgaagctggttccaaccaacagagcgagtgttgcgggagttacaaccatgatgctaactttagcgactcaaagtattgcaacaacttctccgcatgccgtttcaacattgagttccactccagtaacctatcgttgccccctgtctccactcactttaatttcccgctgccggcgcaggatgttgatagatcggatttgactagtctattattcaatcctgtcaaaatttttacagattga

SEQ ID NO: 62244 - DNA, 309 bp, Glycine max
  Peptide Sequence Number=SeqID_153929
atgggggaaggtgaagtggaagaggaagggtggtgggtttgtgtagaagcaaagcttcatgatgaatcaatattgattcaaagatgttttgatgataacaaagatgatgacaaaggtgatgataaaaagctcaaaggtcaatcaaagaatgagttcaagatgttcaagatagaatcaagaatacttcaagattcaagaggaaagttgatttcaaggatcaagcttccaagaatcaagatcaagattcaagaatcaagagaaggcttaatcaagataagtatgaaaaggtttttttcaaaaattgagtag

SEQ ID NO: 62245 - DNA, 813 bp, Glycine max
  Peptide Sequence Number=SeqID_153930
atgtctctcacctcagtttgtattttcttcatgtcttgcaaagaagtcatagtcacaggcttagtttgcaaatactcctctggtacctaccactgggcacaaacctcgaggaagtctgacgacgagtctcaagaggacgaagagtacgaagaagacgacgacaaagaaaacgtgccctctccctccaccgctctcgttgtcaccatcatcgtccctagttcctccgtctccaatggcggtggcaacactccaattttgaagcccaccgccaccatcgtcctcaccgactcatctgatccgaagtggcgttgcctggagctaatcgaggagaaaaagccgccgccatcgctggatgactcgcagcggctattacagcggttgtggaccgacgaggacgagatcaagctcttgcaagggttcctcgactacacattgcagcgaggatcctcgcaccacaacgacaccactttgttctacgaccaaattaagtcgaagctccaactcaatttcaacaagaatcagcttgtggaaaagatccgaaggctgaagaagaagtatcggaacgtcctcaacaagatttgctccgacaaggaattctccttcaagagcactcacgatcaagccaccttcgaaatctcgcgtaagatctggagcaacgtgactccagtcgtcgacaattcattggacgacgatgaaatcaaccctaaccgtagccccaaccctaaccttaattttagccctgtaattcttaagaatgaaacgattttcaagaattccacggagaagaaaacaccgaaacactctcggaggtga

SEQ ID NO: 62246 - DNA, 156 bp, Glycine max
  Peptide Sequence Number=SeqID_153931
atgggatacctcacggaatgtgataaagctaggaaaaaccgaacccctacaaatgaagtccacattactctaaagcaagaggttgctaattttcttacatcgatgctgacaagaaacgatgttgaaagcgccggttactacatcggtgctggctag

SEQ ID NO: 62247 - DNA, 1287 bp, Glycine max
  Peptide Sequence Number=SeqID_153932
atggcatcccaatcatcaagagatcaaacagatatcgaaaattgttttgatcgtgcgttggctggcttctattcagccattggcaagaatctcgaatcactccaacccgctagtgagttattcctagtcaagtgcaagtttcagctttgtgcttcttgtcttaaaaggtcaaaccagtctcaacttgtgggaaaattctcctctaccaaaagagtgattttagccattgttgatcctgcgctcattgttgtttccaaacgtgcttctgcgctcattgctagaaagtcaagtgtgttgaagcctccaactcaggatattctcaccgctactattagacgtccagagcaccctggacgtgtccatgctgctggagccgtagctgacccaacatatcagggaccaactagaggagtcgatcacagaaaaagtgactcagcaactcatggcatcgttcagccagatgcagtcccaatttcagtcccagatgcaatctcagggacttgcactgcctccggagcctctggaaacgatcctgagacgggtgacttagattggtgcggcttgtacatcgaagaaaatcctgccctctcggttgccctggggagagtttatgtgggatccactgttgttcataacactcctttgttgcctggccaagtaaaggtgggcaattcacaccttccttgcttggccgacacatttggtcaaatctttatcacaacagctgtgtctctggcaaaaccacctcaaaagctggatctggaggtcgatgatccgctttatctgatgacattgaccgtcccagagcttttcttgaggcgttaccaggttacatgggatgccaccgtgtttggggtctttaatccagacttcccgctctacataaagcacaaagacctctctgaaatcgcacacggtggtcaatgtctcagtatatccgtgtctggacaatcgcagtttgagactaaaagttacataaagagttggatgcagagttcaaaacacgatgtctaccttggagcctacctgaatggcggacactggcagatggtggtcatcgtgcccaaggaacacctagttgtctggttttgttcattgcataacaggtcatacaactaccttaaggggatcattaatagtgctttaaaaggtcttgatgatgctccacagcctaaatcaaaggctcctgctaggtggattgtcgtcaagtattttaacgatcctagaccattggagccagagagattaaaggcgctgcggatccagtgggcacaatattatctctga

SEQ ID NO: 62248 - DNA, 657 bp, Glycine max
  Peptide Sequence Number=SeqID_153933
atgcaaaccgccagccaggctggcggttcctttgcaaacgaattcgccaaccgtactggcgattctgctactgctgctgcacctccgtcctgcaccactgctgcaccctgccctcctgcctcctgcctgcgcgcctactacctagctgtcagccttaggaactcgccagtcaaactggcagttccctatgcatggccatatcgctgttgcaaggagcgattccttcagaatgaccaaactcgccagtggtactggcggtttgggtgctgcttgcatgcatgccacgtaaagaacaaccccatcgtgcaaaatgtttcaaaagaaccccatctggggaaatactttttaaaagtaccccggatggggaaatttgccggcgagggaaccatgacggtcatgttggtggcgacgacagtggccatggtggcattcacgatattggtggtgatggtggtaatggtagcaacgatggtcatgttggtggcggcaacagttgtcatggtggcaattacagtgttggtggtggtggtggcagtagttgacggtcatggtggttgttgtagtggtggccatggcaggtttggtgaaaacgatcatgacaatgatgatggtcatggtgatgataggtttgagatattttatgatggtataaattaa

SEQ ID NO: 62249 - DNA, 159 bp, Glycine max
  Peptide Sequence Number=SeqID_153934
atggtgagaatgctcggaagtggattgcgagcgtggtgctcaaatttcacgacgatccaacggttaggtggcctgcgggaaaaagtgagggttttgggagaagagagaaagaacgaaattgcgaggcagaggaggctgaggagtcagtttgaaaactaa

SEQ ID NO: 62250 - DNA, 474 bp, Glycine max
  Peptide Sequence Number=SeqID_153935
gcttctgaaaagcctgtgctacgcctgaaaatccagcagccaacccgccagtttgactggcggtttccaaaaccaggagaagactcgctggtggtggtggcgatttcaagttgcaagcaactcgccactcatggtggcggtttccatgccacgtgggagttgcagaccaaactcgccactagttctggcgagttgatggggaaatttgccttccctcgccatcactatagtggcaacaacgacgattatattggtggcaatggtgatggtcatggtggcaatcacattgttggtggttgtggggacgatcttgactggggattgggtctctgttacaataaatgtgtgattgtgtctgtcgaatttgtttacaatgtgtatttgatccttgttgatggttattcattgcctaggagacgacttcggaatactgtgagttggagtttatcattgcctgagtttgtcagcctctaa

SEQ ID NO: 62251 - DNA, 858 bp, Glycine max
  Peptide Sequence Number=SeqID_153936
atggaggatagaggatgggagaaaagtaaaggtgtggaaggacagatgtattttggggaggagttgttggttgctaagttgattgatgttgatacaaggaggtgggatatgaaaatgagtttgtctagggatggaaggtactatgtgaaatctggatataagatagctatgaagagtaagccagatgtagttgcttcgtcaagtagaatccttggagattggtggaagaagctatggaagattagaactcaacctaggtgcagtcaatttgtttgtaaagtgtgtccagacatcatacctatacgccaaaatttgatgagaagaggaatgatgttggaccccaattgtcctaggtgtggggaaaaggtggaatatgctactcatgcattgcttacatgcgggaaattcatgagaatggggaataaagaggttatggccaagatttttgagttcttatacattgtttggagatgcaaaaacttgcttgtatttgaacaaaagtttgtacccctaccacaaatttttgcttgtgctgaagccttacatgtaaaagagtggaagaaatcccaaaaagaagataaagtggatctaaggtggtgccctcacaaaggggtggcacaagaaatgggtatccaaagagtggtctacgagacagattgccttgatctcataaaggagtggaagaaagagagtagggagtattgtacctatctttcggccttagtgaaaggttgtaaaagtatgctaagaaatatggctaaggtttacttttgccatgggcctaggtcctacaatagtgcaactgaccaattagctaggtgtatttttcagcttttgaataaagtatggcttggttag

SEQ ID NO: 62252 - DNA, 447 bp, Glycine max
  Peptide Sequence Number=SeqID_153937
atggtggccgctaatgttgtggcagaacttgccgaagttcaggaaaatagttgtagtcccatctttgagatctccagtcacagactatccaagctcctttctgctttaaatgaatgtacagaatacaaggcagctgatactcgtgaggctgaaaacatagtagaaagagttactcctcgcttacaacatgccaattgtgcagttgttctatcagttgttaagataatccttctgcaaatggagcttatcactagtactgatgtggttcaaaatctttgcaaaaagatggcccctcctcttgtgacattgctctctgcagaacctaagatacaatatgtcaatcttatagttcaaagaagaccaacaatacttgctcatgaaattaatgaactgttgcaggctttaatatgtggaattggttaccttgagcagccagttttaacatga

SEQ ID NO: 62253 - DNA, 195 bp, Glycine max
  Peptide Sequence Number=SeqID_153938
atggagcggggcgggtttggggatgggttcggggcggatattgagaatcccatccccgaccccgaacccgaatttggctatcggggaaaatccgaccccgatcccgaccccggtcaactcagatcttctccgtcaaaatcagggcgggccccacgggttcgggccccacgggttcgggccccgttgccattgtaa

SEQ ID NO: 62254 - DNA, 225 bp, Glycine max
  Peptide Sequence Number=SeqID_153939
atggggaacgtgacgggtaaagagattagaagtggatcaaagtcgagtactcaacacatgcgattaaagtgcggcaacatgaaacccgaggtgcctccaccgcaaaagaggggatactcctccaggtataaccatgttattgagtctagcgagtttggcatagcttcgattatattagccaaggtgttcccgaacaacccaattgaaaacatggagaactactaa

SEQ ID NO: 62255 - DNA, 204 bp, Glycine max
  Peptide Sequence Number=SeqID_153940
atgaagaataagaaggttgcagtagctggtgtctcgctaagcgagacatatgcgcttagtgagcaacatccgctaagcgaggcactcagctcgcttagcgagttaggagaatttggaagagaatctgccaagcatgcacgcactcagcatgccatcagctcgcctagcgagtcatttgtctcttctggcgctcagcgtgcctaa

SEQ ID NO: 62256 - DNA, 492 bp, Glycine max
  Peptide Sequence Number=SeqID_153941
atgatcacttttccagggacccgcaaggcacgggctcgaggaccggaggcttctactactgctccttcttcttctacaccttcagctcattctgctccagctccaccaccatcaccattagtcccagcaccctccagcacctccatgcagagctcagacgttctagtgccaatgctgcagagcctccaccatggcttatgcctggttatgcagagtatccatggcttggctcaacatcggcccattatcagcatggaggagtttaaagctcagatggcctggccaggagtccagccttctcctttgaggggagttttggaggtctcagagaaggaagatggcgctgcaaatacagattatgcagcagatatggcaacaacgcagagcacctgggatccatggcctgcagcagctcaggatatacctcagccagcccaggatgctccctcctcacctcaggacgagcccatagcagcacaggaggagccttga

SEQ ID NO: 62257 - DNA, 123 bp, Glycine max
  Peptide Sequence Number=SeqID_153942
atggaaatggctccaaggacgctctctgctaagagggcaaggaaagatgccgtcggagaaggttctagtgcggccccactggtggatgtggagtttgacggacataggttccgaagtgagtaa

SEQ ID NO: 62258 - DNA, 426 bp, Glycine max
  Peptide Sequence Number=SeqID_153943
atggctcgtaccaagaaatctggtcaaatgacgtcagaggcaacaaaggaaattgcttacaagattagaagcaggcctcatagggaagctttgtcgccaatggatgggcgaccaaaacaccctggtcgtgtccgtgttgctggattcggtgaactcgtactgcctcctgagcctgaggttggtccttcagttgctcatatcaacataaaggagaattgtgttgatcccttagggaacgacctagacacggatgagccagagaaatgcggattgtacgtaaaaaaaaatcctccatgtctggttgccattggaagactttatgaagggtcgaccaccattctcaacatccctttggccaatgatcaagtcaaggttggtgttgagaaagttcgagatgcagatgctcacattcctgtacctacttaa

SEQ ID NO: 62259 - DNA, 797 bp, Glycine max
  Peptide Sequence Number=SeqID_153944
atgataatgatgcccccggcagtgaaggcccatcacatctactttgctcgtagacatcgaaaacaagcatgtgttgttgaggatcctcctacagctgcagaggattcaaatgaagagcaacaacaaccacctattgaagaagttgttactgatgttaaaggttttccaagcagaccccatgacacatcaattttgagagattttgaaaatcacattgctctgagagtttggaatcgagaggaacgtcctgagctgaacctatcttaccatggaaggaagatggataagtttgggaggcctactccagagattgaaagccttgtgactgtcagtgaactcagttcttcgatcgcatgttccctatatacgggcgatcgaggattaatgtctacttttgtggaacgctggcataaggaaactagtattttccatttgcccgtaagagaggtgactatcaccttggatgacaaggcgtcgttgatacattttcctatcgtaggggcattccatagcttcgagcaacttcatgtcaatgacgttgtcgatatgttggtagaattactcaaggtcagcgctgtagaggcgagagctgagacgattcaatgtcattactcagctcttatgttcaactatcgtggctacgagacgtgtatcagacgaaaatcgaggatcttcttcatcaatggattcatttgcttcttggaagatgagtggcagcagaatggagaaaggaagagagagaggagacaccacttcaaggagaagatgagtttagaagaagctcactaccataggag

SEQ ID NO: 62260 - DNA, 1011 bp, Glycine max
  Peptide Sequence Number=SeqID_153945
atgaaccggcgacatttttataattatttaccggaaaaagctttgtacgacacacattctaagacggttattgaaaaccgtcttagaatatgtgctggtcataaagattacgacgggttgtgtcccttgacattcaagagtgcccaaagaaagaaccctaacaacgcattctctaacccatcgtgcgaggtccttcgacctctacacaaccctagcaccaaggggaaaatgtgggaccttgttgcgcgtgatagatgggtcatcttcgatgcattctctgctctcattgttgctacagtgcgttcccttttctttcttttttttttcgcccattttgtgtttctcgaaggtgggggtcaaagttgttacggagattttgataccgcatttcttgacagcatccatcttcacagcacagagtatggaccttgttgtttttcaccggaatatgcagttgttggttctgttgtgcgtggcttcgggaatatgaaggttaagagaatgagagaaacactatactcttctcttcttctgcagtgcccttattgtagaatatatcattttttgacaatgaaacagtatgagtggtggctggagaaattagttgacataagcttgcaacaaagtgctgcatatggagtttggaattttagctttaacattctttatcattcaactcaggttatcactgtgctgtttggaggaatgtctattctagtaggtcatatcacagctgagaaacttagaaggagttggagcaacaaagcaccaaaatctataactttgtcattcaattgcccatcatataaaaagttaagcataaccttgaaagcttccagtgggacatcccttaaagtaacttctgaggacatgctttcttttggggtaatattgcaatccataagctttttaaatatccctttctcgtcactaaacaactattggatcacttatttatgcatggatcttgtacacactgctaattcctatgttctcttcatcttagcataa

SEQ ID NO: 62261 - DNA, 528 bp, Glycine max
  Peptide Sequence Number=SeqID_153946
atgcaacaacctatttttgggtgtccttcgcaaccccagaatatccatggcataacgttgaaaggcaaacaagatgaaaattggagacaactgttcgccccaatgatcagtcaatggaacaatcaagttgagtttagggtcggtctattgagttttaactccaactacatggtctggaacacatggacagttgatgatctcgtgccttatgtggagaagataacgattttatccgaagagcaagagagagttactgagcctgtgtcacatggtccagcatcagagcgtcaatttccagcacaagagtttcacattcttcagtcaagtgttgaaactcaaggcataggcagacgaagggaggttgttgaagcggaagaatattcccaacaaatggtggaccgtggccatggaatgtattacatgccaccaacattttctcagtatcctttcgaaggtcatcacactgatacttctgcaagcgaacattcgtttggtggtgttgtggaaacacatcctcatttttcatag

SEQ ID NO: 62262 - DNA, 102 bp, Glycine max
  Peptide Sequence Number=SeqID_153947
atggctatagccctgcaagccagcaatgaattgctactaagtgtgcttgtggctaggtgctatagggggattggtagtgcagctgatattcttggaatgtag

SEQ ID NO: 62263 - DNA, 582 bp, Glycine max
  Peptide Sequence Number=SeqID_153948
atggcttcctatggtggtgagcttcttcttgaggaaggatcttacaactctggcacagacctagaggctaggttagtttatgggctagtaatgaagatggacatgaacatagaagcacttatatataaacagatctcactcattgctcagtccaactccttgaggcttggattcccagccctcatcactgccttgtgcaaggcccaaggagtcacctcagattctctcacttatgagtcactcagccggtctctccgctcagagctcagagcctttcatgtctatgttgtagagtctgcaccaaggccaactccggattatgcagagcttgcaggatgtggtccagcagtgaccagttatgagcgtggaggagtttctgcagaagcccaggaacctcaaccagaccaggaggatgactcttctgaagccactcccattccacctgagccatttatttttgaggatgatccagtgaccacagagggtactcaacaagaatctccagttggcactcctgcactggacttgaacgaggaggccatggatcaggacccaccactaccacaggaccaggatcactga

SEQ ID NO: 62264 - DNA, 429 bp, Glycine max
  Peptide Sequence Number=SeqID_153949
atggagaagcatggaataaaaatatccatagtgaaaacaatacaattcaatgaaattaggattccatcacagacacacacagaggaccaacgccaaacactcttagtcaaaagagaagagaaggctcaccaaaacatcgtcgaacttgaagtggcgagcgtactcctcgacgacaatcatggcggcggcgcccttgcgttggagggcgatgcgcttggccttcatggaggcggactcatcgagtgcgtcagggccaagaggaacagcgtcggacggaggaagaagcggcgacagaaccttggggacggggacctaaacggtggcgttgtccctacgcgtgttggcgaggaagtcacggagcactgtaacatcgtgaacgaaggcattgggagcgtcaggagcagcgtcgaatgcgcgcagaaaccctag

SEQ ID NO: 62265 - DNA, 132 bp, Glycine max
  Peptide Sequence Number=SeqID_153950
atgaaggaaaaagaactcaagtaccttggaaatggcgatgccaattcccatgtttgtaaatgtgtaaatcttgttcacttgcttgttttgagggtccaatatgccgcacaaggctttatcccattgaattaa

SEQ ID NO: 62266 - DNA, 534 bp, Glycine max
  Peptide Sequence Number=SeqID_153951
atggaccgtgaaccatccactcaacccatttcaaaacttaagtttgaatttgagagaatgaaattgaccaaagatgatgtaagagagttgatttatggagagattttggagtatcatccccaaatgctccaggaatatctttgtggtggagatcaaactagcttcatgtatccaagcttaaagctgcaaagggtaggacttggtagcctacacattacttcttcgttgtttgaagcaaagagaaagatagagaagggacaaggaagttttgggacaggttttagttacacttctgatgctagtgacattcgtcaaacaaatcctcatgatggagatatgtgtaagggccatcagtcatctccaagtaatcaagacagagcaccctatgagaggatgctggacaataaggtggagtttggttccccaaataaacggtcaagcggattctttaactctgctctggtactaggtagatttactgttttggcttgcaaaaacaactctaagtttctacttactgactttttggattga

SEQ ID NO: 62267 - DNA, 504 bp, Glycine max
  Peptide Sequence Number=SeqID_153952
atgatgattcgattaattaaaacaaaaataagaaaagagcaatggacctttgaacaaagagaggaagtacctttgaagagaggggatttgggaagcgagagaagaaaagaaaaatcaaagcctggaacaagaaaccgagagaaattttggggtcaaacccaagtagatgtaccctctacttgtaccacaaaggatgtatcctccaatgtgttaagacaaagatctcaggctgttaaacctttgatactttgtgaatggggatacaaaagaattctcaggcgagagaagggagacacaaaagaattcaggcggttagtccttggcgaattctttttggcaaagggagaagagaatgaaaagatgaatagcacaagttttcaaggtttggaaaaccaaaaaacttcagaaagcttttggtacaaagaagaagaagaagttcaaagagattcaaagcttgtaaaggattgtaatgaaatgattggaaaagtattcaagattgaatga

SEQ ID NO: 62268 - DNA, 66 bp, Glycine max
  Peptide Sequence Number=SeqID_153953
atggaactgtggtggcctacagaaggaggggcggtcatcgccgatgaaaagggtaggaaagtgtaa

SEQ ID NO: 62269 - DNA, 201 bp, Glycine max
  Peptide Sequence Number=SeqID_153954
atgtcatccaaggtgatagtgatgagaatcctgaaactggccaaatacaggctaaagacttatcaatgtaatccttgtggcgtctaccctgacttatcttccttcactggaagtggcgtcatccaattctccgtagcctgtatcaagcgatttgctcctagtcaggatcacatcatctggtatcagagcttcggctcttga

SEQ ID NO: 62270 - DNA, 327 bp, Glycine max
  Peptide Sequence Number=SeqID_153955
atgtcccggtttgccacaattgtagcagaggaatggctcatcgggattattcttggtaggtggatgttgtctagcatgttggacccttggggggttcttgctacggttggaggtattgctcacattgcggttctgattcttaaagtttttgccaataggcttcaaaactgcacctgtgtttgtggcactgccaaaacaagggagaaaaaggaatcgcatgaagacagtacaagtagaggcttcaatctcttctccgtctctctgacgtttgagaattctatcggaacagtcggaggaataactggaggaatctcagggaacctctag

SEQ ID NO: 62271 - DNA, 198 bp, Glycine max
  Peptide Sequence Number=SeqID_153956
atggaaaagatctgcaaccgcaatttgaaacgttggcttctaatcaagatcgtgacgatcaaactggccaccaagtgcgagaacacgactgatagcgagtgcaagtggggcgtgagctttagacgagcgggtgcaaatgggagagataggagttggagcgttgcggaagtgagagctttaaaccgaaagtgggagtaa

SEQ ID NO: 62272 - DNA, 489 bp, Glycine max
  Peptide Sequence Number=SeqID_153957
atggatccaatctcgatcaaactgggtgatgacaattactcaatatggaaggctgaagccttaggaaaaataaaaaaatgcaaccttgagaagttcatcacaatgacaaatttgggtggaaagccacccgtgttcagtgaagaatacaaaagctgggaagagcaggatcaggttctttattggtggcttcttgattccttgcatccggagtttcttatccaaatggaaagatgtgataatgctttggaactatggatggagatagaggtttatttcttagaaaaagaaattgaagagctaggtgaaaaacataaaagtcttattgaaaaacatctcaagctcaaacagagactttggaggcttgatgaggagtgtctagagattagcaatgaaaacgaggccctagaggaagagctggtgaaggagcatggaccagaatcagtagcagatatattgtccatgaagcatggcaccgctggctctgcataa

SEQ ID NO: 62273 - DNA, 261 bp, Glycine max
  Peptide Sequence Number=SeqID_153958
atgatccaaatcacgggacaattgtcgttgaatttagatccagatccagggagatggagcgaatgtgaacgagacaaatccagaccctttgtttgcaaatctgactctcttggcaagttggactcgaatctagggtttctcatttcttattcaatggttgagagaagtcatggttcattgaatgatgctctgtgccttcaatggagtcatggtcgaggtcttcaatggtgtccacaaggcctcagcaatggagcttcatga

SEQ ID NO: 62274 - DNA, 486 bp, Glycine max
  Peptide Sequence Number=SeqID_153959
atgaggggtagagggtgtcacagaagcaacatccttccaagcaacaattggagcatcaaaatgaaggcccttcacggagaacatgatgtttgggaaatggttgaaaatgctataaggagccacaagatgagacttcactatcccaagcacaaaaggagacttttaaggattcaagaaagagacacaagaaagctctcttcctcatctatcaagcattacatgatgatgcattcgagaagaattttaatgcaacatccactaaagaggcatgggataagcttcaaacctttcacaaaggagaagacaaagagaaggaagaaagtcaaggaaatgaaagaagtcaatgaggccgaggtagacgtcgaggtcatggctaaggacaggttggatgtggcaacagtggacgaggttcaaatttcatcaataacagttacaagaaaggaaaaggctcaacaagagaatgtggaagaggttatacaagcataa

SEQ ID NO: 62275 - DNA, 549 bp, Glycine max
  Peptide Sequence Number=SeqID_153960
atggggaaaggcatggtcggctccaggatggaaggatatggtgctaccttcaggctttttgtagagcactgtgtagggaatttcattgttggatggggcatggagactatggcttcgagctcgttgagtgtcttcctaccgattaaggaaaagtatgatgagtttgcgccaaccaacctcgagtctctagaagttcttctagtacaggatgtcagtggaactgccttggtcgataaggaccctggacaccatgaagttcaatataatgatgaagacaaccatagggttgtcttggttgacaggattgatgcccttgaagtccctgtccataaaggcgataggagggagacttcgttgtgggttcctgttctattggaggtggtcactcgcgccgctatggctaatgtctttgatggcctcagtcttccgctcttcttttgtctgcttcttggttcatgtgctgcccctcttgatgtcctgcagggcccagcagtcttcgttgtctcaaaggttttgcctggggtagctagatgggtacctccaggttaa

SEQ ID NO: 62276 - DNA, 174 bp, Glycine max
  Peptide Sequence Number=SeqID_153961
atggcgattccattattgcataaaaatgcaatttcacgaaagaaattagcgaccaatgtatttcagttgctattagcgattgaaatcgcagccaaaaggcttctgtcgctaattgacatcgaatttgtgacccaagcttacatggtggctaagttgcgtcaacgaccgaattag

SEQ ID NO: 62277 - DNA, 456 bp, Glycine max
  Peptide Sequence Number=SeqID_153962
gaacacgagatggaacttcaacgaattaatcaaaatgaagaaaatgacaaaaagaagagaagtataacccttaaagcctcatcatcaatgcaagaagaaaaagaagaagaagattcagatgatgaagaatatttttctttctttgttaagaaatttcagaaattcatcaagaaaagaagaattgacaggcgtcagaacttcaataatggaagaaaatcacaagatgattctcaagttcttaggtgttacaaatgcaaccaaattggtcacatcaaggtcaattgtccttcaaatgaagagtggcctgagaaaagcgaaaagaaaagatttgatgaaagaagaactaagaaagcctatattgcatgggatgacaatgattcatccgatggttcagaaaaggagataaatattttaaccaaggattatgaaactgatgagaatatctctcaaggatga

SEQ ID NO: 62278 - DNA, 397 bp, Glycine max
  Peptide Sequence Number=SeqID_153963
ggctgttgctaaggtgaacccgatgcccccatctgatctcaaccaaatgaatcatccaacctcaggtatggtgggcaaagatttgggaagtacgagcggcccccattatgcgcaaattcaaaacaagcatgccttcccaccatatggcttgcatcccaactatacaccacccaatgtggcatacactcccaaggaggatgtcaataactccactcccacactcattgaaagccaacaacctcaatctgatcatgcacatgtctctcaacccatgggggagacacatggaatgccccaccacaatctagccgactttgagccttgcctcggatatgccactgaagggaaaggctcagggccattgaaggaggtgaagattatgcctttgctaacctag

SEQ ID NO: 62279 - DNA, 373 bp, Glycine max
  Peptide Sequence Number=SeqID_153964
atggggacaaatcaaaacggcaaaaggttttatcaagtcaaggttaaaggtctagatgtcactagcctcaaggaattagaacgattgatgggacctctccaaaggcaagccttccgcaaagtgtatgggaagattctagatttgaccgtagcggaggtatttacggaagctgtcgtgtccctcgcccaatactatgaccagccaaaaccgtatcttttctccggctttcttccttccttgagcaagattgcagctgtgattggggattcagcaaaagagttgggtcgcatgaagcaaattcggaatggaatagtgggcctgccacagaaatacttggaaggcaaggcaagggatatggcgagccattacaagg

SEQ ID NO: 62280 - DNA, 462 bp, Glycine max
  Peptide Sequence Number=SeqID_153965
atggtgggttacacaccttcaagctttgcggatttggacttcgccggcagaaggatcaaagcgggtctgaaaagaggcaaatttaatcatcccacttggacgaatgagaaaactggggcaaatgaagagggtgagaatgagggagaagcccatgctgtgactgccattcctatacagccaagtttcccaccaacccaacaatgtcattactcagccaataacaaaccttctccttacccaccgcccagttatccacaaaggccatccctaaatcaaccacaaaccataaccccaaccaaggttcatcaacctccatttctccgagaatacgactcgaacgcaacgtgtgcttgtcacggagaagccctggggcgttccattgagcattgtagggctctgaagcgtaaggtgcaaagtctaattgatgcgggctggctgaaatttaaggagaatcacgtgtaa

SEQ ID NO: 62281 - DNA, 440 bp, Glycine max
  Peptide Sequence Number=SeqID_153966
acccatgaattcattgcctagcgctgttcatgtgtcctccaccaacgagtctggagccccgcgaattcattgcctagctgttcgccaattctccattctcaatcttattcggagacccatgaattcattgcctagcgctgttcatgtctccaccaacgagtctggagccccgcgaattcattgcctagcgctccccatgaattcattgcctaacgctgttcgccaattctacattctcaattttatactgagacccatgaattcattgcctagcgctgttgatgtgtcctccaccatcgagtctggagccccgcgaattcattgcctggcgctccccgcgaattcattgcctagcgctattcgccaattctgcattctcaatcttattcggagagccatgaattcattgcctagcgctgttcatgtgactccaccaacga

SEQ ID NO: 62282 - DNA, 147 bp, Glycine max
  Peptide Sequence Number=SeqID_153967
accatctattgtgtgatgggattaagaagaattacacgacttggatatggcatggtgaagtcacagacatgcagagtgggtcccaatctaaaccatttgatgtagaaatgggagatcacttggaggacatgattcatgaccttggac

SEQ ID NO: 62283 - DNA, 105 bp, Glycine max
  Peptide Sequence Number=SeqID_153968
cacgtctcaggacttcacatattgtgcacaaaggatgccaagtatctcaaagcggccaatcaaaggttgcatgtcatcaagtaataatctccggacgaaattagg

SEQ ID NO: 62284 - DNA, 1045 bp, Glycine max
  Peptide Sequence Number=SeqID_153969
atggccaaacagcaaggcttgagcaaagtgtatgtgcatgcttttcttgacggccgcgatacgccaccaaaaagcgcacagccttatctgcaagcgctggaagaccaccttaacagcttgggcgtgggtaaggttgcctctgttggcggtcgtttcttcggtatggacagggataagcgctgggaacgtgtgtcagtcgcttatgaattactggtcaatggcacctcagattatgtcgcgccagacagcttaaccgccttgcagcaagcctatgcccgtgatgaaagtgatgagttcgtcaaatgcacggctatccgcgccgcggaggaggcgccagtacgcatggaagacggggattgcctggtgtttatgaacttcaggagcgaccgcgcccgccaattgactgacgccctgctcaaccagcaatttacgggctttgcccgcagccgcatcccgcacttcagtcactactttacgctgacccaatacgacaaaaaccaaacgctggccgaaccaatttttgcgccgtacaccgtccctaacacgtttggcgagtacgtctccaagctgggcctgaaacagttacgtattgctgaaactgagaaatatccgcatgtgacattcttcttcaatggcggtgaagaaaccgtattcgatggtgaggaccgtatcctggtgccttcgcccaaagtcgcaacttacgacttgcaacctgaaatgagtgcgccagaagttaccgacaaactggtggtagccattgaatcaggacaataccaggccgtgatctgcaactacgccaacggtgatatggtgggccataccggcaacttgcaagccgcaatcaaagcggtagaaaccctcgatacctgtattggccgtgtggtagcagctgcacagaaaatgggggcagaagtgattattacggctgaccacggcaatgccgaaagcatgtttgaccacgccagcgaccaggcgcatacccagcacaccaccaacctggtgccgttcatttatattggccgcccagccagcatctctgctggcg

SEQ ID NO: 62285 - DNA, 240 bp, Glycine max
  Peptide Sequence Number=SeqID_153970
atgtatgtaggtagagacgaaaaaataaatctcgaagttacgaggaaaattatcatgaatccaattatttctgctgcttctgttattgctgctgggttggccgtagggcttgcttctattggacctggggttggtcaaggcactgctgcagggcaagctgtagaagggattgcacgacaaccggaggcagagggaaaaatacgagcattagcacttttatttgctaatccttttgtttaa

SEQ ID NO: 62286 - DNA, 210 bp, Glycine max
  Peptide Sequence Number=SeqID_153971
atgagcctcagcatgcagagccagggttttacttcttttccgtgccctacttcggaccagttcagggcagaggtcgcatggcctggagattggcttgaggcccgggcaggagaggcacctgcagaggctcccgacgaggcagatgaggcccgcgaggacgaggagatggccgatttacttaatttcttaggagggagcgggcccacatga

SEQ ID NO: 62287 - DNA, 420 bp, Glycine max
  Peptide Sequence Number=SeqID_153972
atgatttgtgtaatcgattacatggttatgaaaacaaaagtgtgctatatcttttcattctcttctctctttgccaaaagagaattcaataggactaatcgcctgagaattctttgctcttctcccaacacattggagggtacatcctttgtggtacaagtagaggagaacaagggagggtacatcccttgtggatctttgcttgtaaaggattttacaaggttgaaagaaatctcaagaaccggtggttgcttggggactggatgtaggcatgggtgtcgcaacctacccttcggcgggagggcgatgcgtgactcgcgggtgagtcttccaagaaaggaatacgcgcggagtcgccaccaacgtttatttgaggaaaacgtcggaaaaatcggaaaagacgtggtctacaaattttaa

SEQ ID NO: 62288 - DNA, 320 bp, Glycine max
  Peptide Sequence Number=SeqID_153973
atggtcattgaccaatccctcttctatgatctgactcaattgtctagtgaaggtataccatttgaaggtacactagatgatgattggaaatttgatttttctatgcatgatgctcgccggttggtttgcaccaaccaagcggatatgaccgaaaggctgcttgccggttcattggctcttgaaagccgcatccttcactatcttattgtttgtatcttactcccaagatcttcaaaccttgcacaggtttctgaagaagatcttatagtcgtgtgggcctttcataccggccgacaaattgattgggcacatttagtccg

SEQ ID NO: 62289 - DNA, 331 bp, Glycine max
  Peptide Sequence Number=SeqID_153974
catagcacttaaagcctccgccgtaatgcaagaagaagaagaagaagaagaagaagaagaagaagaagaatctgatgatgaagaagacttctcactctttgtgaagaagtttcataaattcatcaaaaatagaagaatggagagaagccataacttcaacaatgggaagagatctcaagaaaagaatgagaagaaaagctataaagaaagaagatccaagaaggcatatattgcttgggatgacaatgactcatccgattgttcgaagaaggagatcaaccttctatccaaggactatgagagcgatgagaacatttctcaagaagattaa

SEQ ID NO: 62290 - DNA, 384 bp, Glycine max
  Peptide Sequence Number=SeqID_153975
atgaagctttgctttgagacctctagtgaaagtgaagaagcaaaaggggaagaatctagtagagagatttacccccaagaagaaggtcaacctttaatggttaaggaggagtgtaaggaggtaagtgtctcctccaagaggttagctaagaaggaaagacattttgaaataaagacaaatattaaaaaaacttcccctcttagacaacctccacattttctcctttgtaaaaagacacttgttagcattgccacacctcttaggcttgagtttatccctcaagtaaaggagttgttggatgagggtttggttcgcaagagcttaaatccttgtgctttgttggtgcccaaaataggtattattaggcaccgtgggatcctctag

SEQ ID NO: 62291 - DNA, 324 bp, Glycine max
  Peptide Sequence Number=SeqID_153976
atggatgaaattgagcttgaagttgcaaacactggtctgagaaatgtctacatctttcatgcagaagttgtgggccaatatgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 62292 - DNA, 516 bp, Glycine max
  Peptide Sequence Number=SeqID_153977
atggtgggttacacaccttcaagctttgcggatttgcacttcgccagcgaaaggatcaaagcgggtctgaaaagaggcaaatttaatcatcccacttggacgaatgagaaaactggggcaaatgaagaggtgagaaagcctgtagaattcaccccaattccagtgtcctatgctgacttgctcccatatctacttgataattcaatggtagccataaccctagccgaggttcatcaacctccatttctccaagaatacgactcgaacgcaacgtgtgcttgtcgcggagaagccccggggcgttccattgagcattgtagggctctgaagcgtaaggtgcaaggtctaattgatatgggctggctgaaatttgaggagaatcgcgtgattttcaactttcaccggaagtgggtgcaagccattggtctgtttgctcaagtgacctgtgctcttgagtttggacttctaagatcgttcaatcagagattactcgtccttcacgttgatgggggtgcc

SEQ ID NO: 62293 - DNA, 383 bp, Glycine max
  Peptide Sequence Number=SeqID_153978
atggttggtaattttgaacatcctaattttgagcattatagttttgaacattctgattttgaacattctgagaacatgatacaacctccaccccgtgagaggactctaagggaaatggctacacctgatttcacctacgaaagcttgtgcatccaataccctgatgaggatgtcccatatgttcttaaaactggactgatccatttgcttccaaagtttcaaggccttgcaggtgaagacccgcacaaacatctgaaagaattccatattgtctgctccaccatgaaaccgccagatgtccaggaggatcacatatttctaaatgctttttctcattctttagagggagtggcaaaggactggctatattaccttgctccaag

SEQ ID NO: 62294 - DNA, 166 bp, Glycine max
  Peptide Sequence Number=SeqID_153979
tgctttaaaaggtcttgatgatgctccacaacctaaatcaaaggctcctgctaggtggattgtcgtcaagtattttaacaatcctagaccattgaagctagagagattaaaggcattgcggatccagtgggcacagtattttctccgagttagagatcagacctag

SEQ ID NO: 62295 - DNA, 288 bp, Glycine max
  Peptide Sequence Number=SeqID_153980
atggaagtatcagttggtctgtgccatcgtgacatagggatcacgcccacaagacacccagtggacccagagaagtacaacagggccctggggtttccagctctggttatgggcctctgtcagtcctgccaggtgcccgtccccccagcaaggtcacgccatcatgacatagggatcgcgcccgcaagacacccagaggacccgaagaagtccaacagggtcttggggtttccagctctgattatgggcctctttcagttctacggagtgcctgtcgcccccgacaag

SEQ ID NO: 62296 - DNA, 447 bp, Glycine max
  Peptide Sequence Number=SeqID_153981
atgtccttaccttcagaggactacatgtcctcgccttcagaggactacacgtcctcgccttcagaaggctacatgccctcgcctttagaggaccacaagtcctcaccttcagaggactacacgtcctcgccatcagagggttgcacgccctcaccttcaaaggattacacgttctcgccattagaggactttacttcctcaccttcagaggactacacgtcctcaccttcagagggctgcacaccctcgccttcagagggctgcacgcccttgcctttagaggactacatgttctcgtcttcagagggctgcatgccctcgccttcagggggttgcgcgccctcgccttcaaaaggcaacacgtcctcaacttcagagggctacacgccctcgcctttagagggctacgcatcctctctttcagtgggctccatatccacaccttaa

SEQ ID NO: 62297 - DNA, 227 bp, Glycine max
  Peptide Sequence Number=SeqID_153982
ggtacatcctttgtggtacaagtagagggtacatctacttgggtttgactgagaacaagaaaggatacatctcttgtggaccagttctaatggagggtacatccacttggttgttcaaagagagcaagggagggtacatcccttgtggatctttccttgttaatggatttttacaaggttggaaaagaaatctcaaggaccgcaggtcgcttggggactggatgtag

SEQ ID NO: 62298 - DNA, 279 bp, Glycine max
  Peptide Sequence Number=SeqID_153983
atggataaagttgatatctttgtccctcatcctctcacaaacgcatgtttgcttattcaactttcaccggaatgtggctgtaagccattggtctgtttgctcaagcaacctgcgctcctaagtgttgacttccaagaccgttcaatcagagattactcatcttgcacgttggggggggacgttcatgtgacctcattttatcatgccggaaagtttgtcttcttagagaagcgagttgtcaagaataggatattggacaaatggcctcagttatcttaa

SEQ ID NO: 62299 - DNA, 216 bp, Glycine max
  Peptide Sequence Number=SeqID_153984
atgaagatgctcttgataccacatgatgcaagctccattggagcttcggaatggagaaagggagagagagagaggagacgccacttcaaggagaagatgagtctagaagaagctcaccaccataggaggccatggataagagcttggaggaagaaggagatgaatgaagggagagggagagggagagaagagcaagaaattttgtgctctaaatga

SEQ ID NO: 62300 - DNA, 1104 bp, Glycine max
  Peptide Sequence Number=SeqID_153985
atggggagtggccttggggagggactctttgttgtgctgattctggtgatgttgtctgtgacagcgagcactataaatgctcaaccaaagtctattctcttgaattgtggttcagattcttctgtgaatgtggatggtaggagatgggtgggggacatggccactgataacaatgtcaccctaagttcccctagtgttcttgtttccacttctacatcaagtgacagtccaatatatgaccctctctataaaactgccagaattttcaatgctcctttgaattacacaatcaaagatgttcaggggaactactttgttaggttccatttctgccccttcgagactgatgactacaatgtgaatgagtcctcatttggtgttgtggtcaatggactgaaactgttgtcagagtttgatgttcctggtaagatatctcacaagaatatgaacttgctgaattctggaaggaatgctagttcattcttcttggtcaaagaatatattctggctgtgaatggggatatgcttttgattgagtttgttccaaccagaagctcctttggcttcatcaatgccattgagattgtaccagttgttggtgagctttttgctggttcagttagcagagttggtggaagtggtggaaacttgaatttgccgggacaagggatggagactatgtataggttgaatgttggtggtcctgagattcagtccaatcaggatcatgatctttggagaacctgggaagtggattctggctatatgatcactgaaaatgctgggtctggaattaagaacagttctaacattacatatgcttccatgaatgatacttgggtggctcctctccttgtgtatgaaactgcaagggcaatgtccaacactgaagtcttggacaaaaggttcaacatgtcatggaaatttgaagtagatcctggctttgattatctggtccgtttacatttctgtgagctggtttatgacaaggccaatgagaggatatttaggatctacataaacaataggacagctgcagataatgttgatgtcttcgtgcgtgcgggagggatgaataaaagcatatcaccaggactattttga

SEQ ID NO: 62301 - DNA, 495 bp, Glycine max
  Peptide Sequence Number=SeqID_153986
tttttaaagttcttagatgattatgaaggtgatggcccaattagagttctattgacccatggtagaataaaggaagctcagggatcttatcccccatcggtcagcaattctttcaaggcttcaaagttaattattaaccaacccgtgatggagattcaagaattcaatgaacggcttgcagagttgggcattgaggcccgatcaggttttaaatcccatggtgaagggagtacacaactttcaggttctatccaattatcatcaaaggaatcattctttgggaaggctgaggcaaagactattgctgacattaataccatctctgaagaaattgtttgtgtaattgttggcacaattactaggattgttctggacaatcattcatggtgttatacagcttgcattcggtgccacaaaaaaagtgatgcagagatggctcccttcacatgtgcatgcggcaaatacaataaggaagttgtgcttaggtcattgtga

SEQ ID NO: 62302 - DNA, 258 bp, Glycine max
  Peptide Sequence Number=SeqID_153987
atggatgaatttaaggctgaattggagaggcgtaacttccataagtgcctcaccaatttagctgatagtagcattgacctagcattggtgaaggagttctacgccaacctctacaatcctgagggaccttctccaaaacaagtcagaatacggggccacttgataaggattaatgtagacagcctcaatgtctttttagaaacacctgtggtggttgctgtaatgacccgcctcgtcgctacagtatccacactctaa

SEQ ID NO: 62303 - DNA, 129 bp, Glycine max
  Peptide Sequence Number=SeqID_153988
atggttaagagcttgaaggtaggagaagatgaatggagggagagggagagaaggagcacgaaattttatgcctcaaaagagcccactaatccaagatcaagtccaagattctccactaagtgggcttag

SEQ ID NO: 62304 - DNA, 384 bp, Glycine max
  Peptide Sequence Number=SeqID_153989
atgcatgctcttcacggatgggtcaaagcccaaacccttggtatatacttgcacaacatcccaagcttctcggtcaaaagcccggaacccctagttcagctaaacctgtgcaccttaaggcccacccagagggaagctccccaagttccaactccaaacacaactcgcccggccggcaattccaacgcaataaggaacttccctccgaggccatttcaagaattcaccccactcccaatgacgtatgaagacctcttgccgtccctcatcgccaaccaattggccgtggtaactcccggaaaggtcttccgaccccctttcccaagtggtatgaccctaacgcgacttgcaagtaccatgggggtgccccaggcattccattga

SEQ ID NO: 62305 - DNA, 367 bp, Glycine max
  Peptide Sequence Number=SeqID_153990
atgactaggggcaatccgtctgacttacaaccctttgatcctgagatagataggacatttcatagattagttaggcatcattttgtaccttttgagcatcctgagcattttgttattggtgagtctgagcattttgtggttggtaattttgaacatcctgattttgaacattacagttttgaacattttgattttgaacattctgagaacatgacacaacctccacccagtgagaggactccaagggaaatggctgcacctgatttcacctacgaaagcttgtgcatccaataccctgataaggatgtcctatatgttcttaaaactggactgatccatttgcttccaaagtttcatggccttacag

SEQ ID NO: 62306 - DNA, 936 bp, Glycine max
  Peptide Sequence Number=SeqID_153991
atgggacctctccaaaggcaagccttccgcaaagtgtacggaaagattctagatttgaccacaacggaagtatttacggaagctgtcatatcccttgcccaatactatgaccagccgttgaggtgcttcacgtttggggacttccaaatggtaccgactattgaagagtttgaggaaatactaggatgccctcttgggggaagaaaaccgtatcttttctccgggtttcttccctccttgagcaagattgcagctgtggttggagattcggcaaaagagatggatcgcatgaagcaaattcgcaacgacgtagtgggcctgcctcggaaatacttggaaggcaaggcaagggatatggcgagccaagagaagtggagcccgtttgcggatatattagctttgttgatttttggggttgtcttttttccaaacgttgacggtttggtggacttagccgccattgatgctttcctcgcatatcaccatagcaaggagagtccagtggtggctatcttggcagatttgtttgacacctttgactggaggtgtgagaaaaacagtgcacggattgtctgttgtttacccgctctctatgtgtggttggtttcacacctattccaacaagacacaagacacccgtgtccgcttcaaagttatcgctcatgcgccgaaaaaggaagagtcgattgggaccaacatttggctaggataggaggcagcgcaatcagttggtttcctcgatggaaggaaggcaaggagggagttcttttctcgtgtggggactaccctaatgttccattgatagggactaggggttgtattaattataatcccgcactcgccataagacagctagggtaccccatgaggggagcgccaacggaagggagtctctcacctttccttgtgaaagatttaggcgtgcaaggtctcaag

SEQ ID NO: 62307 - DNA, 318 bp, Glycine max
  Peptide Sequence Number=SeqID_153992
atgtcaagatttacacgcgattctcctcaaatttcagccagcccgcatcagttagaccttgcaccttacgcttcagagccctacaatgctcaatggaacgccccggggcttctccgtgacaagcacacgttgcgttcgagtcgtattctcagagaaatggagctttctcgctgcaaaattcatttcttggttgatgtttttgactttgtggttgatttagggattgcctttgtggataactgggcggtgggtaaggagaaggtttgttattggctgagtaatgacattgttgggttggtgggaaacttggctgtatag

SEQ ID NO: 62308 - DNA, 432 bp, Glycine max
  Peptide Sequence Number=SeqID_153993
atgccttttagaggcttgaaaaatgcaagaaaacgagctgcgttttctacgttttttggaaaacgtgatgaactcgctaagcgagcaagctgcgcaaagcgagctcatcaatactcattgtatatgtctttcagaaaaagaaagtgcattggtgcaaggcccacagctcaatatgacacaagaagattccactccttcaaggcttggaccagatacacagacaatgtgctaggaagacatatactagttgagaggaaggtagaaatatactatacggagttggatgagttcaaggctgaattggagaggcgtaacttccataagcacctcaccaatttagctgacaacaacatcgacctagccttggtgaaggagttctacgccaacctctacagtcccgaggggccttccccaaaacaagtcagaatctga

SEQ ID NO: 62309 - DNA, 101 bp, Glycine max
  Peptide Sequence Number=SeqID_153994
gaaacaaggagtttgaagaggccatgaatcttgaagttgttagactttctacaagatacctgctctcataccacttgttggatcaagtggcctcagaataa

SEQ ID NO: 62310 - DNA, 285 bp, Glycine max
  Peptide Sequence Number=SeqID_153995
atggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgaggtatttattcaaataggtataatccacggaattgggaaattttagaaaatcttaagaagaaagaattcgagataattattcttcctatgatgcaattggagcttatcaacaaaaaagggtaa

SEQ ID NO: 62311 - DNA, 147 bp, Glycine max
  Peptide Sequence Number=SeqID_153996
ttcagggcagaggtcgcatggcccggagattggccggaggcaccagcagaggcaccagcagaggctcccgacgaggcagatgaggcccacgaggacgaggagatgaccgatttacttgatttcttaggagggagcagggccacatga

SEQ ID NO: 62312 - DNA, 294 bp, Glycine max
  Peptide Sequence Number=SeqID_153997
atgatagtagacatgttaccagtgttctattatggaaatggtgggttacacaccttcaagctttgcggatttggccttcgccggcagaaggatcaaaagggtgagaatgagggagaaactcatgctgtgactgccattcctatacggccaagcgtcccaccaacccaacaatgtctttactcagtcaataacaacccttctccttacccaccacccaattatccacaaagaccattcctaaatcaaaccacaaagcctgtctaccacacttccaatcacgaacaccacctttag

SEQ ID NO: 62313 - DNA, 321 bp, Glycine max
  Peptide Sequence Number=SeqID_153998
ggtacatcctttgtggtacaagtagagggtacatctacttgggttgttgtcactgagaacaagagagggtacatctcttgtggatcagttctagtggagggtacatccactaggttgttcaaagagaacaagggagggtacatcccttgtggatctttgcttgtaaaggaattttacaaggttgaaaagaaatctcaaggaccacagcccgcaggtcgcttggggactggatttaggcacaggttgttgtcgaaccagtataaaactcttgtgtttgttttcttcttccctacactctttattttctgctatgcactttaa

SEQ ID NO: 62314 - DNA, 537 bp, Glycine max
  Peptide Sequence Number=SeqID_153999
atgcagtccccaagcgacctgtggtccttgagatttcttttcaaccttgtaaaatcctttacaagcaaagatccacaagggatgtaccctcccttgttctctttgaacaacctaatgtatgtaccctccactaaaactgatccacaagagatgtatcctctcttgttctcagttacaacaacccaagtagatgtaccttctacttgtaccacaaaggatgtaccctccaatgtgttaagacaaagttctcaggcggttagtcctttgaaactttgtgaagggggatacaaaagatatctcaggcgggagaagggagacacaaaagaattcaggcggttagtccttcgttcttttggaaaagggagaagagagacacaaaaagaattcaggcggttagtccttgatgaattctttttggcaaagggagacgagaataaaagatatagcacacttctgttttcaaggtttggaaaaccagaaaactttagaaaacttttgcaaaggaagaagaagaagaagaagttcaagaagatgtaa

SEQ ID NO: 62315 - DNA, 348 bp, Glycine max
  Peptide Sequence Number=SeqID_154000
atggtcattgatcagtcactgttcttttctttgactcatttacccagtcaaggtgcaccttttgagggcaccattgttgatgactggaaatttgattattcgagtcatgatgctcgtcgcatggtctgcaatgatcaagctgaaatgaccgtgacctcctttgtgtatcgtaaagatcggaatggtcaatggctgaagaaggatgcactccctcctcaagatgaacgtactccttcacctcctcctccatgcgaagattccgcactcatgaatgaagtcctctccgaattacggggtcttcgttcttatgttggtgaccgcttcgactcgttagatacacgcttgccg

SEQ ID NO: 62316 - DNA, 378 bp, Glycine max
  Peptide Sequence Number=SeqID_154001
atggttagactattaccacttcaagatagtctaacatcatataccccatccccgtcttctatgtctatcccagttaggcctcccgatgttgcacatacaccatctccacctccgattgaagctagaccatcttcatctcatgttaatgcacgtggaccatctctggtacctgcatccacaccatctccatcctccattgatgcatgtggaccgtccccaatacctacatccacaccttccccatcttcgcctatgggcaacatgcctatagatgaagctgttgtaaatttggcgatggaagacccctctcttaataattgtcctatggttacttcaaaggttgaaatggatggtaatgctattttttattttaactga

SEQ ID NO: 62317 - DNA, 752 bp, Glycine max
  Peptide Sequence Number=SeqID_154002
gaaatggctctaaagaagcttcccctaagagagtaaggaaagaggccactagagaagggtctaatgcggccccacaagttgatgtggagtttgatggacattggaggcagtggactcaacttgcggcacccatagctaagtatgatccaaaaatagtcatggagttatacgccaatgcatggcccacagagaagggagtcagggacaagcgctccaagaggggcaacactacgaattcaatcagaggaggagccaagcctcggggttcgatgaggaggccatcagtcaacagctgtgtattacggggtaggacttcgcccgaagcgtggcagggagacggggatcatgcctcccagacacccactagacctgaagaagtccaacaggacactagagtttccagccttgatcacgggcctctactagttctatggggtgccggagaaggaccaccagcagccagccgcagatacgccgccgccacctctatgcatgtgaccgaccagcaggcgactaatcttaggggtcaagtgcagctgaatgagagcttctaccagtacaccttgcatcagcagagccaagatcctagccctttcccgtggcctaccctagagcagtttggggccacagttgcatggccgggagataagcccgattttaaggcaagggcaggacccgcaggggcccctggggatgaagatggagctcaggaagatgatgacatggccgatgtgatggaatatttcctttga

SEQ ID NO: 62318 - DNA, 639 bp, Glycine max
  Peptide Sequence Number=SeqID_154003
atgaaaattctaaccgagttgcatctttacaagattggtgctgaccactttggttccgactttgcaatggctcaaaggaaaacccattctcctagatgtgaaagaaattggagtgtgtttgagcaaattcattccaaaaaaagaaataggcttgagcacaagaggttgcatgatttggtgtttgtcaaatacaaccaacaattgaagcaaagatataatgcaagagatgaaattgatccaatttctcttaatgatattgatgtgtgcaatgaatggctcgtggaagagatggatcaagatgatgataatgatttggtatttgaagatgatgatgctctaaattgggcaactgtgtatcaggcttcgggggttggagagtgtaggatgtatactaggcgaaaaaagcaaaaaacaacaagtgttgctgctgcccaaacttctaaaaaacaggcaatggttgttggatcttcatcaaggaagcaaaaagcagtccaagaaaatgatgaagatctagattttgaggagaatattgatcttgaatctgaagaagaagaaatcatgatcaattttgaggcgtctgatggggaagagggagagggagatgatccattaccatatgataacaacgaagatgattat

SEQ ID NO: 62319 - DNA, 636 bp, Glycine max
  Peptide Sequence Number=SeqID_154004
atggacctcatcaaggctgctggactgctgagaactgtcaccaagttgggagattgctatgaaagtctagtcagagaattcattgtcaacattccctctgacataacaaacagaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcactgccaagcaagtccagcattggccaaagaaagggaagccttctgcagagaagctaagtgtgaagtatgcaatcctgcataggattggcactgcaaactgggtacccaccaatcatacttccactgttgccacagaatcttttgctgtcaaattacccattgccttcccaactgtattgtgtggcattatgtggagtcaacattccaatatcttaaacaacattgactctgtgaagaagagagaatctcctctgtcccctgcttaccaactgtttgaggggacacatgtcccagacattgtctcgacatcagggaaagctgctgctacaggtgctgtgtccaaggatgctttgattgctgaaccccaggacacatgccag

SEQ ID NO: 62320 - DNA, 429 bp, Glycine max
  Peptide Sequence Number=SeqID_154005
atgacaagaaacaagaagcgtttggtagttgaggaggaggatagggtggctttggataaacaaattgttgtaaatgatggcacggagaaaaagaaagaggaggaaatagaggtagaaaaagaaaatgaagaaaaagaaaaagtggaaaaaaataaagaagggaaagaaaagagtagaagtgagaaagcaggagagaagaataaagaaaaagcttcaaatgaggatacggaagtaccatatcctgtggtactttccaagaaggacaaggaccgccatctggcgagattccttgatattttcaggaaactgtatgccttttggggaagctttgcaacaaatgccactctactcgaaatttttgaaagatatgttgacgaggaaaaacaaattcatccaccaggagaatcttgttgtggcaggacatcgtag

SEQ ID NO: 62321 - DNA, 847 bp, Glycine max
  Peptide Sequence Number=SeqID_154006
ggctacacgtcctcgccttcaaaggactgcatgtcctttactttcagaggactacatgtcctcaccttcagaggactacacatcctcaccttcagagggctgcacgccctcgccttcagaggactacacggctgcacaccctcgccttcagagggctgcacaccctcgccttcagagggctacatgccctcgccttttgatggctgcatgcccttgccttcagaggactacacatcctcaccttcagagggctgcgcggctgcacgccctcgctttcagagggctacacgccctcgccttcagaggactacacgtccccgccttcaaagggctacacgtcctcgcctttagaggactacacatcctcgccttcagagggctgcatgccctcgccttcagaggactgcacgtcctcgtcttcagagggctgcacgccctcgcctttagaggactacacgtccttaccttgaaaggacaacacatcctcactttcagtgggctccatatccacaccttaagagaatttaagggcggccaactgtgcgagcacaaccagagggaggctatcgtgcaaccactatgcatactagggcaagatttcacccttgccactgcaaagagacgtgtgtggatcatgcgcaccaacatgaccactcttacacagatatggatgatgttgctacttagcaacattcctcccggcgaccacaatgccgatcttcccccacggaaggatcgcgcccgcatgacacccagtggacccgaagaagtccaacaggaccttggggtttccaactctagttacaggcctctgacagtcctacagggtgcccatccccacagcaag

SEQ ID NO: 62322 - DNA, 201 bp, Glycine max
  Peptide Sequence Number=SeqID_154007
atgaagcccaaagaggattgcaaggaagaaaggcatggaaaacatgagaaagccttaagtgtcattctttccttgatcgctaccacttctcttgcaataatgtggaaggtacttccagaatacacgagtttcatggcgtctctaactaagaggcgaaaatgcaaggaagatgtgttctacgtgaccttcatgccaccttga

SEQ ID NO: 62323 - DNA, 171 bp, Glycine max
  Peptide Sequence Number=SeqID_154008
atgtgtcaaggcaaagaattctcaggcggggaagggaagaatcaaaagaattctcaggcggttagtcctttgaattctcttggaaagaaagaagggagacacaaaagaattcagacagttagtccttctattcttttggcaaagggagaagtgaatgaagaagaagaatag

SEQ ID NO: 62324 - DNA, 123 bp, Glycine max
  Peptide Sequence Number=SeqID_154009
atggcctttgtggataactgggtagtgggtaaggagaaggggcgctacttgagctgccagatccctccacctttgggcatattccttgaaggattcatgctcgtttttgcacatgttctatag

SEQ ID NO: 62325 - DNA, 219 bp, Glycine max
  Peptide Sequence Number=SeqID_154010
atgcatgttcaaactggtattaaaaggtgtaatattaatgagaattcctccatgttatggcaccggagattaggacatatctccattgagaggattaaaaggttagtgaaagatggagtactcaatactctagattttgctgactttaagacttgtgtggactgcattaaggatatggatgcaccgtggtcagaaatattttatcacctttatagatga

SEQ ID NO: 62326 - DNA, 276 bp, Glycine max
  Peptide Sequence Number=SeqID_154011
atgtaccctatcttgttttcagttacaacaacccaagtagatgtaccctctacttataccacaaagggatgtaccctccaatgtgtaaagacaaagttctcaggcggggaaagggaagaatcaaaagaattctcagactgtgtcattttgaattctttgaaaagggagaagggagacacaaaagaattcaggcgattagtccttcgttcttttggaaaagggagaagagagacacaaaaagaattcaagcgattagtccttggcgaattcttttag

SEQ ID NO: 62327 - DNA, 173 bp, Glycine max
  Peptide Sequence Number=SeqID_154012
aaaaagggattaagagaccgtgggtctcttgttgtagaaggattcctgaacacaagggaagggttgtcccctgtgtggttcaaactttgtaaaatgagtcttacaaagagagtggaaaaatctcaagtgggttgcttgaggactggacgtaggcacgggaagtggttgaacca

SEQ ID NO: 62328 - DNA, 306 bp, Glycine max
  misc_feature (202)..(202): n is a, c, g, or t
  Peptide Sequence Number=SeqID_154013
atgttgctaaatagcaacgtcatccatgtaagggtggtcatgttggtgcgcatggtccccactcgtctttttgcagcggcacaggggaaatcttgccccggtatgcatagtagatgcgtgatagcctccctctctggatgtgctcgcacagttggtcgccctccaatatcagggggtggtcctcatatgaaattgattgtcncttttggaacaaagcgtgataattcatgcaaccttatcctatcttttgcaaatctctctgggaactccctcagagtgtatattctgtttgatttagtcacttga

SEQ ID NO: 62329 - DNA, 279 bp, Glycine max
  Peptide Sequence Number=SeqID_154014
agggtacatctacttgggttgttgtgactgagaacaagagagggtacatctcttgtggatcagttctagtggagggactttacaaggttgaaaagaaatctcaaggaccgcaggttgcttggggactagatgtaggcacgggccacttgatccaacacgggatagaggctatgcttccatttgaagtaaaggttccttctttgagaattctagccaaatcagggttggaggaatcggaatgggcccaaactcgctttgatcagttgaatcttatagaag

SEQ ID NO: 62330 - DNA, 157 bp, Glycine max
  Peptide Sequence Number=SeqID_154015
gcaaagggagaagggaatgaaaaagatgaatagcacaagttttcaaggtttagaaaaccagaaaaactttggaaagcttttggcacaaagcggaagaagaagaagaagaagaagaagaagaagttcaaagagattcaaggcttgtaaagaattgtaa

SEQ ID NO: 62331 - DNA, 450 bp, Glycine max
  Peptide Sequence Number=SeqID_154016
attgactgggctcacttggttaggtaccgaatgcataaggcattacgggccaatgcacctcttccgtattctcaattggtcacccattttctctgttattttcaaattcctcttgatgatgaaccttttgttcaagtcaagagatattttgctataggtgctggtgcagtaacttcatttggttaccataaggatcgtgatggacaatggttgaagaaggacgcgctacctccgcaagacgagcgtactccctctcctcctcctcagcgagatgattcttcagcccttatgaatgaagttctttcggaattaaggggtctccgcacctatgttggtgaacgatgcgattccttggatggtcgctttgaaggcatggatactcgcatcacccagcttgaagaggacgtgggttatcttcgtcggtgcttcgaccttccaccgccttcttag

SEQ ID NO: 62332 - DNA, 463 bp, Glycine max
  Peptide Sequence Number=SeqID_154017
ccccgcgaattcattgcctagcgctgttcgccaattctccattctcaatcttattcggagacccatgaattcattgcctagcattgttcatgtgtcctccaccaacgagtttggagccccgcgaattcattgcctagcgttgttggccaattctctattctccaatcttattcggagacccatcaattcattgcctagcgctattcatgtggcctccaccaacgagtctggagccccgcgaattcattgcctaacccccgcgaattcattgcctagcgctgctagccagttctccattctcaattttattcggagacccatgaattcattgcctagtgttgttcaagtatcctccaccatcgagtctggagccacgcgagttcattgcctagcgttgttggccaattctctattctccaatcttattcggagacccatgaattcattgcctagcgctgttcat

SEQ ID NO: 62333 - DNA, 312 bp, Glycine max
  Peptide Sequence Number=SeqID_154018
atgaaaaagaagaagattgcaagttacgagagtcgatttgatgaagaaatgagtaagataggaaggtttggaggcaaaattgattgcaataacataaatgagataagggaagagagaatgcaaacacaattttatactggttcggccacttcccgtgcctacatccagtactcaagcaacccacttgagatttccactatctttgtaaaatccattacaaagtctgaaccacacagggacaacccatcccttgtgttcaggaatcctttacaacaagagactcacagtctcttaaccaatctcattgaataa

SEQ ID NO: 62334 - DNA, 366 bp, Glycine max
  Peptide Sequence Number=SeqID_154019
atgctggctactggtaatcgattactaccttctagtaatcaattaccagagagtaaaactctttgggaatgggaagaatcaaaagaattctcagactgtgtcgttttgaattctttgacaagggagaagggagacacaaaagaattcaggcggttagtcctttgttcttttggaaaagggagaagagagacacaaaaagaatacaggcggttagtccttggcgaattctttttggaaaaaggagaagagaatgaaaagatgaatagcacaagttttcaaggtttggaaaaccacaaaacttcagaaagtttttggtacaaagaagaagaagaagttcaaagagattcaaggcttgtaaaggattga

SEQ ID NO: 62335 - DNA, 124 bp, Glycine max
  Peptide Sequence Number=SeqID_154020
ctttgagaagcatgtgatcctttggcatcatcaaaacattcagcttgatcctttgtctacaagtatgatattagaggacaaattgaaggcttgtcaaaggtcgaagaagggcttgactgaatag

SEQ ID NO: 62336 - DNA, 198 bp, Glycine max
  Peptide Sequence Number=SeqID_154021
gattcctttgaggagcaggaaacacagggatccttcgtcccccatggacgtcaggatgttctcaccactgttattggacgtccagagcaccctggatgtgtccgtgctgctggagccggtgtcacgatcaagcaatactttggatcggctccacggacgtcccgcaactcttcctccctgcctcctgaagaattgtag

SEQ ID NO: 62337 - DNA, 317 bp, Glycine max
  Peptide Sequence Number=SeqID_154022
atggctaaaaaaggcaaagtttctgtgaaggttttgacaatgtctaaggcaggtatcgcagggctggggttccaaggtacattgccaagtgtgtctgcaaatgttgaagtgctgaatgttgccaataactcaatttccggaacaatttctccctttttatgtggaaaggaaaatgctactaataagttaagtgtgcttgatttttcaaataatgtattatatggtgatcttggtcactgttgggtgcattggcaagcattggtgcatttgaacttgggtagtaacaatttgtctggtgttattccaaactccatggg

SEQ ID NO: 62338 - DNA, 939 bp, Glycine max
  Peptide Sequence Number=SeqID_154023
atgggacccctccaaaggcaagccttccgcaaagtctacgggaagattctagatttgaccgcagcggaggtatttacggaagctgtcgtatccctcgcccaatactatgaccagccgttgaggtgtttcacatttggggacttccaaatggtaccaactattgaagagtttgaggagatattaggatgccctcttggggggagaaaaccgtatcttgtctccggctttcttccttccttgagcaagattgcagctgtggttggagattcggaaaaggagttggattgcatgaagcaaactcggaacagcgtagtgggcctgcctcggaaatacttggaaggcaaggcaagggatatggcgagccaagagaagtggggcccgtttgcagatattttagctttgctgatttttggggttgtcctctttccaaacgttgacggtttggtagacttagccaccattgatgctttcctcgcatatcaccatagcaaggaaagtccagtggtggctatcttggcagatttgtttaacacctttgaccggaggtgtgagaaaaacaatgcacggattgtctgttgttttacccactctctgtgtgtggttgatttcacacctattccgacaagacacgagacaccccgtgtccgcttcaaaagctatcgctcatgcgccgaaaaaggaagagtcgattgggaccaacatttggctgggatagggggcagcgcgatcagttggtttcctcgttggaaggaaggcaaggaaggagttcttttcttgggtggggactaccctaatgttccgctgatagggactaggggttgtattaattataatcccgcactcgccataagacagctagggtatcccatgaggggagcgccaaccgaagaaagtctctcgcctttccttgtgaggaatctaggcgcgcaaaatctcaag

SEQ ID NO: 62339 - DNA, 1536 bp, Glycine max
  Peptide Sequence Number=SeqID_154024
ggcggtagcatcacctttgacggccagcgcattgatgcgctgcagggcagggcgctggccacgctgcgccgcgacattcagtttatctttcaggatccgtatgcgtcgctcgatccgcgccttaccgtcggtttttcaattatggagccgctgctggtgcatcgcagcatggggcgcgcgcaggcagagaaacgcgtcgcctggctgctggaacgcgtcggtctgctacccgaacacgcgcagcgctacccgcacgagttttctggcggtcagcgccagcgtatctgcatcgcacgcgcgctggcgctcaatcctaaagtggtgatcgccgacgagtccgtctccgcgctggatgtgtcgattcaggcgcagatcatcaatctgatgctggatttacagcgtgaatttggcatcgccttcctgtttatttcccacgacatggcggtggtggagcgcatcagccatcgcgttgcggtgatgtatctcggacagattgtggagatggggccgcgtcaggcggtattcgaacagccgcgccatccttataccaaaaaactgatggccgcggtgccggtggccgatccggcgcatcggcaccgcgagcgggcgctgatggtcgatgagatccccagcccgattcgcccgctgggtgatgagccggaagtggcaccgttactggaaggcgcgcaagacagggactacaggagaacgataacgatgcaccatatcatgcgaaaaggggttatcactgccgggttgttgagttcggcgctggcgctgcccgcctgggcggccaaagatgcggtgattgccgtggcgtcgaccttcaccacgctggatccgtacgacgccaacgacacgctgtcgcaggcggtggccaagtctttctatcagggcctgttcggcttcgataaagacatgaagctggtcaacgtactggccgaaagctatcaggccagcagcgatgggctgacttacaccatcaaactgcgtccgggcgtgaaattccaggatggcacggatttcaatgccgaagcggtgaaggtcaacctcgaccgcgccagcaatccggacaaccatctcaagcgttataacctgtttaaatatatcgccactaccgaagtggtcgatccgtccacggtgaaaattaccctgaagcagccgttctcagcgtttatcaacaatctggcgcacccggctgcggtgatgatctcaccaaccgcgctgaaaaaatatggcaaggacatcggtttccatccggtaggcaccggaccttatacctttgacacctggaaccagaccgactttgtcaaagtgaaaaagtggtcgggctactggaaaccaggctatccgaaactcgacagcattacctggcgtccggtggtggataacaacacccgcgcggccatgctgcaaaccggtgaggccagctttgccttcccggtgccgttagagcaggccaaactgctgcagggcaatagcaagctggatgtggtaaccacaccgtcgatcatgcagcgttacatcagcctcaac

SEQ ID NO: 62340 - DNA, 321 bp, Glycine max
  Peptide Sequence Number=SeqID_154025
atgtcaggatttacacgcgattctcctcaaatttcagccagcccgcatcaattataccttgcaccttacgcttcagagccctacaatgctcaatggaacgccccggggcttctccgtgacaagcacacgttgcgtttgaatcgtattcttggaaaaatggaggttgatgaaccttggctggggttatggctaccattgaattatcaagtagatatgggagcaagctttttcaccgcaaaattcatttcttggttggtgttttggtttatgctaaaggtggtgtttgtcattggaagtgcggtaggtaggctttgtggttga

SEQ ID NO: 62341 - DNA, 228 bp, Glycine max
  Peptide Sequence Number=SeqID_154026
atggttagagggcaaggttggatggtgaagttgatgtgtgggaatcataatcatgaattggcaaaggataaaaagacaattattgctgatatgacaaagtcaatggtcaaaccaagaaacattatgctaacgttgaaggagcacaatgtcaatagttgtacaacagtcaaacaaatatacaatgcaagaagtgcataccgttcttccattagaggaagtgatacttaa

SEQ ID NO: 62342 - DNA, 303 bp, Glycine max
  Peptide Sequence Number=SeqID_154027
atgtcattcaataaggaagatgaggaatcccgttgcggtggcggggagggtgtgtgttcatcaggaattggaggtggaaggtcgtgtttatgcacccattggccatccacatcctttcgatatccaaaggaggcaacaacactagcaccaatagaaaataaatgtttgaccttaacaaaagatggactcagtcaatttggtgaccggtttgaagagcccctagcaaaattaaatcctcctcagaggcctaagaaagatttctggaacgtggaagcaaaactcgacaaagaatataatgcataa

SEQ ID NO: 62343 - DNA, 204 bp, Glycine max
  Peptide Sequence Number=SeqID_154028
ttactcaatcccacaaaatttttagggaacattgtggttgaacatgattatgctgagtgcactggatctgctattcaagctttagttttgtttaagaagctatatccaaggcatagggagacagagataaagaattccattgccaatgcagttcatggtatggaagttggggagtttgctacatttatggcacttggtggctaa

SEQ ID NO: 62344 - DNA, 840 bp, Glycine max
  Peptide Sequence Number=SeqID_154029
atggaagaatcatccaagaagcgcaacggttcatccacctccgctgcggcacatagaacatcacgttccggagccaccggagcatccccgacaccaattccaccatccttgtcatcctctacactattttcatctaatgaacaacgtatccagtactcctctctctttaaatctcgtcaaattcttgatcccaaatatcttgacctagaattctttgatgggaaaacatttgattgctatcaagtgtttcaaaacactagtctgattccttttatgtcattaaaattaccatattatcctgagttagtacgagtcttttactcaaatttgaaaattcaagatggaactttaatttctgaggtgcatggtatccctatgattattgatgagtctcttttcttttctctgacacaactacccagtcagggtgcaccttttgcgagtacccttgttgatgaatggaagtttgattactttagtcatgatgcccgccgcatggtctgcattgaccaggcagatacggccggcagactgcttgtcgggtcattgacatttgattgtcgcatcatgcactatatcattgttagaattttgatgcctcgttcttctaatctcgctcaagcctctgaggaggacttcattctgatgtgggctttcttaaccggccgtccaatcgactgggcccatttgattcgttaccacatgcataatacattgcggtctggtgcacatctaccttaccctcagctagtgactttgttgcttcgacattttgaaattccattgaattttgagcctttggtgcaagttcaacgttcctttgctattgctgccagtgcg

SEQ ID NO: 62345 - DNA, 49 bp, Glycine max
  Peptide Sequence Number=SeqID_154030
agttttactctctggtaatcaattaccagaggatagtaatcgattccag

SEQ ID NO: 62346 - DNA, 75 bp, Glycine max
  Peptide Sequence Number=SeqID_154031
atggaggtggtgtccccactaagagattgcagggatacacaccctgaagaagcatggtcagaaaaagaagcctag

SEQ ID NO: 62347 - DNA, 174 bp, Glycine max
  Peptide Sequence Number=SeqID_154032
atggagggtacatcctttgtggtacaagtagaggttctagtggagggtacatccactaggttcaaagagaacaagggagggtacatcccttgtggatctttgcttgtaaaaggatttttacaaggttggaaaagaaatctcaaggaccgcaggtcgcttggggactggatgtag

SEQ ID NO: 62348 - DNA, 243 bp, Glycine max
  Peptide Sequence Number=SeqID_154033
atggtgcgtaatcagctttcctcttttaagtcctacctcgagttgggtctttccccggcgaatactaggtccgcgaagctggacggctgtaacctactgcttctcatagctagaacatggcctaccatcatggtaggccatctgttctctctcagagttgagcagtgtcggctttcatctgtctttgagtgcgatcgggagccatatcggaattgtactgatattgccttaggaaggcagtaa

SEQ ID NO: 62349 - DNA, 58 bp, Glycine max
  Peptide Sequence Number=SeqID_154034
gatttgtgtaatcgattacagcttttaaaatttgaattaaaacgtttattaactgctg

SEQ ID NO: 62350 - DNA, 279 bp, Glycine max
  Peptide Sequence Number=SeqID_154035
atggaggccatgaaagaccaaatgaccaccatgatggaggccatgatgagcatgaggaaaatgatggaggtcaacgtggttgtgtcatcgctacaagttccgccattgagagcaagcatcctttcccacaatatggcctgcctcccaactatgcaccatccaatgttgtacatgggcatgatgagaatgttgaccactccactcctatacccctcgagagccaaacaaccctcagtctgggcatgcgcatgtcgcttaacccatgggggagacgcatga

SEQ ID NO: 62351 - DNA, 312 bp, Glycine max
  Peptide Sequence Number=SeqID_154036
atggcagaaatgggaaagttggatcatctagaggaaaggctcagagccagtgaaggaggtgaagattatgcctttgctaacctagaagagttgttcctagtacccaatatcatcacccctcccaagttcaaggtgctagactttgacaagtacaaggggactacttgccccaagaaccatctaaagattgaaaggatcaatgtgggtccgaaaaaaggcaaatttgatcatcctactaggacgactgagaaaactggggcaaataaagagggtgagaaagagggagaaacccatgttgtgactgccattcct

SEQ ID NO: 62352 - DNA, 279 bp, Glycine max
  Peptide Sequence Number=SeqID_154037
atgttggtgcgcatgatccacactcgtcttttggcagcggcacgggtgaaatcttgccccggtatgcatagtagatgcgtaatagcctccctctctggatgtgctcgcacagttggtcgccctccaatatcagggagtagcccaggaaccgttgaaaggaaaccgtggccccccacactgaaaatgaggacgcgtagccctctaaaggcgagggcgtgcagccctctgcaggcgaggatgtgcagtcctctgatgccgaggacatatggtcctctaaag

SEQ ID NO: 62353 - DNA, 353 bp, Glycine max
  Peptide Sequence Number=SeqID_154038
atggcagggatagaccttggccctcttattggtggaggggatattcgaaaagtaggggatggaagcatagtcaacttctggaaggataaatggcttggggctgtttcaaaccttgaacagcagtttaatcagctgtttctcatcagtaaacagcagaccagttctatttccaatatgggtaacatgtcccatggtcattggtgctgggatttaaagtggagaagaaacttatttgatcatgaacagggtgcagctgtggcttttatggaaaccattagtaatgttcacattcagcctcatatgaaggacaccttgagctggacagctgaatcttcgggtttatactcaactag

SEQ ID NO: 62354 - DNA, 149 bp, Glycine max
  Peptide Sequence Number=SeqID_154039
tggaatggagaaggaagagagagaggagatgccacttcaaggagaagatgagtctagaagaagctcaccaccataagaggccatggataagagcttggaagaagaaggagatgaatgaagggagaggaagagaagagcaccgaatttag

SEQ ID NO: 62355 - DNA, 302 bp, Glycine max
  Peptide Sequence Number=SeqID_154040
acccagagcacgatagcacgcagagactaacgtcgtcttctgcaccctttgtcaatcgcagtctgagcccgttgacacgcagagacttatatcgtcttctgcaccctttgtcaatagcggcagagataccttatggtcatccgcgcctttcgtccaccgaggggaacggatttgacggtatcaggatgataaacattcaagcccaacgacgcgcaagattcttctctgctgggcagggacgatcgagtgcaatggcaaagggaattgtcgtggttctgctggcggggatattggccggctga

SEQ ID NO: 62356 - DNA, 130 bp, Glycine max
  Peptide Sequence Number=SeqID_154041
atgtcacacaaggaactgattaagatatttggaatggaaaactcgaaacacttggctactcctatgagcaccagttgttaccttgacaaagatgaatccggtcaacccgttgatgcaaagcaatacagag

SEQ ID NO: 62357 - DNA, 237 bp, Glycine max
  Peptide Sequence Number=SeqID_154042
atggatgaagaggtgggtactggagaagaagaaggtgttggtgcctttgatggtgctgaagtggaaggggcctcagatctcttacccctggccttcctgggtcctctgaaagttactggagatctagtgggagatgaggtgccccacattcatgtccatcttcatgatgatgccataaatgaatctggctctgtcaagagtgacatcaaaagtgtgggaagtgggaataaggtttga

SEQ ID NO: 62358 - DNA, 201 bp, Glycine max
  Peptide Sequence Number=SeqID_154043
atgactcaggctgagaagaagacatgtccagcactccagtggaaggctctggctgaggtagagtgggctctgaggcctctagaatgtcgtcctcctggtccgactaaggctcctgggctgcagaggcctcacctcctcccaaaggagaaggctggactcttagccaggccaccttctgtaaaaactcctccacgctcataa

SEQ ID NO: 62359 - DNA, 297 bp, Glycine max
  Peptide Sequence Number=SeqID_154044
atggttaatctatgtctaatggccaaaaattatgaaagcgacaaagaggtatctttgaagaagaaatggtatatagatagcggttgttcaaagcatatgacgggagattcatcaaagttcacacatatctctcccaagaaaagtaatccttgtggcgtctatcctgacttatcttccttcaccggaagtggcgtctaccctgacttatcttccttcactggaagtggtgtcatccaaaaattctacagcctgtatcaagcgatccgccccgtaaggttcacatcatatagggtatag

SEQ ID NO: 62360 - DNA, 219 bp, Glycine max
  Peptide Sequence Number=SeqID_154045
atggcagaaatcaaccaaagtaagacgatgaccggtcacgattggccgcgtattttcgtttcctactttaagttcaagttaggtgagacgctaacccatgaaaaaggaggggacatggttaatgttcccctcaaaaaaaaaaaagtagcagagacagcatgggaaagtccaaataggtgcccaaatgtaatcccaagcttagaaacccaaactttttaa

SEQ ID NO: 62361 - DNA, 174 bp, Glycine max
  Peptide Sequence Number=SeqID_154046
atggtggtgagcttcttcttgactcatcttctccttgaagtggcatctccaatcatctttcttccttctccattctactgccatgatcttcaagaagcaaaggattccatagatgaagaagatccaaggcctacaagctccaatggagttacaccatgtggttctatcacttaa

SEQ ID NO: 62362 - DNA, 384 bp, Glycine max
  Peptide Sequence Number=SeqID_154047
agacaggtccagggtgatgcaccacaggccgcggacgcgccgccacctcatcaggctggtccagccggattgtttgatacagagcagtatttgcggtatttggttcgccagcaggcggccaaccactgggcacatgtacagactcatgattgtctttatcagatgagtctcagcctgcagagccagggctttacttctttttcgtgccctactccagaccagttcagggcagaggtcgcatggcttggagattggcctgaggcccaggcaggagaggcaccagtaggggcaccagcagaggctcccgacgaggcagatgaggcccgcgaggacgaagagatgaccgatttacttgatttcttgggagggagcggtgccacatga

SEQ ID NO: 62363 - DNA, 231 bp, Glycine max
  Peptide Sequence Number=SeqID_154048
atgcgtttgacaagaaggggcaggatcatcttaggccatggtcagaagtcgagacgagttgacggcagaaatcaaccaaggtacttaggcacggatgctaatggaggacagggtcacgaccaaccaatcgtcgtcccttcccagcgttgggccagcggagaacgtcgctgcaaggcagcccagtatcctttgaattcacagtattttattactattgtttgttttaaataa

SEQ ID NO: 62364 - DNA, 648 bp, Glycine max
  Peptide Sequence Number=SeqID_154049
atgaacttaatcattgtcaaccgaaaagaacacgctttacggtgcccttaccgaacctatgctagagctagagtaatgggtgaagtagaggaggtgcaagagcagatgaaggccgacatggaggccatgaaagtgcaaatggcaacaatgatggaggccatgatgagcatgaagaagataatggaagccaatgcggttgcaattgccgctactagggatgttgctaaggtgaacctaatgcccccatctgatctcaatcaaatgaatcatccaacctcaggtatggtgggcaaagatttgggaagtacggacgaccccatgatgtgcaaattcaaaatgagcacgccttcccgccatatggcttgcctcccaactatacaccacccaatgtggtgtacactcccaatgagaatgtcaataactccactcccatactcgttgagagccgacaaacccaaactaatcatgcacatgtctctcaaaccgtggaggagacacatgaaattccccaccacaatccagccgactccgagccttgcctcggatatgccactgaagggcaaacagttggtgatatacccctgcaaaacactttggagggccctcagtatcacaaacaactacacccttgcattccacagcgggtaa

SEQ ID NO: 62365 - DNA, 432 bp, Glycine max
  Peptide Sequence Number=SeqID_154050
cgtgtatctgacttatcttccttcactggaagtggcgtctatccggacttatcttccttcagtggaagtggcgtctacccggacttatcttccttcatcggaagtggcgtctaccctgacttatcttccttcactggaagtggcgtcaaccaaaaactctacggcctgtatcaagcgatctgccccgtaaggttcttgggcatggactctctgtttgaggataccaccataacctatgtcagatgcatcagtttcaataattttgaatgcctgcggaattgggagatacaaacatttgatagattggactttgattttgatgtttttgacaacttgagggcattcttcagactgaatgacataacattccattcatattgcccgaaaggtcccgtgaaagcagttttgtacctatccaattcttggatctga

SEQ ID NO: 62366 - DNA, 171 bp, Glycine max
  Peptide Sequence Number=SeqID_154051
atgctccacccatatgagatcaacataggcttaaaggagcactcaaactgtgtgacccccaaggcctacactccgaagagtccgtcagggcctctccctcctaattcagggttcctacagtggatcccatcacaatactcgtcgcccttaaagggtcttacaattgtgtga

SEQ ID NO: 62367 - DNA, 78 bp, Glycine max
  Peptide Sequence Number=SeqID_154052
atgggctcgggaaggttccaagttagtgtaccagtccccttgtacttgtcaaagtccaacaccttgaacttgggaggg

SEQ ID NO: 62368 - DNA, 386 bp, Glycine max
  Peptide Sequence Number=SeqID_154053
atgcccttggggggtaggattgcatcagagtgcaaggtaattttcactaggagacagaggaggaagaatgccgagaaagaaaagagagctgagggattattggaggatgtgagtaatgaggaaggagagaataataagagagaagagggtgatgaagagaaagaagagagcaaggagaggggtgaaaaggtcttacccactaagaccaagagtcaattagcaagggaggctaggagggagacacccgcagccccagtaaaggacaccccttatcctttggtgccatcaaagaaagagagggagcactactttgctcgcttcatcggcatattcaagaagctggaaatcaccatacccttcggagaggccttacagcaaatgcccat

SEQ ID NO: 62369 - DNA, 199 bp, Glycine max
  Peptide Sequence Number=SeqID_154054
cctcgatccccagggtttcccttcttttgcgtgccctactccagatcagtttagggctgaggtcgcatggcccggaaattggcctgaggcccatgcaagggaggcgcccgcaaaggctcccggcgatggaaaggaggcccgcatggacgaagaaatgacggatttgctcgatttcttgggagggagtggagccccgtga

SEQ ID NO: 62370 - DNA, 276 bp, Glycine max
  Peptide Sequence Number=SeqID_154055
atgaattcatggggtctccgaataagattgagaatggagaattgcaaaacagcgctaggcaatgaattcgcggggctccaaactcgttgctggaggccacatgaacagcgcaaggcaatgaattcgcgatgctccagactcgttggtggaggacacatgaacagcactaggcaattaattcatgggtctccgaataaaattgagaatggggaattggcgaatagcgctaggcaatgtatttgcggggatcctgactcgatggtggaggacacatga

SEQ ID NO: 62371 - DNA, 276 bp, Glycine max
  Peptide Sequence Number=SeqID_154056
cgcacccgtgagcctcgccttcgctcgcccgcgaagggcacgttgcgacaaccctctacttgtaccacaaagaatgtaccctccaatggaaaggtcagactatgttgttttgaattctttgaaaagggagaagggagacacaaaagaattcaggcgggaaaagagaaagaaaaagatgaataacacacttttgttttcaaggtttggaaaaccaaaaaacttaagaaagcttttggcaaaggaagaaggagaagaagttcaagaagatgttcaaag

SEQ ID NO: 62372 - DNA, 552 bp, Glycine max
  Peptide Sequence Number=SeqID_154057
gtagttgtgtctccaccaaaaccacctccgaagcccgatccggaggtcgatgatccgctttatctgatgacattgaccatcccaaagcttttcttgaggccttatcagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcagtttgaatctgaaagttacataaagagttgtatgcagagttcacaacgcgatgtgtatcttggagcctacctaaatgggccagacaactaccttaaggggattattaatagtgctatcaagggtcttgatgatgctccacagcctaaatcaaaggctcctgctaggtggattgtcgtcaagatgtccaccatcattttaggaacttttaggaataattgggaagcgtattttaacgatcctagatcattggagccagagagattaaaggcattgcagatctag

SEQ ID NO: 62373 - DNA, 180 bp, Glycine max
  Peptide Sequence Number=SeqID_154058
cgggtggattttgtggccgatttaggggtgacctttgtggctgattggacgttcttggttggtagggtggtgagtaatgggcaggactggtattggctaagtagtgatattgttggggaggatattggtacatgggattataaggagctagtggaaagtttggccatgcgggaattgtag

SEQ ID NO: 62374 - DNA, 267 bp, Glycine max
  Peptide Sequence Number=SeqID_154059
atgatgcaagctccattggagcttgtaggcctagatgaatggcagcggaatgaagaaagggagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaagttaatattcaaatgatcaaagttgaaaaaaatgcacacacatga

SEQ ID NO: 62375 - DNA, 321 bp, Glycine max
  Peptide Sequence Number=SeqID_154060
atgatagaggtcaacacgactacagtcgttgccaagtgtaccgccactgaggtggacccgactcacccatctggcctcaatcaagtaaattctccagtctcggatatggtagggcagggaggcgaagcattaggaaggcatgaccaagagcaagggcatccacttgaaggacttggagggcctatgacaagggctagagcaaggaaagccaaggaaggtcttcaacaagtgttgtccatactatttgaatacaagcccaagtttcaaggagaaaagtccaaggttgtgagttgtatcatggctcaaatggatgaggactaa

SEQ ID NO: 62376 - DNA, 318 bp, Glycine max
  Peptide Sequence Number=SeqID_154061
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcacttcttgttgtgcggtagacagactttgtggttga

SEQ ID NO: 62377 - DNA, 261 bp, Glycine max
  Peptide Sequence Number=SeqID_154062
atgacttcaaaagaattgaacgaggagccatatgaagtgaaaatctcatgtacgaaacatgtaaagtgtgtggctaacccaaataacgaaagtttcgtaagggaactggagcaggctaccatgagacaaaagattttctttctaaaagaaattcgattcggaactacgatatgtccaaggtccaatatggaaagaatttcagaggttttccttgactttgtccgtgtcaacaaacaattcgaaatgcctcgacttttttag

SEQ ID NO: 62378 - DNA, 210 bp, Glycine max
  Peptide Sequence Number=SeqID_154063
atggagtattttcgaagctggattgcttttggaggaagcaacccagctcgcctgggcgagctgggcggcaacctcctccccctttttcctataaagaggctgaagggggctgttctaagggtcccggatccccctggtgatgtatttcagctatttcgggtgaaaaaaatcatttttgtgaagaaaatccaagccgaggtgcttccgtaa

SEQ ID NO: 62379 - DNA, 327 bp, Glycine max
  Peptide Sequence Number=SeqID_154064
atggatgggcaatggttgaagaaggatgtgcaacctccgcaagacgaacatactccctctcctccgcctcaacgagatgactcctcagccctcatgcataaagttctttcagagttacgaggcctccgcacctatgttggtgaacgctttgattccttggatggtcgtatcgatgccattgatgcttgctttgaaggaatggatacccgcatcactcaacttgaggaggatgaattaagttgtcatcaagaggatcatgcgcttctcaagtttaattcaagacaagaatccaagaaattcaagatatatgatcaagataatctctag

SEQ ID NO: 62380 - DNA, 234 bp, Glycine max
  Peptide Sequence Number=SeqID_154065
gaagctgttgctactcctgagaggtcacgaaagggcacatcagatccacccacaccagtagtggacctatcctcacctcagcatacagcagacccctccactcctatactcgagatatcagaggacccgaccacaccagtcctgactttgaacacttctcctccaactactccagtactttatctaatagataaggaggatgttcagacacaggacacccaggaccagtcatag

SEQ ID NO: 62381 - DNA, 306 bp, Glycine max
  Peptide Sequence Number=SeqID_154066
atggtggtcatcctgcccaaggaacacctagttgtctggttttgttcattgcataacaggccagacaactaccttaaggggattattaatagtgctttaaaaggtcttgatgatgctccacaacctaaatcaaaggcttctgctagctactatgtgatgcactggatgtccaccatcattttaggaacttttaggaataattgggaagcgtattttaacgatcctaaaccattggagccagagagattaaaggcattgcggatccagtgggcacagttttatctccaagttagagatcaggcctag

SEQ ID NO: 62382 - DNA, 108 bp, Glycine max
  Peptide Sequence Number=SeqID_154067
atgtcttggcaggaggaactagagagaaatcaaaaggcatcaggttccaagtctgatggatgtgcaagacaggtgaaggaagttgcatgtcctatttgcactgtttaa

SEQ ID NO: 62383 - DNA, 351 bp, Glycine max
  Peptide Sequence Number=SeqID_154068
atgtaccctctcttgttctcagttacaacaacccaagtagatgtaccctctacttgtaccactaaggatgtaccctccaatgtgttaagacaaagttctcaggcggttagtcctttgaatctttgtgaacgggagacaaaagatatctcaggcgggagaagggagacacaaaagaattcaggagaacaaggtttggaaaccaaaaaatttagaaagctttttggcaaaggaagaagaagaaagatgagaagcaaaaggtttcaagatttctcaaaagtagttcaagaaattctaaaagttgtaagagttgtaagtcatcttgaaatgcaagtcaaggtcttgcttttatag

SEQ ID NO: 62384 - DNA, 509 bp, Glycine max
  Peptide Sequence Number=SeqID_154069
ttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttattttgactcaacacggggaaacttaccaggtccagacatagtaaggattgacagactgagagctctttcttga

SEQ ID NO: 62385 - DNA, 447 bp, Glycine max
  Peptide Sequence Number=SeqID_154070
atgtgggctttccttaccggtcgtcagatcgactgggctcacttggtttggtaccgaatgcataaggcattactggccaatgcacctctcccttaccctcaattggtcactctatttctccgtcattttcaaatttcgcttgatgatgaaccattagttcaagtcaagcgttcctttgctattggtgttggtgcagtgacttcttttggataccgtaaggatcagaatgatgagcgtactccttctcctcctcctcagcaagatgattcagccctcatgactgaagttctttccgagttacggggtcttcgtacttatgttggagaacattttgattcattggataatcgctttgccgacatggatatccgtctcacacaacttgaagaagatgtgggttatattcgtcagagcttcgaccttccaccaccacctccaccttcttag

SEQ ID NO: 62386 - DNA, 264 bp, Glycine max
  Peptide Sequence Number=SeqID_154071
atgtcagttctagaattgtacatagaaaaggatgttgctggtgattctatgtttgattttgcaaactccgttacgtcatgtggacataatctatctcataatgagtcagaactgccaagaaatataagcaatttacatgatgatgaagatgatgattatcttgcatctaactcatacgttgaagagtctttggatgaaatgatgagaatcctgaaattgaccaaatacaggctaaaggccaagtggagaagggcgaaggcccaa

SEQ ID NO: 62387 - DNA, 747 bp, Glycine max
  Peptide Sequence Number=SeqID_154072
atggccaatggcaagtgtttcaggtttttcccaaaaaagtttcagccagccacaattgttgaccaagatggttttcctgtttatagaagaagagacaccagacggattgtgcaaaaacagggtgttcatctcgataatcgatttgttgtcccatatagtccacatttgttactcaaatatagaacacacctaaatgtggaatggtgcaatcaaagtacctcaataaaatatttgtttaagtacatcaataaaggatctgatcggattacaacagctattgtcaatgaccaaaaccaggatggcacacaaaatcaggttcatgatgaaattaaacattatcttgactgtcggtatgtgtcggctcctgaagcatgttggaagatttttgcattcccaatgcatgggcgtgcaccggcagttgaacgtctttatttccacctagaaaatcaacagcctgtttattggaaagatagtcaagaaattggcacagtactggctaagagtacaatcaaagaatcaatatgctggaaaccaaggaaacaaggaaatactattggcaggctgatttgggtgcccccttccagtggagagttgttctacatgaggatgatgctttcctctgctaaagaatcacaatgttatgaagatattagaacagtagaaaatgttgtctatcatacattcagagaagcatgctttgcaaaagtttttctaggaagtgatcaagaatttgttggtgccttatga

SEQ ID NO: 62388 - DNA, 348 bp, Glycine max
  Peptide Sequence Number=SeqID_154073
atgggtgaccaagaggagacacaggaacagatgaaagccgacatgtcggctttgaaagagcaaatggcttccatgatggaggccatgttagggatgagacaactcatggagaataacgtggccaccgctgccgctgttagttcggctgccgaagcagacccaactctcccggctaccgcgcaccatcctcccccaaacgcggtaggacgagaaaggagcacactagggcacatcagcaacccccatttgggatacaaccgggtagcttacccttatggactaccacctaattacatgccaccagtcatgcgtgatgacgtgggtcatgtcccttcccccgtcctttaa

SEQ ID NO: 62389 - DNA, 90 bp, Glycine max
  Peptide Sequence Number=SeqID_154074
atggagatgcagcggaagacaaaggagaagagactaggtagcttccttgagaagctttctgaagaaaacttccttgagaagcttctttga

SEQ ID NO: 62390 - DNA, 280 bp, Glycine max
  Peptide Sequence Number=SeqID_154075
atggagaagtctgaaaagaaaaatattaatgaaaagaaattgatgaaagcatacattacatgggatgaaaacgatatggaatcttctgaagattcagaaaatgaagaaataaacctctgccttatggcaaaaagttatgaaagtgatgaagaggaacccttgaagaaaaagtggtacatagatagcggatgctcaaaacatatgacgggagacgaatcaaaattcacacatatctctcccaagaaaagcggacatgtaacttatggtgacaacaacaaag

SEQ ID NO: 62391 - DNA, 92 bp, Glycine max
  Peptide Sequence Number=SeqID_154076
ctttgagacacatgtgaacctttggcatcatcaaaacattcagcttgatcatttgtctacagtatatgtcatcttttgtgaatatgttagag

SEQ ID NO: 62392 - DNA, 132 bp, Glycine max
  Peptide Sequence Number=SeqID_154077
atggaggttgaggaaccttggttggggttatggctaccattgatttatcgagtagatatgggagcaagtcagcataggacactggaattggggacggcctatgtggataactgggtggtgggtaaggaggag

SEQ ID NO: 62393 - DNA, 255 bp, Glycine max
  Peptide Sequence Number=SeqID_154078
atgggtcttgatgatgctccactgcctaaattaaaggctcttgctaggtggattgtcgtcaagtgtaatagacaaaaaggaagtactgagtgcgactattatgtcatgcactggatgtccaccatcattttaggaagttttaggaataattgggaagcgtattttaacgatgctggactattggagccagagagattaaaggtgttgcggatccagtgggcacaatattatcttcgagttagacatcagagctag

SEQ ID NO: 62394 - DNA, 285 bp, Glycine max
  Peptide Sequence Number=SeqID_154079
atgaggggcattgtgcatgagcctcaagtgatcctaggggcaaatcaaaaatttcctacatctaatatccagtcgtgtggatttgggatgaccgaccctctcgatgagtcgatctcttgctttctcataagggtgaacccttgggtactagtaccctcacctccagaggactacatgtcctcgccttcagaggactacacgtcctcgccttcagaggactacacgtcctcgcctccagatgacttcacgtcctcaccttcggaggactacacgtcctcgccttga

SEQ ID NO: 62395 - DNA, 441 bp, Glycine max
  Peptide Sequence Number=SeqID_154080
atgaccgaccctctcaatgagtcaatctcatgctttctcataagggtggacccttgggtactagaacctctcgcctttagaggactacacgtcctcacctttcgagggctacgtaccctcgccatcagagggctacacgccctcaccctcagaggactacacgtcctcgcctttagagggttacacgccctcacttgcagaggactacacgtccttgcctttagaggactacatgtccttgacttgagaggactacacgtcctcaccttcagagggctacacgccctcgccttcagagggctacatgccctcaccttcagaggactacacatcctcacctttagagggctacacgccctcgccttcagaggacttcacatcctcaccttcagagggctacgtaccctcacattcaaaggcctacacgcggggatcctctag

SEQ ID NO: 62396 - DNA, 153 bp, Glycine max
  Peptide Sequence Number=SeqID_154081
atggctacaccaatgagtactgcttgctatctagataaagatgaaaccagtcagtcaatagatgttatagcaatatcgaggctttatgctatcctaaaaattgccccatgcaatttaataggatattatgagcttctgacttattccttctaa

SEQ ID NO: 62397 - DNA, 117 bp, Glycine max
  Peptide Sequence Number=SeqID_154082
atgtggaccaccacgggggacgagcttgccacccagctcgcccaggcgagcaaggttgcttcctccagaagcaactgccttctggaggaagaaactggaaggcccaagtgggcctga

SEQ ID NO: 62398 - DNA, 309 bp, Glycine max
  Peptide Sequence Number=SeqID_154083
atgactagaggcaatccatctgacttacaaccctttgatcctgagatagataggacatttcatagattagttaggcatcatcatttaccttttgagcatcctgagcattctgttattggtgagactgagcattttgtggttgataattttgaacatcctgattttgaacattatagttttgaacattctgagaacatgacacaacctctaccccgtgagaggactctaagggaaatggctgcacctgatttcacctacgaaagcttgtgcatccaataccttgatgaggatgtccgcatatgttcttaa

SEQ ID NO: 62399 - DNA, 1776 bp, Glycine max
  Peptide Sequence Number=SeqID_154084
atggaaaacttcaccaccaatcttaatcagcttgctcgcgtcggcggaattgacccgctgatcggccgcgataaagagctggaacgggccattcaggtgctgtgccgtcgtcgcaagaataacccgctgctggtgggcgaatcgggcgtcggtaaaactgcgattgcggaagggctcgcctggcgcattgtgcagggcgacgtgccggaagtgatgaaagagtgcaccatctactcgctggatatcggttcgctgctggccggtaccaaataccgcggtgattttgaaaaacgttttaaagcgctgctgaaacagctggaacaggataacaacagcattctgttcatcgacgaaatccacaccattatcggtgccggtgcggcatcgggcggccaggtggatgcggcgaacctaatcaagccgctgctttccagcggtaaaatccgcgtgatgggttccacgacctatcaggagttcagcaatatctttgagaaggatcgtgcgctggcgcgccgtttccagaaaattgatatcactgagccatcggttgaagagacggtacaaattcttaacgggctgaagccgaagtacgaagcgcatcacgatgtgcgctacaccgccaaagcggtacgtgcggcggttgagctggcggtgaagtacatcaatgaccgtcatctgccggacaaggcgattgacgtgatcgatgaagccggcgcgcgtgcgcgtctggtgccggtcagcaagcgcaagaaaaccgtcaacgtgtcggacatcgaatccgtggtggcgcgcatcgcgcgtattccggagcagagcgtttcggccaccgatcgcgatacgctgaaaaatctcggcgaccgtctgaaaatgctggtgtttggacaggacaacgcgattgaagcgctgactgaagccatcaagatgagccgcgcgggtctgggtcaggagcgtaagccagtcggatcgttcctgtttgcgggtccgaccggggtcggtaaaaccgaggtcaccgtgcagctggcgaaggcgctgggcattgaactgctgcgctttgatatgtccgagtatatggagcgtcacaccgtcagtcgtttgattggtgcgcctccgggctacgtcggctttgatcagggcggtctgctgactgatgccgtcatcaagcatccgcacgcggtggtgctgctggatgagatcgagaaagcccatccggatgtcttcaacctgctgctgcaggtaatggataacggaatgctgaccgataacaacggccgcaaagcggacttccgcaacgtggtgctggtgatgaccaccaacgccggggtgcgcgagaccgagcgtaaatccatcggcctgattcagcaggacaacagcaccgacgcgatggaagagatcaaaaagatctttacgccggagttccgtaaccgtctcgacaacattatctggttccgtcacctcgatactcaggtgatccatcaggtggtggataaatttattgttgagctgcaggcacagctggatgcgaaaggtgtgtcgctggaagtcagcgatgatgcgcgcgactggctggccgaaaaaggttacgacaaagcgatgggcgcgcgtccgatggcgcgtaccgtgcaggaaaacctgaagaaaccgctggctaacgagctgctgtttggctcgctggtggatggcggatcggtatcggttggactggataaagagaaaaaccagctcacctaccacttcatgagtgcggaaaaacgtaaaaccgagggcaccgtgcattaa

SEQ ID NO: 62400 - DNA, 2343 bp, Glycine max
  Peptide Sequence Number=SeqID_154085
atgaagcaaacagtggcggccctgctggccaaaacgctggagagcgccggcgtaaaacgcatttggggcgtaaccggtgactccctcaacggactgaacgacagcctaaaccgcatgggcaccattgaatggatgccaacgcgccatgaagaagtggccgcttttgccgccggggcggaagcacaaatcagcggtgagctggcggtgtgcgccggctcctgcggccctggcaacctgcatctgatcaacggcctgtttgactgccatcgcaaccatgttccggtgctggcaattgccgcgcacattccttccagcgaaatcggcagcggctattttcaggaaacccatccgcaggagttattccgcgagtgcagccattactgcgagctggtctccaatccggaacagctgccgcaggtgctcggcatcgcgatgcgtaaagccatcctcaatcgcggcgtgtcggtgattgtgctgccgggtgacgtggcgctgcaggcggcgccggagaatgcgcgcagcgaatggtatccgccgcagctgccgcaggtggtgccgtcggtcagtgaactgacgcgcctcgcagagacgctcaatgaagcgaaaaatatcaccctgatgtgcggcagcggttgcgccggtgcccatgcggaagtggtaaagctggccgaaacgctgaaagcaccggtggtgcacgccatgcgcggcaaagaacaccttgagtacgacaatccgtacgacgtcggcatgaccgggctgatcggcttctcatccggctatcacgccatgatgaacgccgacacgctggtactgctcggcacccagttcccttatcgcccgttctacccggcggacgcgcgcattattcagattgatatcaatccggccagcctcggcgcgcacagtcacgttgacatcgcgctggtgggcgacatcaaagccacgctgcaggcgctgcagccgcagctcaccagccacagcgaccgtcatcacctcgatcgcgcactggagcactacgcggatgcgcgcaaagggctggacgatctggcgaccgccaacgataagcaggcgattcacccgcagtatctggcccagcagatcagccactatgcggctgatgacgccatctttacctgtgatgtcggcacgccaacggtgtgggcggcgcgctatctgaaaatgaacggcaagcgccgtctgctcggctcgtttaaccacggttcgatggccaacgccatgccgcaggcgctgggcgcacaggctatcgataaacagcgtcaggtggtcgcgctgtgcggcgatggcggcttcagcatgctgatgggcgatttcatctcgctggcgcagcttaagctgccggtgaagctggtgatcttcaataacagcgtgctgggctttgtggcgatggagatgaaagccggtggctatctcaccgacggcaccgatctggagaacccggacttcgccgccatcgccaccgcctgcggcatcaaagggatccgcgtggagaaagcctcggagctcgatggcgcgctgcaacaggccttcgcccacgacggtccggtgctggtggacgtgatcaccgccaaggaagagttgtcgatgccaccgcaaatcaaagccgagcaggctaaaggtttcagcctgtatatgctgcgcgcgatcctgaatggccgcggtgatgaaatcgtcgagctggcgaaaaccaactggctgcgtgataccgtgacccgcccgagtgccgcgatgctggatgcgatgatggcggccgaaaccggcgatgatgtctatcgcgatgatcccaccgtcaatgcgctggaggctgaagcggcacgcctgagcggtaaagcggctgcgctgttcttccctaccggtacccaggccaacctggtggcgctgctgtgccactgccagcgcggcgatgagtacatcgtcggccagcaggcgcacaactacaaatatgaggctggcggtgccgcagtgctcggcagtatccagccgcagccgatcctcgcggctgccgacggcacgctgccgctgcacgacgtggcggccgccatcaagccggacgacatgcattttgcccgcacccgcctgctgagcctggaaaatacccatcacggcaaagtgctgccgctgagctaccttgaacaggcgtggcagtttacccgcgagcgccagctggcgctgcacattgacggcgcgcgcatctttaatgccgtggtggcgcagggtgtgcagctgatcgatatcgcccgctactgcgatagcctgaccatctgcctgtcgaaaggactgggcacgccggtcggctccctgctggtggtgagacgcttatattga

SEQ ID NO: 62401 - DNA, 1077 bp, Glycine max
  Peptide Sequence Number=SeqID_154086
atgccgacattctggcgcagttcgcgaatcgcgttgtcggacggcgtctggctaaaatcgaagtggttgccggcaatctgcaggctaccggaacgcggcagctccagcaggttgagcacgcgcaggagtgaacttttacccgcgccactcgggccgagcaacaccagcgtttcgccctgcgggcaggccagcaaaagcgtagcacaaaatcgggcagggcagcggggaaaggggctgacgggtaagcgtcggctgttgcgcggaagcttagcggcgccgcaatggtgcggcgcgctaatggttgcggctgagtgcggaaaaaatgcgcgactattttttctcttccagcagctggctgagcgagccgccaccggcgtgtggccagtcgccgacgtagcgcacatcatccaccacccagcagggcgctggccacgtcagcggcggtgggccctgtgccaggctggagaacagatcgccctgccgccacgctgccggtgggttgctctggctgctggcatgcagcagtttctgatacaggttgtcgctcaggtacgggcgatattttgccagcgtggtgctgtccggcaatccctgggcactcagcagcaatgcagcgggaacaagcagcgcaaaggctttgtttctcatctcgatttccttattgttcactggcaaagcgccatttttagcatagagtatagccgtgcttttacgccgtacgagctatcgcctcatgaatcaccacaggagagaacgatgaaattttcgactacgccaaccctggaagggcacagcattactgaatattgcggcgttgtgaccggcgaagcgattctcggtgccaacattttccgcgacttctttgccggcatccgcgatatcgtcggcggccgctccggtgcctatgagaaagagctgcgcaaagcgcggcagatcgcctttgaagagctggaagaacaggcgaaagcgctgggcgccaatgcagtggttggcattgatattgactacgaaaccgtgggcaaagacagcagcatgctgatggtgagcgttaccggtactgcggtgatcgtgcgctaa

SEQ ID NO: 62402 - DNA, 396 bp, Glycine max
  Peptide Sequence Number=SeqID_154087
aaattaaggagtgtagggaagaagaagacaaacgcaagaatttatactggttcggcaacaacccgtgcctacatccagtccccaagcgacccgcggtccttgatatttcttttcaaccttataaaagcttttgcaagcaaagatccacaagggatgtaccctcccttgttctcagttacaacaacccaagtagatgtaccctctacttgtaccataaaggatgtaccctccaatgttttaagacaaagttctcaggcggttagtcctttgaaactttgtgaaagggaaacaaaagatatctcaggtgaacaaggtttagaaaccaaaaaacttagaaagcttttggcaaaagaagaagaagaagaagctcaagaagatgctcaaaaagttatgtaa

SEQ ID NO: 62403 - DNA, 318 bp, Glycine max
  Peptide Sequence Number=SeqID_154088
atgcagagttcaaaacgcaatgtctaccttggagcctacctgaatggcagacactggcagatggtggtcatcgtgcccaaggaacacctagttgtctggttttgttcattgcataacaggccagacaactaccttaaggggataattaacattgctttaaaaggtcttgatgatgctccacagcctaaatcaaaggctcctactaggtggattgtcgtcaagtgtaatagacaaaaaggaagtactgagtgcggctattatgtcatgcactggatgtcgaccaccattttaggaagtttcaagaataactgggaagtg

SEQ ID NO: 62404 - DNA, 279 bp, Glycine max
  Peptide Sequence Number=SeqID_154089
atgatgacaaaggtgatgacaaaaagctcaaagatcaatcaaagaacaactcaaaacaattcaagagttcaagataagaatttagaagaattcaagactcaagaagaaagtttagagtcaagaatcaagattcaaggttcaagatctcaagaatcaagattcaaggttcaagatctcaagaatcaaaatcaagattcaagactcaagattcaagaatcaagagaaggctcaatcaagataagtatgaaaagtttttctcaaaaattgaatagcacatga

SEQ ID NO: 62405 - DNA, 177 bp, Glycine max
  Peptide Sequence Number=SeqID_154090
atgactggagtaatcaaacttctagtcgtcaacaatggtgccctcaaaagtgtagaggatgacaaggaaggtagaattggtgtcggggatgcaccggtggctccgggacgtggtgttctagttgccgcagcggaggtagatgaacccttgcgcttccaggatgattcatccatttga

SEQ ID NO: 62406 - DNA, 413 bp, Glycine max
  Peptide Sequence Number=SeqID_154091
atggggggagaacaggctcaatcgcccaaaaccaacgaacaccctgtggaagaggaatccataatcaacaacgatgccacgaccgtcgaagttccccatgttcctaatgaaggtgcaaaaattgtggaagatgccgggctcaaagcggccaaccaagacgggcttgatgaagcgctcgagagcacacggagtgaaaatgatgcagcctcacaagcatgcaagcgtgcaccggggctaaattgtttcaaaaatgggggtaaacctcaatacagggtgcttgatgatgttccggcgcttgaagacctcgtgacgaatatactggaatatggccaaatctggaaaggcgatggcttattcgatagtggtcttgatggtgagaatggagttatactctcagctcgacactataaaaa

SEQ ID NO: 62407 - DNA, 228 bp, Glycine max
  Peptide Sequence Number=SeqID_154092
atggaggagatacatggagaagaagatgaaggacaaggaattaaaatgaagatgctctcgataccacatgatatagctccatgtggagcttgtagaccttggatcttcttcatcaatggagtctcttacttcttgaagatcaatgacagcagaatagagaaggaagaaagactattagagacgccacttcaaggagaagatgagtcaagaacaagcttaccaccatag

SEQ ID NO: 62408 - DNA, 135 bp, Glycine max
  Peptide Sequence Number=SeqID_154093
gtgaaaaagaggctaagttttgaaacgcaaaaagtagcagttgggctaagcgcatatccaccactaagcgcagcttcagcgcgcttagcgcaaaggagaatctggcagagcatcagcatccaagccgtgtgttaa

SEQ ID NO: 62409 - DNA, 228 bp, Glycine max
  Peptide Sequence Number=SeqID_154094
atgtggctgaaaggggtgaagaccctgtggttctgtttggaaatcgcgatgaacgcactaagcgcgcctgctgcgtttagcatgttcatcacaactgttaaaattttggatttccagatgaacgcgctaagcggaccatgtcgcgctaagcgcgctaagtgcgccctgtgcgctaagcctgagtgtcattctgatgagcctgagctaagcgcgcccatgctgcactaa

SEQ ID NO: 62410 - DNA, 234 bp, Glycine max
  Peptide Sequence Number=SeqID_154095
atggctcaacctccacctcgtgagaggactcttagggagatggctgcacctgatttcacttatgaaagcttgtgcattcaatatcctaatgaggatgtcccatattgtcgcaacctacccttcggcgggagggcgacgcatggctcgcgggtgcgtgttccaagaaaggaatacgcgcagagtcgccaccaacgtttatttgaggaaaacgttggaaaaccagaaaagacgtga

SEQ ID NO: 62411 - DNA, 261 bp, Glycine max
  Peptide Sequence Number=SeqID_154096
atgaccgggctcaggcgctcaaaagtgaggctatcagagacatcccctctggctctacataatgtggtgattagagcaggtaacctaagtctagaagtattagactgggctatagaggtcatctggccaaagatcagcgtccctatgttcatatccaagcgagagactaggccaaagatcaacctagctttatccactgtcaagtcaaaagtgtgtgatgtgggggccaagttggagtataagaggacactccacacctga

SEQ ID NO: 62412 - DNA, 234 bp, Glycine max
  Peptide Sequence Number=SeqID_154097
atggacatgatagtttgtcctaagttttacttcaacgtgcatctttggacatggtggtcattttgtgacaacagagcaagtaggaggtcgaagactcgtgcttgtgcgtctccccaattcttatcgaaattttttttcgatccaactcgaactgatggatcagcgatagtgtttcaaatttttgtggtgatattttccctcacagacggcaccaatgttcagtacggacgataa

SEQ ID NO: 62413 - DNA, 396 bp, Glycine max
  Peptide Sequence Number=SeqID_154098
atggagaggagtatgatagatgctgccagtggtggagctcttggagacatgacccctgctgaagccagaaatttaattgagaagatggcttctaactcccagcaatttagtgctagaaattatgctattgtcattagaggagtgcatgaagtagtcacgaattcatcttcatcagccgagactaagaagcttgaaggtaaactagatgccttggttaacctagtaacccaactggccatgaatcaaaaatctacacctgtcgccagactctgtggtttatgctcctctaccgaccaccacgcggacctttgcccttctgtgcaacaatctgaagcaattgaacagcctgaagcttatgctgcaaacatctacaatagaccttctcaacctcaatag

SEQ ID NO: 62414 - DNA, 550 bp, Glycine max
  Peptide Sequence Number=SeqID_154099
atggctacctcaccaaaagaaacttcagctcctggttcaccctctgcaccatcaaaccaggaacgacttgaattcaatatccagcccatacagatgattcctggtcaagcccctgttcctgaaaaactggttcccaaacgacaacagggtgtgaagatttctgaaaaccctagccttgcaacaagtcctagggaagtagacacagaaatggataagaagatccgcagtattgtaagtaacattctgaaaaatgcctctgttcctgatgctgatgaagatgttccaacatcttccaccccagatgttactgttcctgatgctgagaaagatgttccgacatcttccaccccaaatactgaagtcctctcttcacccagcaaagaggaatcaacagaggaagaggatcaagccacacaggagacccctgcaccacgggcaccagaacctgcgccatgtgacctcattgacctggaagaagtagaatctgatgaggaacccattgccaacaagttggcacctggtattgccgaaagattacaaagccgaaagg

SEQ ID NO: 62415 - DNA, 513 bp, Glycine max
  Peptide Sequence Number=SeqID_154100
atggagaagtctgaaaagaaaaatattaacgaaaagaaattgaagaaggcatacattacatgggatgaaaacgatatggaatcttctgaagattcagaaaatgaagaaataaacctctgccttatggcaaaaagttatgaaagtgatgaagaggaacccttgaggaaaaagtggtacatagatagcggatgctcaaaacatatgatgggagacgaatcaaaattcacacatatctctcccaagaaaagcggacatgtaacttatggtgacaacaacaaaggtagaattcttggagttggaaaaataggtacaaattcttatactggttcggccacttcccctacctacgtccagtcctcaagaaacccacttgagatttttcactatctctataaatcctttacagtctttgaacacaccttgggatccctcacccttgtgttcaataatctcataagccaagagacaaacagtctcttgattacaactgagtttatgagatgtacagattga

SEQ ID NO: 62416 - DNA, 274 bp, Glycine max
  Peptide Sequence Number=SeqID_154101
gatttacacacgattctcctcaaatttcagccagcatcaattagaccttgcaccttacgcttcagagccctacaatgctcaatggaacgccccggggcttctccatgacaagcacacgttgcgttcgagtcgtattctcgaagaaatggaggttgaggaccttggtggggttatggctaccattaaatatcgagtagatatgggagcaaactttgtggttgatttagggatggcctttgtggacgactgggtgatgggtaatgagaagggttga

SEQ ID NO: 62417 - DNA, 670 bp, Glycine max
  Peptide Sequence Number=SeqID_154102
tagagggtacatctacttgggttgttgtactaagaacaagagagggtacatctcttgtggattagttcaagtggagggtacatccacttggtttttcaaagagaacaagggagggtacatcccttgtggatcattggcttgtaaaggattttacaaggttgaaagaaatctcaagaaccgttggttggtgagggcgaggccatctgatattccatctactgctgcagctccagcacctacttctgtagctccttcagttctagctcatgttgactcacagcgcttgaagccatgcttcaaaatatccatcatggacagattctattgctacagagtctacatgtgggaaggtgaaggtcccacagcccaggtaccccaacaggtacaagatgcttcctctgagaccacccttctagagccattcactcttcatcctgaggcaggggaagaacaggcgagaccagagacggctgctactcctgagagatcacttgagggcacattagagcctcatactccagcggcagacctctcctcaccacagcctgcagctgacccttccactcctttacttgacataccaaaggaccagaccacaccagtcctggcacagaacacctctcgtccagctactccagtacttcacttgacagatgaggaggattcttag

SEQ ID NO: 62418 - DNA, 198 bp, Glycine max
  Peptide Sequence Number=SeqID_154103
atgttgagagcttctatgttcaatttcgagcgtcccgatatgatgcaatcctaccccgcaagggcattggatagaaaactccaagtagattgggccagagatgcaagagaaggccctagggttcttatgagccttagggtagggtaccctagaaatataggatttttcagcccttgtattttagggcacctagactag

SEQ ID NO: 62419 - DNA, 237 bp, Glycine max
  Peptide Sequence Number=SeqID_154104
atgggtggtgcttgttgggcatctggttccatggttgctgtcggaggaggtgggttggaggatgaagggatgtcttcagctcttgctctctttcttgaggccatctttatgggagctcagcgaactgggtcgctcagctcagtaactgccgcaaagaaattcgcttggcgcggggatattggcttagtgcgcaactatcagctcaatataaaaattttctacgttacctgggcttag

SEQ ID NO: 62420 - DNA, 309 bp, Glycine max
  Peptide Sequence Number=SeqID_154105
atggcaggagctggtgacaatggtggtgtatatcatcaactggacggatttcagcgcttattactggacgcgatgactacacaaatgcaacgtttgttgaaacgtaacaatgaagagctctacagacgaatagaaggactagagcaccaaatcaatccaaatgctgggagaccttatggtggcaacagaagggtcaatgatggatcgaaccgaatagaggtgcaagacagaattgagggagtaaaactcaatgtatccttttttaaaggcaggagggacccagacacctaccttacctgggaggtgtag

SEQ ID NO: 62421 - DNA, 699 bp, Glycine max
  Peptide Sequence Number=SeqID_154106
atggcaatgttgaaggaaggcctcacaaaagacatggggaaatggctccttgctaaaagggcaaggaaagatgtttctgtagaaggttccagtgcaccactacaggtggatgtggagttcgacggacataggttccgaagtgaggaacaccaacgccgatttgaggcaattaagggctggtcgttcctcaaggagaggaggcaatggactcagcttacagcacccatggctaagtacaatcttgaaataaccatggagttctacgccaacgcctggcccatgaagagggagttagagacaagcactcctaggaggagccaggcctcgaggttcgacaaggaggccatcagccaactactgtgtgttctagggcaggactttgcctggagcgtggcagggagatgggtaggcacaacagcagtaggaggagggctagcagcagccagccacagatgcatcgctgccgcctttacaggagacaccatccctatagtccatctccgctcacctatggaggatagagctctagatgcagacctaaatgaaactttctacaactacactatgcaccggcagagccaggaccctagtcctttcccttggcctaccccaagggcaagacccgcatgggcccctggggacgacgaaggagctcaggaggatgatgatttggcttatgtgctagatttcttcacttga

SEQ ID NO: 62422 - DNA, 159 bp, Glycine max
  Peptide Sequence Number=SeqID_154107
atgcatgagaaagggtttcagaaggccgtcaggcaggccgatttctttgtgaaagaccttgacttaggtctcttcgatcccttcaaggatgtgaaggatggtgtcctgtttgatgaggaggagattgttgcagaaaatgaggctgttgatgaagggtag

SEQ ID NO: 62423 - DNA, 342 bp, Glycine max
  Peptide Sequence Number=SeqID_154108
atggataagagcttgaaggtaggaaaagatgagtggagggagaggaacagaaggagcacaaaattttgtgcctcaaatgagcccatgagcccaaaatctaccctaaggctcctgagaaccctagggccttctactgcatctctggttcaatcttcttggagtcttctatccaatgcccttgagggtcgaattatgatattgggcaccagttacagtgcaaagcaaggaatcactcagtgttttgataaaaacaaaaacaaaaagataccgaggaagggggtaacaggggcactaccgaggaaagggaaacgaaaccgaggcgctatcgaattgcgaccgtga

SEQ ID NO: 62424 - DNA, 255 bp, Glycine max
  Peptide Sequence Number=SeqID_154109
atgcttagcgggatgagtgcttgcttagcgcgtgtatccagctcatccttcttccaaattcttcctcgcgctaagctgcaagagtggtgcactcagccgcaagagtgtgaccaagttggatatccctggtggaggaaatggagtggttttcatgagagaaaatacttgtacttggggacatgtcacttggtttggatctcccttgtgactcaggctaagcaccatggggggaggagagttgcctatgcaagatag

SEQ ID NO: 62425 - DNA, 246 bp, Glycine max
  Peptide Sequence Number=SeqID_154110
atgagtgaaatagaagaggtgcaagaacagatgaaggccaacatggaggccatcaaagagaaaatgaccacgatgacggaagccatgatgagtatgagaaaaatgatggaggtcaacacgactacagtcattgctgcaagtactaccactgaggtcagggaggcgaagcattgggaagtatgggcggcctccattttgtgttggtccagagcaagcattcctttgttggacatgtggcctcaataa

SEQ ID NO: 62426 - DNA, 849 bp, Glycine max
  Peptide Sequence Number=SeqID_154111
atggaggtttttgagggtggagcattcgatttaggagacatgggacctgatgcggaagatggcaacggtgcatcagagttcaagcgtgaaagatgggttgtttggatttggatttggccattgaaagagaaaaggtcgtcggaaatatctttttatgttggcaggagggatccaagagaaggggaagggaagaaagagaatagggaaacaaagaatgaaacgtcatcgccgttaatcacctccaacgatgatcgatggtctgctacgtctgtgataccattatggaagcagttggagtactataaagggtaccaaaagaaactgagtgtgtatcttggagaaagtagggcaaacgagaccgttgccaaagcattgcacataataagtttgggaacaaatgacttcctagagaattattttgcaatccctggcagggcatctcaatatacaccaagagagtatcaaaattttttggctgggatagctgagaatttcatctacaaactttatggtcttggtgctaggaaaatatccttagggggtttacctcccatggggtgcttgccactggagagaaccacaaattttgttggtggtaatgaatgtgtgtccaattacaataacattgcattggagttcaatgataatctcaggtttcaggttacctcaatggcatgttgtgctactggaatgtttgagatgggatacgcatgcagcagggcaagttctttcagttgcatagatgcttccagatatgtattttgggactcattccatccaacggagaaaactaatggtataattgcaaagtacctggtgaagaacgctttagctcaatttttgcattaa

SEQ ID NO: 62427 - DNA, 992 bp, Glycine max
  Peptide Sequence Number=SeqID_154112
ttcctctagacttagaaattgaagccacgttaagaaggaatagagtcgaaaggagaaggaaattgttgcaagacaggacagtagcttctattctagaagaagaagctcaatcctctaactccacatcgtcttattcaccgtcatcaagggaatccactacatatttaccagaagcctctgtcatggctgatgaacatcaacatagggttacccttgaggattattctagtagttcagtgccgcaattctttacaagagaagccaagaagtggctccattcatttaaaggtaacaatttgaagacgtgggaggaagttgttgagaaatttctgaagaaatacttccctgagtcaaagactgcagaagggaaaactcccacacatggattttttgagccaattcaattgaacatgtttatagatgagctgagaccacaaaccaagcagttgttacatgcttcagcaagagggaagataaagttgaaaacccctaaagaggcaactgaattgattgagaatatgtctgctagtgatcatgccattctgcgggatagagttgtaccatttagggtgaggctcatgaatcatgtcattgcattcccattgaagagcacactcaggaagttcattacatgggaaatcaacagagacaaggatacaccaaggaggattttcggggttccatcaaggccacctcaacaagggccaaatatttttcagaggaccaccaaactggaggagacaatagcccagtttatgcaagtggccatgtccaaccataagagtactgaatcagccctgaaaaaccttgaaatccagttagctgagaagtcatccaacaactttggagcaaataccaagaagaatcccaaagaagagtgcaaagctgttatgacaagaagcaagaagcttatgtcggctgaggatgaggatgttgttgctttgaatgagcaagttgttttgaacgacactactgataaaaagaagaatggg

SEQ ID NO: 62428 - DNA, 312 bp, Glycine max
  Peptide Sequence Number=SeqID_154113
atggtgtttacaaatacaccgtctttaataagctccggcctaacctacaaagacagtgttagcacaaaacgtcgttgtagacgtcatgtgtcatgcacatgcccagtaaaaatgtcatatatttacgtaaatgccaccgatcactctactacgacagcaagtagggtcatgaaaggtgttcaacatgaagcctatgattatctccttaagcctataaggatgaaagaactggcagcatatcttaagaaatacgggtacatgaggtcaaagaatttgaagatgttacctcaacaaagaaaagaaaacatgtag

SEQ ID NO: 62429 - DNA, 219 bp, Glycine max
  Peptide Sequence Number=SeqID_154114
atggaggctagatctttgagcttcaatgaggtccttcaatggagaagacgtttgaggaggcgccatccactagagaataagcaatggaaagagaagcttcaccacctagagagtgccttggataagaagcttagagaggaagtttcaatggagaaagagaatgagagagagaggcagagagggacgtggaaattgaaggaggatagggaaggaagttga

SEQ ID NO: 62430 - DNA, 402 bp, Glycine max
  Peptide Sequence Number=SeqID_154115
atgcccaaagctactttggacaaattgcctttcaatgcatcacacctaaggccaggctccatggtggtgcgggattttggcggcagccaccaggacgtgggggggccgaccttggattcattcattgggggtggtcctttcaatgctacaccaaaagctgaagtttgtggtggaacgacagttaatcatagtctcaggaaaataggacattcttgtgagttgtccttcttctacaccatatgtggaagccgcggaggagtccttggagacatccttggaagtgggcatgggtacaagcccgaaatgggtttgggccagaacagcgatggtgtggcaagcttggtagagttcacggagaaccatggaaggtttgggctaggatataagcctacacccatcgat

SEQ ID NO: 62431 - DNA, 111 bp, Glycine max
  Peptide Sequence Number=SeqID_154116
atgaggggtggaggcgagctcaactcgcccaggcgagctggttacttcagcattaagccttctggtgggtcaggcgagctaggggctagcttgggcgagccaggggcctaa

SEQ ID NO: 62432 - DNA, 207 bp, Glycine max
  Peptide Sequence Number=SeqID_154117
atgaaggggaagaggcagcataaatgcgaagaggaagcaggaagggtgaatggcgttttagccctttcacccgagttgctgggtgtcccatcaaaaacattagggaaagtaatcggggcgctgctatgtgcacccagcgaaattgttggtgcacctagcaatttcacaattttcccattttgcccttctatgaggcccacagattag

SEQ ID NO: 62433 - DNA, 1236 bp, Glycine max
  Peptide Sequence Number=SeqID_154118
atggttagaactagaggtttagggtgtgccttaggcaaagttataggaagagtcccggggagagagtataatcgtgattcagatgattcttcccaacggcgaaggccgacagcatccgcacgtaggcaatgggaagctgctgctgttgctgaggatgctcctcacgggaatgacatagctgaagaggtattccaacatgctgaagaagttgttaatgatgccaagggttttgcaggtgggcctcatgacacatcagtgttgactgcctatgttgatcatgaacatcctgaattgaagctatcctcccatggaaggaaggttcagaaattcaggaggcctgttgctgagattgaagggttggtcactgccacaggattaagtcctttggtcgcatgttcattggacactggtgattggggacttatattcgcttttgtcgagaggtggcataaggaaacaagcagtttccatcttccagtaggagaggtcaccatcaccctcgatgatgtggcctctttgcttcatctgcccaccataggagcattccacacctttgacactcttcatgtcaatgaagcagtgttgatgttgtgttggatttatgagcatttttcatctgttgttgaggcttttacggactcagactatgatgaaaggtcaccacgtgcctgccgctggacatctacaaaggcctctacaaaggcattatcagcatcgacgtacagaaatcgtcttgatcgactaatgactgttgatgtttgttggatgtcttatggttaccattgtgcagttcgagagtttgacctcatttcatgcttttctagacatatccgatggggtcccattgtcaccatacaccgaatagagagggtggtgcaacaatttaggtatgttcaaacgattcctccacactatgcaggtccaagactatgcttcaaagacattgacaatagatggatgcatttttctgattacctagcaccggtgggtcaaatttatgttgtacctagacaatgtgcacacgactacatggagtggttctacctaatttcatatccattcattaggccgacacaatccggtgaaccacttagacatccacttgtcatgcaagatgggacatatgtggaaccagatattcctgagatctcggtggcgccaacatctgtggaggaaccacctgtacaaggactttctaatgtggagcagcctagacatgcaatggtaacattttaa

SEQ ID NO: 62434 - DNA, 144 bp, Glycine max
  Peptide Sequence Number=SeqID_154119
atggagtgtcatcatcaaaaaggggaagattgtggaagcaatgccttccaagattattttgatgatgccaaagaattaagagttaagcaagtcccaaagaaccaggagtcaaaaagcttcaagaatcaagtttcaaagatttaa

SEQ ID NO: 62435 - DNA, 177 bp, Glycine max
  Peptide Sequence Number=SeqID_154120
atgcagtatttaggaagtgatcccaggtcgtctcccaacgagcaatgcgagcaaccacatatacttggcaagactctaaaattgaaaaccacaccacaaacacatgcatatgaggatcaaaaggtctttcaaggttgtaatggggccaaggacaaggtagatgaaagtatgggataa

SEQ ID NO: 62436 - DNA, 247 bp, Glycine max
  Peptide Sequence Number=SeqID_154121
ccaccttgatgttaccctaacatcaagtgttggacctgagtgtgtagagttgatctctattgttcagagagcaatctctgggtacgctcttagtgcgcttgcacatgacagttggcctccaaggtggcttcttgcactaagcgggcttcttgggctaagcagtcatgatgcgctaagcgagactatcgcactaagcgtgacattccagttcttcaatccttttccaagcctcatgctatctctataa

SEQ ID NO: 62437 - DNA, 477 bp, Glycine max
  Peptide Sequence Number=SeqID_154122
atgaaacacccatctgaagatctttctgtattttgcgcggaaataattgaccatattgttgatgaatacatgactggtcttcattctaatctgcatgcctgtcactcttcatgcattgaatctgaatttgtacttgatcatatggctgaatttgatgctgacagtgaatctgaaattgatattgattacatatctggtgatgttttacctcttgagattgattttctagagtcagatagaactaaccatgtttcaggaagtacacatacctttgactttctttatgagatacaggttgagaaaccatctctttctaccattatccagccgccaacaccagaattgaagcctctaccatcaaatttaaaatatgcttacatggatggtagcaaaagttttccagtaattatatttgcctcccttgctgatgagaaagaggagaagctgttatcagttctcaagaagcataagaagtga

SEQ ID NO: 62438 - DNA, 336 bp, Glycine max
  Peptide Sequence Number=SeqID_154123
atggctccctattgtcgattcatcatggccgcttgtatggccccagccggagtaggaattagtcctgttggattggaggatgaaaagcattgtttagttacatcgtctcaaaacaagcaatgtgagataaaaatcgtaaggggaaaagcaacgtgtgtaaacagtaacctcatttacgtgaatgcgttatgggtcattgattgtcgtttgtgcaatctctaccacttcttttctggcacaaaggacaaagctctgtcgttgattatcgtcggtgcaatctcggtcactcattttgtggcacagtggacaaagctctgtaggattcttgacaagtaa

SEQ ID NO: 62439 - DNA, 318 bp, Glycine max
  Peptide Sequence Number=SeqID_154124
atgttgtgtgatgaaactaactctcttgttcaagaaaatgctttggaagatgaagatgtaggttttcaggataaggacacaacacttgaatccaaggttaaggatcttgaacaaagtaaagaaatcattgccacacctcctaaagacctcccaaaggaatggagaactcaaagagatctctccgtggacaacatcataggtgaaaaatctaaaggaatatccactcactctagacttggaatattatgtaataacatggcttttgtttctcaaattgaacctagaaacatagatgaaacattacatgatgagaattag

SEQ ID NO: 62440 - DNA, 249 bp, Glycine max
  Peptide Sequence Number=SeqID_154125
atggggacagggatggtgccttacgatggtgaaataatcaaaacaaatgaaggagatacttttcaaagccctaaccctttgttctttgaaacaaagcgaggcctcacacttgaggcctttgaaaacaaaaatcctccaacgcctctatcttcaaccattggaccaagtatgcaatattttattctgatacccacaagcagtgagccgtggaatgttgaaaggtatgattttagttattcgtcaaactga

SEQ ID NO: 62441 - DNA, 1395 bp, Glycine max
  Peptide Sequence Number=SeqID_154126
atgtatattttggttgacaacagaccatggttgagtgaccttggttcacggggagtacacatttggcaattgatggttactaagtcaaggctttctccatttgcatattccaaatctcgaagagagaggaaggaaggcaaggaggtttgtcctcaatcaagctctagcaaaccaaagaaatttatgagatggttctcgttgattgaagcagtgatgttatcaagaaagaaagttttgttgcctgtgaaaaacctaaggaattctttacaattgagcagtgaattgcatagaactctgtatggctttattgtatttgaagttgcatggaccagtgttcgtggtattaactactataatgagcttcagactgatacatcactggctatagaagctaaactgatgaaaagatgggaatttgacagtatagctcaagctgcagactgtatgtcttcatggttctcaggaacaccttctgaaaagttgcttctgaaagaacacctggattccgcctcaggggacacattttatgatgctagtgaagatttttctggcactgtatccgttgatgatggtgatgataatgtctgcagaattctgactgttgaagatagtttgggtaccaaagttggagtatattctgatgatacagaagaaacaacagacatgctacacacacctcctccttctggacctaacaagagaagaaaattaatgaatttctttagtgctggagttgaagttggtagctactcggcagctgaaattgataactcattggattattctcagacctttagctgtgtttctgatgatacagttgaaaccactcaagatgatacagttgaagcaacacaatatagtgatgttctactgtcatttaggtttaatgatcatgacctcccatttaaattcagggaagtcatagtatctgatctgcgattgcttactttgttggaggctggtcttccatcttgggtcatcttccttcagtcatatccagtgttatgcaatctttatcgtccttggatgtgcccacttgcaagacttttatattttttgatctcatttgttactgtcctcattggattctatgatttatacaaaaatgttcctgttctcaaggcaactgcatctcgtatatgtgggcctcttcttgattggattgaaacttgggagatggtttcaagggtcaaatacttaggcacaatgctgtttctacataacttccagaaggctgttagtttgcagcatcttctgaagcaacagtcagtgcttctgaagtttctatgtggcgaactctttggaatgaccttttttcccagattttccgtgctctcaagagcatactctatgggtttgttgccttcttcacagcctgcaataggcatcgactaa

SEQ ID NO: 62442 - DNA, 423 bp, Glycine max
  Peptide Sequence Number=SeqID_154127
atgcctttctcctatttggggcttccaattggagccaatccaaggcgaagtgagacgtgggacccgattggttccaaatatggtggtgacaaaattggaggaattacaatgaaggtttttgtggggagggagagggcaattggaagagaggaagataccttgcgtcaattgggagatgatttgcttaccaaaggagaaggggatttaagtgctatttgtggagctggtgaggatggaaggtggtttaaagaggggattaagtggaaaattggtagcggattgagggtgaggttttgggaagatggctggttggagggtggagtgtcgtttagagataaatatactagattatattgtatgtcaatgcaacagcagcagtatattcagtatatgggggccttaattgatgggaaatgggaatga

SEQ ID NO: 62443 - DNA, 219 bp, Glycine max
  Peptide Sequence Number=SeqID_154128
atggtgtccttaccctctgatttaggaagaccttcaaaaaaatcttatgaaatgtcactccaaacttgtgagggtatcagtaatggctgcaataaacctgcgggggtaatgattcatacttatttcgttggcaggagttcgtccaaagattatatggtacgtgccaaagatcaaggcaagacgactctagagacaatggaaaaacttgcttgccgctga

SEQ ID NO: 62444 - DNA, 897 bp, Glycine max
  Peptide Sequence Number=SeqID_154129
atggagagattgttggtgaggaggggcttggagggcctgccaacacggttggggttgttgttgaaaatgtgccacttgagggtgatgctaggtgcacccagcattattgctggtgcacccacttcttcacgtccgcattggttgcttcctcggaggtctgtttgccgcgcattgggtggttcgttgtcggcattgagaagacctgcagcactattgtgctattacactattgaggtaaggttctactctccgttaatggctgcttcattcgattttcgtctggtgtgcattgtggacactggcgatcagggacttatatccacttttgtggagaggtggcataaggaaacgagcagtttccatcttcctgttggagaggtgaccatcaccctggatgatgtggcctctctgcttcatctccttattataagcgcattccacagcttcgagactcttcatgttgacgaagcggtcttgatgttggtggagttacttgaagtctccggagaagaagctagagctgagacagtacaatgtcatgggacacacgcttcttcaaagtcattaccagcatcgacgtatcgaaaacgtttagatggaccgacgattgctgatgtttgctggatgccttacggtgaccaccgtgtagtgcgggattttgatctgatttcatgcttttcaggtcatatacaatggggtcccattgtcgtcagacaccgaccagagagggtggtgcggcaatttggatatgttaagaccattcctccacagactacgggttcaatgttatcatttgaagatattgacgataggttgatgcatttttctaactatcttacagcagtgggacaaatttgtgttgtgtcaggacaatgtgcatctaattacatccactag

SEQ ID NO: 62445 - DNA, 294 bp, Glycine max
  Peptide Sequence Number=SeqID_154130
atggagaatggggtctcgcttaaggagaagtatccaagactataccagatttctcaacagcaacatcaacacatccagcaaatggggacaatagcaaatataggttgggaatggaagcttcagtggaggaggttcctcttggaggctgaaatagacactgttgcaaaatttatggaagacttacagcgtctgacggataggcccccgaggttcctatccatgatagggattcccaccatagatgttgtgttttactgcagtcaaagaagagatgagatgcagtctcctccttaa

SEQ ID NO: 62446 - DNA, 168 bp, Glycine max
  Peptide Sequence Number=SeqID_154131
atggatatctgcaagagaaactggtgtgtgggagcacatgagggcccggttgacgtcaccggtgcagcattggacagatcgatgttctctattgctggtgccggcagtccaacctcaaatggaggtggtcgtcaggacaaccagggtggcatcagttacttccgttga

SEQ ID NO: 62447 - DNA, 693 bp, Glycine max
  Peptide Sequence Number=SeqID_154132
atgaattcccttaattttgtttcagcggcgatcgtgtctgttcattattccgagcccagtcccaaactcgtttccatctccagagccagagacaaaccttatactctcgtgatccgttcctctggccacctttctaataagctaaaagtttcagccctcaaaagcaacgaaacaaagccaaagcagttctcactgtgtcaaaacggatggctccccgctttcccccacgttcttgttgcttcaatgtctaattttatatttgggtatcacattggagtcatgaatggtcctattgtttccattgctcgggagcttggttttgagggaaactcattcattgagggactcgtggtcagtatatttatcgctggtgcatttattgggagcataagctccgcttcattgctagatagacttggttctcgcctcacatttcagattaatagcatacccttaatccttggggcaataataagtgcacaagctcactccttgaatgagataattgggggaagatttcttgttggccttggtataggtgtaaatactgttcttgttccaatatatatatccgaggtagctccaacaaaatataggggcgccctaggttccttatgtcaaattggcacttgccttggcattattacttcactatttcttggaataccttctgagaatgatccacattggtga

SEQ ID NO: 62448 - DNA, 273 bp, Glycine max
  Peptide Sequence Number=SeqID_154133
atgaggtggaaaacaccatcatgtgggtcgtattatgttaattctgatgcctcaatcaaaaggaatgtaggcacagggttggggttgattacacgagataataaaggcaaagtcatggtggctgcaacttactttatagatgctaagatggaagttagggaggtagaagtctatgcattcaggtgggaaatcattaaagcatatctggccaaatcaatagcttcaaaacattaccttctgttagaacaaagcaaacaatgggtgaaagtttga

SEQ ID NO: 62449 - DNA, 408 bp, Glycine max
  Peptide Sequence Number=SeqID_154134
atgttgatgctgagaatgacaatgagacgagacaatgttgatgttgatgataacattgaggaggaatacttgtacttggggcatgtccctcgatttggaactcccttgagactcaggctgatcaccgtagggggggagttgcctgtgcatgacaaggctatttccttgatgaatggtaccacattgcatttgagagttgagtctactggtgtacccctcgaatctccccaacaattggtatcagagccgatggttcaaattggtgaccgactcagacgagtatgcaagtaccacaggtggccagaatggctagcggcacagcgtgcccccgcaggtggagcggggtggccagaatggctagcgggtagggcaagtaccgcaagtggccatgactatactcatggatga

SEQ ID NO: 62450 - DNA, 2052 bp, Glycine max
  Peptide Sequence Number=SeqID_154135
atgtcgacggaaactgctttatgtgccgctctgtggtgtgggggtcagtctgccatgaagtttccaggcttgaaggtttcgtttccaacagggagcagtcttatgaagatcccattgaagacaaccctacaggctgacttgtcacaactgcaggctgctgcatcttttgtatgtcgattgggatgggcgacaaaagtaattgatccagcctctattcttcaagatacaaacatacctggttctccaaaaagtgcagtcaatgatgaagatgcttctattgctagtcatggttttgataatatgcttattgataatgacaacaatcaaagcgatgcctatggtcctcattcttgccatactcgtgttgctttcatagttgatgctaatataacatcatatcttatgatgggttctgtttcaccaggcctgaaatctcatgctgttacactctatgaagcgggtaaattgggtcatgccagtattactgatctttgcaaggatcttagcactctggaaggtgccaaatttgagggagaactgcaggaatttgctaatcatgcatttagcttgcgttgtgtattagaatgtctacaatcaggtggagttgcttctgatgcaaaagtgggtgaagataagatggatttggctactgtaagcaatgatgagtttagttctctaatatccgaaatctctctgactgaaaaatcaggagaatctggtattacagaagctgggatgaatagctatgatatattaagttcagatttagagaagtcagtagaggctcctgcttccactgaatctgctcctagtaatatggttggtggaacccgttctattcctttggaaggtgatgatagtcatgtacaggaagccaatgaagatgggaatctccagaatgatgagaaactaatggttgaagagtcggatgttggaactgaaatgttaaaaagaaaaaagaaatatcgtgtaaacattctccgctgtgaaagcttagcttctcttgcaccagcaactgttgatcgattgtttgttcgtgattatgatgtagttgtgtccattgtgcctcttcctcattcatcagttcttcctggatccacaggtctggttcattttggtcccccctcctattcttttatgactccttggatgaaattggtattatattcaactgtagctagtgggcctctatcagttgttctgatgaaaggacagtgtctgcgcttgcttcctgctccattggctggttgtgagaaagctctcatatggtcctgggatggttccgcagtaggagggttgggagggaagcatgaaggaaatttagtaaagggaagtatactcctgcattgtttaaattcacttcttaagcattcagctgtgctggtgcagcccctaagtaggtttgaccttgatgaatctggaaaggtgattacaatggatatccctttgcccttaaagaattctgatggatcaaatacctatgttggaaaagacttaggattatgtgaaggggaaagttcaaaactgaattctctcctgactgatttggcaaacaagatggaactgtggacggttgggtatattcgcctactgaaattatataatggacgagaatcaaaccagttctcacctgaagaagagaagtatgaatgggttccgttgagtgttgaatttgggatgccactattcagtccaaagttgtgtaatgatatatgtcaaagggttgtttcatctgaattacttcaatctggctcatttgaaaaacaccatcatgcaatgcaaagtttaaggaaaaacttgcgtgacatttgtgctgagtaccaagcaacaggtcctgctgcaaagattctttaccagaaggagaaagctaaggaatcctctcgacaacttatgagttatgcaagtggaaggtggaatccgctcatggatccttcttctccaatttcaggggcctcaagtgaacatcaaaggttaaaacttgccaatcgaaaacactgccgaactgaagttttaagctttgatggcagcattcttaggtttgttaacttctaa

SEQ ID NO: 62451 - DNA, 639 bp, Glycine max
  Peptide Sequence Number=SeqID_154136
atggccttatgcgagagtgtcaacacatattgctctgggaagccagagcaaatgcatcacctatgggacagagtcataaaggatgtgccatggttcttgagttccttcttagccttggtggcgatagaggcagcatggggtagaagctcattgaaatcatggagagagctgcatgaacttgcccaaggtaggcagtcatgggcatgccaaattgctaaggagctaggagggtcatcaagtctctacgcacaccgtataaccgttgagcatcaattgtgtagagagcacgtgcctcactccaaacagattcataggttcgaaaacattggagtgtttgccttagttggggtggggtaccatcagaagccatgggaggcgagatcacagttggaagcgcggccggaaagggtcagacttgggccgtcacctgttggggataggtgttgtttggcgcatcaaggagcaatgcctaagaactccgatggagacgtgagtggtagatctgagaagatcgatgaaagactagtcaaacgcagggatcaccgggcgcttaaggaggtcgaattggatgcaagtggttcactagaagaagaaaattatcatagggacagggggtccactggacaacacggttattga

SEQ ID NO: 62452 - DNA, 165 bp, Glycine max
  Peptide Sequence Number=SeqID_154137
atgacacttagagcggaatggagaaggaagagagagaggagatgccacttcaaggagaagataagtctagaagaagctcaccacaataagaggccatggataagagcttggtggaagaatgagatgaatgaagggagaggaagagaagagcacgaaattttgtga

SEQ ID NO: 62453 - DNA, 888 bp, Glycine max
  Peptide Sequence Number=SeqID_154138
atgctacatctaatacgtagtgacattgaaagcttgccaacatgcatcaataatcttacaagactgcgatatcttgacttgagttgttgcagcaatctctgcattctaccgaagcttcccccatcccttgaaactctacatgctgatgagtgtgaatcactggagactgtattgttcccttccacggcagttgaacaatttgaggaaaacaggaaacgagttgagttttggaattacttaaagttggatgaattttctctgatggctattgagttaaatgcgcaaatcaatgtaatgaaatttgcataccaacatttatcagcaccaatacttgatcatgtggaaaattacaatgattacaaggatctccatgattcttatcaagcagtgtacatgtatccaggaagcaatgttccagagtggttggcatataagactagaaaggattatgtaattattgatctctcttctgctccacctgctcatttgggtttcattttctgcttcattctggacaaggacacggaggagtttttggatcctgcattgcaatttagcatctctatcagtaatggtgagaatgaatgtaaaagggacagtgttgaaatacaaacttctgggccatattctatgatttattcggaccatgtttgtgtgttgtatgacaaacgatgttcttgctacctgaacaacagacttaaaagtctggcaaagtttaaaatcaaagtatcatggcttacagatggtgaacggtgggaggtgttaaaagggtttggggtcagcccaataaacacctcagtatatcacaattttgttcaacaaatggaactgtgcgaccaaggttttaggccggtgttgaagcgaactccaaagaaaaggaaaaggtga

SEQ ID NO: 62454 - DNA, 300 bp, Glycine max
  Peptide Sequence Number=SeqID_154139
atggtagccataacccctgctaggtttcctcaatttccatttttccgaggatacgactcgaatgtaacatgtgcatatcatggaggagttccaggacattccattaagcactgtatgacctcgaagagtaaggtgcaaagtctaattgatgcgggctggctgaaatttgaggagaatctcttaatgtgggtgcaagccattggtttgtttgctcaagcgacctgtgctcctgagtttggactttccaagaccattcaatcagaaattactcatgctacatatttggtgaggatgccgtaa

SEQ ID NO: 62455 - DNA, 299 bp, Glycine max
  Peptide Sequence Number=SeqID_154140
atggcggtggttaatgccgttgagtccgataggccgcgtaggtctaaacctttaagggatgtggcaaccctaggaggtttatctttgaggccctacaaaagggaggaattgttacagcggatgatagatcaaggtcgactggaagttgacagtgaaggaagagaggagcagcacatatgcatgcagtccacggatgggagcgttgttgtaaagcccaaacccttggtgatatacttcaccaagggcaaagcttcgcaaaagcccggacaccctttggcagctaaacctgtccctttccc

SEQ ID NO: 62456 - DNA, 174 bp, Glycine max
  Peptide Sequence Number=SeqID_154141
gcacatatctctcaaaccatgggggagacacatgaaattccccaccacaatctagctgacttcgagccttggctcagatatgccactgaagggcaagcagttggtggtataccctttgaaaacactttggagggccctcagtttctgttagacaagtggcctcagatatcttaa

SEQ ID NO: 62457 - DNA, 249 bp, Glycine max
  Peptide Sequence Number=SeqID_154142
atggataaatttgatatctttgtccctcatcctctcacaaacgcatctttgcttattcaactttcaccagaatatgggtgcaagccattggcctgttttgctcaagcgacctgtgctcctgagtttggacttccaagaccgttcaatcagagattactcgtcttgcacgttggtggggagagaagtgagttatcaagaataggatgttggacaaatggcctcagttaccttaagaaaaaggggggttga

SEQ ID NO: 62458 - DNA, 48 bp, Glycine max
  Peptide Sequence Number=SeqID_154143
atgccggaaatcaaaaggaagcaggcttacgcgatcccggaaattccg

SEQ ID NO: 62459 - DNA, 339 bp, Glycine max
  Peptide Sequence Number=SeqID_154144
atgaccggccctctcgatgagtcgatctcttgctttctcataagggtggacccttgggtacttgtacctatcaccttgagaggactacacgtcctcgccatcagagggctgcatgccctcaccttcagaggactacacgtcctcgccttgagagggctacacgccctcaccttggggctacacgccctcacctctagaggactacatgtcctcaccatcagaggacttcatgtcctcgccatcagagggctgcacgccctcacctccagaggactacctgtcctcgccttgagagggctacacgccctcaccttgggtactagttaccctcaccgttga

SEQ ID NO: 62460 - DNA, 147 bp, Glycine max
  Peptide Sequence Number=SeqID_154145
atgagtgttgagatcaaaagagaatccatagataagagcttcaaggtcaatggacaccggctgaaaccatttctctcaaatccttccttggtggatgtagtggtggaggagacctccttacttcaccctacttctattccgccatga

SEQ ID NO: 62461 - DNA, 642 bp, Glycine max
  Peptide Sequence Number=SeqID_154146
atgggacctctccaaaggcaagccttccgcaaagtgtacgggaagattctagatttggccgcaacggaggtatttacggaagttgtcgtatccctcgcccaatactatgaccagccgttgaggtgtttcacgtttggggacttccaaatggtaccaactattgaagagtttgaggagatattaggatgccctcttggggggagaaaaccgtatcttttctccggctttcttccttccttgagcaagattgcagttgtgattggagattcagcaaaagagttggatcacatgaaacaaactcgcaatggaatagtgggcctgccacggaaatacttggaaggcaaggcaagggatattgcgagccaagagaagtggggcccgtttgcggatattttagctttgctgatttttggggttgtcctctttccgaacgttgacggtttggtagacttagccgccattgatgctttcctcgcatatcaccatagcaaggaaagtccagtggtggctatcttggcagatttgtttaacacctttgaccggagctattccgacaagacacgagacacccgtgtccgcttcaaagctatccctcatgcgtcaaaaaaggagtcgattgggaccaacatttggctgggatag

SEQ ID NO: 62462 - DNA, 381 bp, Glycine max
  Peptide Sequence Number=SeqID_154147
atgcggctttcaagagccaatgaaccgccaagcagccttccgatcaaatttccaatcatcatcatgtgtaccttcaaatggtacaccttcgctagacaattgggtcaaatcatagaagagggattggtcaatgaccatcattatcccatagacttcagaaatcaaggtactttcttgaatttcaagaacgagaggagaagaggtttgtgtgccgtgtacgttgttcttccgatgagaacaatgaggaggaggaaatggaggaaggaattggagtatcctgagcctcagagtgtcgttggcttctactcgaagaacccttgcgcttctttgatggttccgccatttgagagacttattcgaaattttaatcagttgaaatga

SEQ ID NO: 62463 - DNA, 237 bp, Glycine max
  Peptide Sequence Number=SeqID_154148
atggcacaacctccaccccgtgagaggactctaagggaaatggatgcacctgatttcacctacgaaagcctgtgcatccaataccctgatgaggatgtcccatatgttcttaaaactggactaatccatttgcttccaaagtttcatggccttgcaggcctttcctcattctctagagtgagtggcaaaggactagctctattacctagctccatggtccatcacgagctgggatga

SEQ ID NO: 62464 - DNA, 264 bp, Glycine max
  Peptide Sequence Number=SeqID_154149
atgaaaaggggcgagtttttgtgggtcccttaccccaaagaagtccaagcattgttgagtcatttatgttttgttgggtctgcaatttggagatgtgtagtgccgatgatttgtttcaatgttgttgaatggcatcagccagatagagtcatgaggcaatttggactgcaacaacctatacctggccctccattgcaacctagcaatatacatggcctaacactaaaaggaaaaagtggacataattggaggcgactactgtag

SEQ ID NO: 62465 - DNA, 651 bp, Glycine max
  Peptide Sequence Number=SeqID_154150
atggcctcagaatcagacgatgattctaaaatggatctgcaaaaacaaattcaaaaagccaaacagaccaaaaccatctgtaaccaaaaacaaagccaaccgttgactcaacaagactcaacatcacaacccaacaacagctacatttcaaaaaacaaattcttcaatgtcttacaaatggaaccaaaatactgggataagaatcctttcaaggccaccgccaaaaaattttctgcaccttttgaccctgcaggatataattattgggattacattgacgcctggaccaatgtattctggcatcaaaatagtaaattcaagcattcatggctgatttacttcaaaaataacaccgtgtacaattttccaaattggttcctccaatggtggaactacttcggaccaataccacagatatttccagaagaagtccaacagggattccaacagttcaacaaactcttcaatagcaaagaatcaagaattccagcagatttgaagtacttttccagctttgctttgtcatggattttttcatggcaatacaaatatggaaaaactgaaaattgcaagcagtatccgccattacaaagacatgcctttgtaaaatggtggtcacaattcgatacctcaaaggctgctccagatcag

SEQ ID NO: 62466 - DNA, 127 bp, Glycine max
  Peptide Sequence Number=SeqID_154151
ggatcttggaatgcccgctaagagtaaggaaaccgtatctgttttccaaattctacccctccgtggaaagagtagcaaaaatggtcaagatctcgacataagagttagaccgagtgaagcaaaatag

SEQ ID NO: 62467 - DNA, 885 bp, Glycine max
  Peptide Sequence Number=SeqID_154152
atgcgtgatgcgcgaaattcatccacgcatggcgtggatctactgtggtcagtccggttcgcgttgcacctgccgccacagctcgctggccagtgcgcgcacggcatcgtcggcatcggcacggtgcagcaggccgatttcgtagttgtcgatcaccggcagctcacgctcgccatcgatgatgcggtgctcgcggctgaccgcgcggcgcggcagcaggctgatgccgatgccatcggccacggcgccctggatgccactgagcgacgaactggtgaaggcgatgcgccagcgcaggcccagcgcttccacggcgtggatcatctcgtcgcggtacagccctcgcggcgggaaggtgaccagcggcagcgggtcctgctgcaggcagctgctgcgcaggctgtcgatccagtgcatcggctcgcgccggcaatgcaccgcctggcggctgttgcggcgctgcttgaccagcaccaggtccagctcgccgtggtcgaagccctgcgccaggtcacggctgaggccgctgctgatctccagcttcacctgcggatggcggcggctgaaagcggccagcatgcgcgtggtctgcgggttgacgaaatcctcgggcacgccgatgcggacggcggtctccaccgtcgcaccggccagtgcctgggccatttcctcgttcaggtcgagcatgcgccgcgcgtagccgagcagggtgtggccggcgtcggtggggtgcacatcgcggtggccgcgttcgagcaggcgatgcccggccagttcctccagccggcgtaccttctggctgaccgtggattgtgtcgaatgcaggcgcgtggccgccgtggtgaagctgccgcagtcggccaccatcaccagcgcccgcagcag

SEQ ID NO: 62468 - DNA, 216 bp, Glycine max
  Peptide Sequence Number=SeqID_154153
atggtcttggaagtcaacactcaggagcgcaggttgcttgagcaaacagaccaatggcttacactcacattccggtggaagttgaataagcaaagatgtgttcgattcaacaagcgattctcctcaaatttcagccagcccgtatcaattagacttcacactttatgcttcggggtcatacaatgctcaatggaatgccccggggctcctccatga

SEQ ID NO: 62469 - DNA, 342 bp, Glycine max
  Peptide Sequence Number=SeqID_154154
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggattagattcgatggtaatcgattaccggcagttgaaaatgtttatcacagtcactag

SEQ ID NO: 62470 - DNA, 684 bp, Glycine max
  Peptide Sequence Number=SeqID_154155
gagaatttcgaagctccggaggaagatgaagaagtccgagctctaaagttagagttagggaaggcaagactcgccaaggagaagttcaagtcagctgctacacacatccggaaggagtgcaccgagttacaagaggaaaacgcggccactgcaaaagcccttgaacaagaaaccaaaagggcccgcaaggaggaatatggccgagagaaattccgaggagcattgtggggtagtaacaataagctcaagctccgaagagaggagagagatcggtcacgggtgcatggcatgatattaaaagaagagttagttgcttgcacgaggtccaaaaggagtttggctcaacacttggaagccacggagcaaagcatgctagctatcatggggcaatacaatgaagaattgaaccagtccatggcccatgaacaaaagctagtggtggattttgcacaagtgtatgccgaaaaagaagcaagagggagggtgatggatgcgttgcatcaagaagcgactatgtggatggataggttcgccttgaccttaaatgaaagtcaagacctcccgcgtctgttagccaaagcaaaagccatggccgaagtgtgtactgcccccgaggagatccatgggctaatcaattactgtcagcacatgatagatttgatggcccatattattcttggctag

SEQ ID NO: 62471 - DNA, 381 bp, Glycine max
  Peptide Sequence Number=SeqID_154156
atgctggtggacttattgatggtctctgcagagtctgctagggctgagacagcccagtgtcgtggaccgtacgtacgcctgcaatgggtatgtgatatatatgagcgccgatgccaagcaggtcattggacagttgcggttcgcgcatatcttcttcatcttgtgggttgcactttgtttgctaacaatagtgcaaccaatgtgcatgttgtctacttagaggcccttcgtgacctcagtatgacggagaggtacgcttggggagtggctgctctggtgcatatgtacaaccagttgaacaatgcatctatcagccacagccgacagcttggcgtgctggatttacaagcacttgctgtcagtcgcggactccactgctga

SEQ ID NO: 62472 - DNA, 79 bp, Glycine max
  Peptide Sequence Number=SeqID_154157
atggccactcctatgagtactgtctgctatctggataaagatgaaatcggtcagtcaatagacataaagaaatatagag

SEQ ID NO: 62473 - DNA, 345 bp, Glycine max
  Peptide Sequence Number=SeqID_154158
atgtaccctctcttgctctcagttacaacaacccaagtagatgtaccctctacttgtaccacaaaggatgtaccctccaatgtgttaagacaaagttctcaggcggttagtcctttgaaactttgtgaatggggaaacaattcgaattctcaggcgggagaagggagacacaaaagaattcaagtggttagtctttcgttcttatggaaaagggagaagagagacacaaaaagaattcaggtggttagtctttcgttcttttggaaaagggagaagagagacacaaaaagaattcaggcggttagtccttggcgaattctttttggcaaagagagaagggaatga

SEQ ID NO: 62474 - DNA, 420 bp, Glycine max
  Peptide Sequence Number=SeqID_154159
atgtaccctcccttgttctctttgaacaacctagtggatgtaccctccactagaactgatccacaagagatgtaccctctcttgttctcagtcacaacaacccaagtagatgtaccctctacttgtaccacaaaggatgtaccctccaatgtgttaagacaaagttctcaggtggttagtccttcaaaactttgtaaagggggaaacaaaagaattctcaggcgggagaagggagacacaaaagaattcaggcggttagtcctttgttcttttggaaaagagagaagagggacacaaaaagaattcaggcggttagtccttggcgaattctttttggcaaagggagaagagaataaaaagatgaatagcacaagttttcaaggtttagaaaaccagaaaacttcaggtgggatcctctag

SEQ ID NO: 62475 - DNA, 90 bp, Glycine max
  Peptide Sequence Number=SeqID_154160
atgccaaaagatagggggaggattgtcatcatcaaaaagggggagattgtagaaggtctttggtgttttgatgatgatcaaaaagcttag

SEQ ID NO: 62476 - DNA, 375 bp, Glycine max
  Peptide Sequence Number=SeqID_154161
atggctggaagtctatcaaaaatcattccggatatgtcgaaaatagaacctctagatggctcaaattataggagatggtctcaaaaactgttgattttgtttgaagccttagaggttgattatgtgctatttgaagatcctcccgctgatgtcaacgcttctgaatcatctactcctgaaactcctgctacccctgtcgtcacaccgcttcctgcggaaacacaagaagagggacttttaatgctaatgttgttgagtttgctgatcaacacaggtcataaagcttatgagtgcaacctgaggaagggacaacaatctaacaactcgaaacctgctgcaccacatgctcctcaagcacatctagcagaaaaatag

SEQ ID NO: 62477 - DNA, 324 bp, Glycine max
  Peptide Sequence Number=SeqID_154162
atgaatactttagggtttcaaattgtaaaagtgctaaggatatgtgggatacactacaaaacttgtaaaaagaatttacaagatagtggaactctcaagcgggttgcttggggattggacgtaggcacaagggtgtggccgaaccaacctggacatctgagggttgattgtcccatcttcaagaaaacgcatggagaagtctttatagaaaagaaaaatatttgggaagccatagaaattgaaggtgggacctctatagtcgacctgcaggcacaagccggaagtgaaacaatagaaaaacctagagcagattggactgagtaa

SEQ ID NO: 62478 - DNA, 297 bp, Glycine max
  Peptide Sequence Number=SeqID_154163
atgaaagggtgcctcacaacatacttgaggactccttatatagccaaaaatctaagaccggtagttgccggtagttttgaccgggactatttgactgtttgttacaagacaagtagttttgaccgggactttaatggctacaggacagggtcttcttcttcttcttcagcagaacttgtttcttccttatttcaggatgaaccttcttcttcctgctgtaacatttgcaaaacttcctttagatttttagctaagacctcctttgatttcaatcctgctaaagatggtgccagatga

SEQ ID NO: 62479 - DNA, 2029 bp, Glycine max
  Peptide Sequence Number=SeqID_154164
tgctgctggcgctgctcggcgggctgattctcaacctgatgccctgcgtgctgccggtgctggcaatcaaactgagcagcctggtgcagcagcagggacagacacaacgccagacgcgtcagcagtttctcgcgtccagcgccggcattctgttctctttcctgctgctggcgctgctgatgaccgtgctacggctcagcggtcaggcgctgggctggggcattcagtttcagagcagcggctttctgctggtgatggtgctggtgatgttcctgttcagcgccagtctgttcgatctgctgcattttcgcctgccttccggcctgaccacccggctggcgacgcacggcggtgccggtctggcagggcattttggccagggggcctttgccacgctgctggcgacaccgtgcagcgcaccgtttcttggcaccgccgtcgcctatgcgctgaccgcaccgctgccgcagctgtggctgctgtttgtcgcgctcggcgtcggcatgagtctgccgtggctgctggttgcggcgctgccgggtatggcgcgctgcctgccgcgtccggggcgctggatgctgcatctgcgcacgctgctggggctgctgatgctgctggcaacgctgtggctggtgacgctgctgattccacactggggcagcaccgtcgccattctgctggcggccatcctgctgctggcgctgacgggctggctaatcacacgccgcgcgcttccgcaggcaggtctggtgtttattaccgtgacgctggcgggcgcgctgataagcgcgtctttgtcgatgtcaccgctgactggtgcatcacctgcaaagtgaataaatcacgggtgctgaatcagcctgacgtgcgtgccgccctcggcgcagaggatgtggtgctgctgcgcggtgactggactcaaccggatccggccatcggcgagttcctgcgccgccgcgatcgcgtagcaatcccctttaaccagatttacggcccggcactgccgcacggccagattttatcgccgttattaagtccacccgccctggccgccgcgccatttacccctgagcaggaggcgcgcattaaacagctgattcgcgaaaccctggtgcaaaatccggcgattctggcagaagccgccgacgcatttgataaagaagccgcgcgccagcagcaaaacgtggtcgcgcagatggtagagaaaaaccgcgcggcgctgtttgacgatgccggctcaccgcgcatcggtgccaaaaaaccggcactgacgctggtctatttcaccgactacaactgcgtcttttgcaaaaagtttgaggcggatatcgaaaaactgctgcacaactatccgcaggtggcggtggtgctgaagccgctgccgtaccgcgctgaaagctcgctcagttcggcgcgtctggcgctgacggtgtgggagcagcagccgaataactttcttaagctgcatgaacggctgatggcaaagaaaggcaaccatgatgaagccagcatcgccgccgcgctggacaaaagtggcatcagcctgtcagcgccgagcaccgccagcctcgacaccatcaacctcaacctgacgctggcgcagcagctgggtgtgcagggtacgcccgccacgctggtgcgctgcaggctcagccatgagccgggtaacgcgctggctgcgcgaaggcgtgctgttgttgctgatggcagcggcgctgctgctggccatggactggctgcgtgcaccgcagctgcccgcggatgtagcccggcagccgctcagcgcgctgcagggcgaggtgaacctggcgacgctgagccagcagcggccggtgctggtttacgtctgggccagctggtgtggcgtgtgcaaactcaccacaccgacggtggccgcgctcagtcagcacggcacgcaggtgcgctggcaaatcagcgccacgccgacgttcatcgtgctgcatcagggcaaggtggtcagcaccagcagcggctggaccagcagctgggggctgaagctgcgcatgtg

SEQ ID NO: 62480 - DNA, 2814 bp, Glycine max
  Peptide Sequence Number=SeqID_154165
atggcgctgctggccgcgctgccggccagacgcaaaattctgattcacattaacaacaccaatccgatcctcaacgagcattcgccgcagcgccagttcctgacgcagcagggcattgaagcgctgcgtgccaaaggcgcgtattaccatattcatcatccttaccatatcgcgatgcacaacggtgccgcgacgcgcgagcagattcagggctgggtggcgaaccgtttttactatcagaccaatattccgctgaaagatgcggcgatcatggccaactgtccggatccggcaacgcgccgtaaatgggtacagcgtatcctcgatcacgacggtcgtaacggtgaggaaggcggcattgaagcctggctgcagctgggagaagcggttggtctcgatcgcaaagtcttgctgtcagagaagctgttcactcaccgagctgtttgccccgcagattcatcagtcgcgcctcgacagctggccacagcactatccgtggatcaaagaggaaggctatttctacttccgcagccgcctgagccaggcgaaccgcgatgtggaacacggcctgcgctggcgctggaagtctttaccagcgctgagcagcagaaccgtatgctggagatcctgcagtttaaactcgacattctctggaccatgctggatgccatgaccatggcattcgcgctgcagcgtccgccgtaccacacggtgaccgatcagtgggaagtcgcgcaggacagccacgtagtgctttacccggaagggatggcgaagctgaatgaaaccgctgccgccattctggagctggtgaccggcaagcaggatgtggcggccattatcgccacgctcaatgcgcgttttccggaggcgggcggcgtcgatgatgacgaacaggagttgagcaccgaacagtggattgaggtgttccgccaggcacgcgccatgggcagcgtgcagctgggcttttccggtggtgaaccgctgacgcgcaaagatctgccggagctgattcgcgccgcgcgcgatctgggcttttacaccaacctgatcacctccggcattggcctgacggagaaaaagcttgatgccttcgccgacgccgggctggatcacatccagatcagcttccaggcgagtgatgaaacgctgaacgccgcgctggccggttcgcagaaggcgtttcagcagaagctggcgatggcaaaagcggtgaaaaagcacggctacccgatggtgctgaacttcgtgctgcatcgtcataacatcgaccagatcgataaaatcatcgatctgtgtattgagctggaggcggatgatgtcgaactggccacctgtcagttctacggctgggcgcatcttaaccgtcagggattactgccaacgcgcgagcagattgcccgcgccgaagcggtggttgcccgctaccgtgagcgcatgggcagcagcggtaatctcaccaatctgctgttcgtcacgccggattactacgaagagcggccaaaccctttcccttcagtgctggagcagagcctggaggatatctggtacaactcgtttggcttcaatcgctatcgcggcttcgactggatgccggaaccgtgccgctcatgcgatgagaaagagaaagatttcggcggttgccgctgccaggcatacatgctgaccggcgatgccgacaacaccgacccggtgtgcagcaagtcgccgcatcatggaaaaattcttgaggcacgccgcgaagccagctgcagcgatatcaaaatcgcccagctgcagttccgcaaccgcagcaactctgagctgattttcaaacagcggcccgacgcgcgggaaagcgcggcgctggtgcgcgtcggcgcaggcagcctgcacgaacccgatcgctggcccggcctggcgcatctgctggaacatctcctgttttgcggcagcgctggctttaccggtgacgagcgcctgatgccgtggctgcagcaacagggtggtcaggtgaatgccaccacgcaactcagccgcagtgcctggttcttccagttgccggcgcaggcgctggcggcgggcatggcaaggctggcagatatgctggctgcgccactgctgaccggtacggcgattacgcaggaagcggcggtcattgaggcagaatatcagctgctgcggcatcatgccgaaacgctgagtgaagcagcgctgctcgacgcggccggtggcgcactgcgccgctttcgcgtcgggagtgcagcgtgttttggtgacaacgtaacggaactgcagcaggcgctgaggtttgctgtatccggtgcgctgactcctgcatttgccggaactcccggtaaatggcccgccgttgctgcgcgtaagtccggtgcagccgcggggaacgctgctggcggcgctaagctggcagcagcaactgcgcccacggctggccgcactgcgccatgccggtggcagcggacgctggcaacagcagcagggcgtctggcaactgctgcctggcgtgctggcggcgctgaatgcgccggtgctgccgcaaccgcaccgtgctgcacaaagtattgtgattcgtcagttgctggaagcactaccgcagcagctgctggccccggcagtgcatcctgcgtggcaggccgcctggtgcggccgcagcgaaagcgtcagtcagcacgccgcgcactggctgagcgaggtggtccggactcagcctgcgccgacgcgctcggcggcgctacagcacggcgtcagcgcgctacgctgtgcggcgaacgatcaggccttattgctgtttattccgctgcccgctgccgatga

SEQ ID NO: 62481 - DNA, 3174 bp, Glycine max
  Peptide Sequence Number=SeqID_154166
atgccgatttcgcatgaggattgccggaaggaacataacgatgcgcggctgatgagggcgcaaaaaaaagcccgcaacacgaggtgcgggcaacgtaatactggaagcaatgtgagcaatgtcgtgctcttcttcggtagagccaccgtcgaagcgcagaagaataataatcattcctattatcatctatgcgcggcgaatttggggagtgcgcgtgctttgcgatacactctcgctattgcccgagaatcgttgagttctatgccaaaattattccccgcgctgctgcttggtctcagcgtcctgagtgcctctgcgctcgccgcgcccgcggactctatccgtcacagcggctttgtctattgcgtgaacggcacggttaacaccttcaacccgcagatggtcagcagcgggctggtggtcgatacgctggcggcacagttgtatgaccgcctgctcgacgtcgacccttatacctatcgtctgatccccgatctggcacagagctgggaagtgcgcgataacggcgcgacttaccgcttccacttacgcaaagatgtttcgttccagcacaccaactggtttacgccgacgcgcaaaatgaacgccgacgatgtggtcttcagctttgcccgcatgttcgatcgccagcatccgtggcataacgtcaacggcggcagctatccctacttcgacagcctgcagtttgccgactcggtgcagagcgtgaagaagctggataacgacacggtagagatccgcctcaacagcccggacgcctcgttcctgtggcatatcgccacccactacgcgccggtgctgtcgcaggagtacgccagtcagctgagcgcggcaggccagcaggaacagctggatcgccagccggtgggcaccggcccgttccagctgagcgagtaccgcaccgggcaatatctgcgtctggcgcgcaatccgcactactggaaaggcgtaccgcgtctgcaacaggtggtgatcgacctcggcgtgggtggcactggccgcctgtcgaaattgctgaccggcgagtgtgacgtactggcctacccggccgccagccagctgtcgatcctgcgcgacgatccgcgcctgcgcatgacgctgcgccctggcatgaacatcgcctatctggcgtttaacacccgcaaaccgccgctcgaccgtccggaagtgcgccacgcgctggcgctggcgatcaacaacgagcggttgatggagtcgatttattacggcacggcggaaaccgcagcctcgattctgccgcgcgcctcgtgggcttacgataatgatgcgcgcgtgacggaatacaatccggcaaaagcgcgtgaggcactaaaagcgctgggcattgaggatttgcatctgcgcctggtggtgccgaccacctcgatgtcgtggaaccccagcccgcttaaagccgccgagctgttgcaggcggatctggcgcaggtgggcgtgcgcgtcaccatcgcgccggtcgagggacgttttcaggaagcacagctgatggccatgaaccacgatttaaccctgaccggctgggccaccgacagtaacgatccggacagtttcttccgcccgttgctgagctgcgcggcgattcgttcgcagaccaactacgcgcactggtgttcgcccgcgtttgatgaggcgctgcagcgcgcgctgctgtcgcagcagctgtcggcacgtatcgacagctacgatcgcgcccagcagatgctggcgcaggcgctgccggtgctgccgctggcgtcatcgctgcgcctgcaggcttaccggcacgatattaaaggcctggtgttgagtcccttcggtaacgcctcgttcgccggggtttaccgcgatgagcacggcgaggacctgagctatttcacgcccaacgcgccgctggaaggcgcctcgctgttcgatgcctggtggttctggtttaaagggctgctgcagtttgatttcggtgtctccagcaccaacggtcaggcaattgatatacagctgcgcgaggtgtttcccgccacgctggaactgtgcgtgctggcgtttatgctggcgctgctggtcggtattccgctcggcatctgcgccggcgtgatgcgcaataaatggcaggataaagccatcagcgcgctggcgctgctcggcttctcaatgccggtgttctggctggcgctgctgtttaccctgctgttttcgctgacgctgggctggctgccggtttccggtcgtttcgacctgctctatccggtgcagaacattactggttttgccctgattgacgcctggcttagcccttcaccgtggcggcatgagatgctggtcagcgcgctgacgcacctgattctgccggtgatcgtgctggctgtggcaccgactaccgaagtgattcgcctgctgcgcaacagcaccagcgacgtgatggataaaaattacgtcaaggcagcggcaacgcgcggcttgtcgcgcttcaccgtgattcgccgtcacgtgtggcacaacgcattgccgccggtgatcccgcgtcttggcctgcaattctccaccatgctgacgctggcgatgatcactgaagtggtgttcaactggcccggactggggcgctggctgattaacgccatccgtcagcaggattacgcggcgatctccgcaggcgtgatggtggttggcgggctggtgattctggtcagcgtactgtcggatattatcggtgcggcgctcaacccgctgaaacacaaggagtgcgccatgattggcctgtacggcttcggcatcctgctgtttctctgcctgttcggcgggctgctgtccccttacggtatcgaccagcagtttctcggctatcagctgttgccgccgtcgtggtcgcgctacggcgatccgtttactgagcggcgtggcaccgacggttggctctgcgctgctggtcacggtgctggcagcaatctgcgcgctgctgctgggcgtgctggcggggattacccacggtttgcgctcggcggtgatgaatcacgtgctggatacgctgctgtcgattccctctttgttgctggcgattatcgtggtggcctttcttggcccgcgactggagcatgcgatgctggcggtactgctggcgctgatcccgcgtctggtgcgcgaaatctacacggcggtgcatga

SEQ ID NO: 62482 - DNA, 306 bp, Glycine max
  Peptide Sequence Number=SeqID_154167
atgaatgcattgcctagcgctgttcatgcatcctccaccaaggagtctggaggctcgcgaattgattgcctagcgttgttcgccagttctccattctccacttttactctgagccccatgaatttattgcctagcgctgttcatgtgtcctctacattcgagtctggagccccgcgaattgattgcctagcgctgttcgccaattctccattctccacttttattcagagccccatgaattcattgtctagcgctgttcagtgtcctccaccaacgagtctggaggcctgcgaattgattgcgtag

SEQ ID NO: 62483 - DNA, 492 bp, Glycine max
  Peptide Sequence Number=SeqID_154168
atggctgagaagacaaagaaaagactggaagaagttgccaagtctggaagcactgagggcgtcattgaccctctatctcccatcagacgccacgtgaagtggaagatggcccgcacgaagaaaactggacagatgacgtctgaggcaacaaaggaaatagctgacaggattgattctttggacgagcaggcgtcacagggatcgtttgtcccccatggacgtcaagatgtcctgactgctgccattgggcgaccagagcaccctggccatgtttgtgctgctagagccggtgtcactataaagcaatactttggatcggcttcacgaacgtcccgcagttctgaagacctacaacagctgacccaacaaattagagaccaactggaggagtcaatcacagaaaaagtgactcgacagctgatggcaaatgcaatcacagggacttgcactacctccagagccagaggttggtccctcaggtccttgtgttag

SEQ ID NO: 62484 - DNA, 606 bp, Glycine max
  Peptide Sequence Number=SeqID_154169
atgggcgcgaaggtgattggctgctctgaacaaagcggcagtatccaggggctcgataaaccgattctcggcgatgtaaaaccgtgctttagcgacgaagagtggcagcgggtagctgaaggttataacgcgcttggcaagctggcggcagagaaggggatgcaggtttgcctacaccaccatatgggcaccggcattcagactaccgcggagattgacaagtttatgtcgctggtggacgaacgcgtcttcctgctctacgacaccggtcacgcctggtattcagagggcggcgaggcgccgatgctggcgatcctgaaaaaatatctgccgcgcattaaccacgtgcatctgaaagacgtccgccctgcggtgattgagcaggtgcgtcgcgaagggctctcattcctcgacggcgtcaagaaaggcacctttaccgtaccgggagacggcgaaatagatttccgtccggtcttccagttgctggatgactacggctacaaggggtggatggtagtggaagccgaacaagaccctgcgctggcgaaccccttcgaatacgccgtaaaggcgcgtaagtacatccgcgaaacggcaggaatctga

SEQ ID NO: 62485 - DNA, 157 bp, Glycine max
  Peptide Sequence Number=SeqID_154170
atggcacaccctccaccccgtgagaggactctaagggaattagttgcacctaatttcacctacgaaagcttgtgcatccaataccctgatgaggatgtcccatatattcttaaaactaaactaatccatttgcttccaaagtttcatggccttgcag

SEQ ID NO: 62486 - DNA, 126 bp, Glycine max
  Peptide Sequence Number=SeqID_154171
atggtcagaatggagaaggaagagcgagagaggagacgccacttcaaggagaagatgagtctagaagaagctcaccaccatagaaggccatgggataagagcttggaggaagaaggagatgagtga

SEQ ID NO: 62487 - DNA, 53 bp, Glycine max
  Peptide Sequence Number=SeqID_154172
atggccacctggtgcggaagaatgacagaattgcaagaccgagtcgatctcat

SEQ ID NO: 62488 - DNA, 66 bp, Glycine max
  Peptide Sequence Number=SeqID_154173
gaatacgcgcggagtcgccaccaacgtttatttgaggaaaacgtcggaaaaacccaaggaaatccg

SEQ ID NO: 62489 - DNA, 222 bp, Glycine max
  Peptide Sequence Number=SeqID_154174
atggaacaactaaaatcaactcaacaagcactccaaagtgtagaaatccaggttggtgagctggcagaagtagtaaatcaatttatgtccagaccagaaaaatcatttgtagaggctgaagctcaagagaaaagccctgtaaaagagcatgagtcaagagaaaaagatgaggagaaagatgttggatcaagtggcctcaaaataattaagaaggggggttga

SEQ ID NO: 62490 - DNA, 483 bp, Glycine max
  Peptide Sequence Number=SeqID_154175
atgaggggagcaccgaccgaagaaaggcttccttatagagataggcgcgcaaggtctcaaggttatacaaagaagtcacaaggctggaggacgattgaggaaagacaaggagctctagaggcagccttccgaaacggctcacggaggttattctatggatggctaacggaggtatttacggaagctgttgtatccttcgcccaatactatgaccagccgttgaggtgtttcacgtctggggacttccaaatggtcccaactattgaagagtttgaggaaatattaggatgccctctaggggggaggaaaccgtatctcttctccggttttcttccttccttgagcaagattgcggctgtggttggggattcagcaaaggagttggatcgcacgaagcaaactcggaacggcgtagtgggcttgcctcggaaatacatggaaggaaaggcaagggcatatggcgagccaagagaactggggccc

SEQ ID NO: 62491 - DNA, 561 bp, Glycine max
  Peptide Sequence Number=SeqID_154176
atgatggaggccatgatgagcatgaaaaagataatggaagccagtgtggttgctgttgccactaccagcgctattgctaagtacgaatggccccatgatgtgaaaattcaaaacgagcacgccttcccgccatatggcttgcctcccaactatacaccacccaatgtggcatacactcccaatgaggatgtcaataactccactcccatactcgttgagagccgacaacctcatcatgtacatgtctctcaacccatgggggagacacatgaaattccccacctcaatctagccgactttgagcctttccttggatatgccattgaagggcaagcagttggtggtatacccctacaaaacactttggagggccctcaattttgcccccaaccacaagtgctcttcctatctttttttgatccagcaaaatctgaatctgagtatcctactaagttgcataaagaattcttaggataccataatcttaaactaactgttcctaataaatatcttataattctttttactgccattaaatgtgaaaactttggatctgattga

SEQ ID NO: 62492 - DNA, 299 bp, Glycine max
  Peptide Sequence Number=SeqID_154177
atgacaatagaaaagcaaccccttaaggctagtatgcaagagaagactagctccatgaaccaagatgaggctactacttcaccttcctctactgaaagtgaagaagcaaaaggggaagaatctagtgaagaaattgtgaatattgcttcaacaaacaaagccttgtttcaagattcactaaagaccaagccttgccttaaaacaaagtgctttcaagacatgcaaggctctggtaatcgattaccaggaagtgtaatcgattaccaaaaggacagggttgagaatataactgttgaaaa

SEQ ID NO: 62493 - DNA, 248 bp, Glycine max
  Peptide Sequence Number=SeqID_154178
ggtacatctacttgggtgtgactgagaacaagagagggtacatctcttgtggatcagttctagtggagggtacatccactaggttgttcaaagagaacaagggagggtacatcctgatgcaagctccattggagcttgtaggcctaggatcttcttcatcaatggattcctttgcttcttggaagatgaatggcagcggaatggagaaaggaagagagagaggagacgccacttcaaggagaagatga

SEQ ID NO: 62494 - DNA, 378 bp, Glycine max
  Peptide Sequence Number=SeqID_154179
atggagagggattttgttttcaagccaaccaaagaacacatagtgaggttaaagattcaccatggagggatgtttatttataagccatccactgtgtatgtcaatggacacatcgttgaagaagaatggggttgggatgtggatactatgtcatatattgacttgacgaaggttattaagtctattggctacaaagcattcaagtgcttatggtacaagcacccccaaaaggcactttgcagaaggttgaagccactgaatggtgactgttggatttcccctgcagttactttttggtccactttttctttatacaaatatgttcaagcgaaatccaattttctggaaactggaccggatcatcaagtaatgtcctaa

SEQ ID NO: 62495 - DNA, 263 bp, Glycine max
  Peptide Sequence Number=SeqID_154180
atgaccggaaggcttcttgtcgtcaccctcttccttcaacactttaacatccttcttgattctgaaccttatgttccaatcaagagatcttttctaataggcgcaactgtcattgcatcctttggttatcaaaaagagcatgatggctcttgggtgaaaaaggctgctcgacctgttgatgaagaaggacatggtagagaagattcttctcttcaaaagattttggataggttcgatggtcttcaaacctttgttggtgaaag

SEQ ID NO: 62496 - DNA, 298 bp, Glycine max
  Peptide Sequence Number=SeqID_154181
ggaagaatttctccaagaacaccctcttaaggtcatcccagctggaaatgaacctgggagcaaggatgtaccctccaatgtgttaagacaaagatctcaggctgttaaacctttgatactttgtgaatggggatacaaaagaattctcaggcgggagaagggagacacaaaagaattcaggcggttagtcctttgttcttttggaaaagggagaagagagacacaaaaagaattcaggcggttagtccttggcgaattcttttgggcaaagggagaagggaatggaaaagatgaatag

SEQ ID NO: 62497 - DNA, 471 bp, Glycine max
  Peptide Sequence Number=SeqID_154182
atggtagccataaccccaaccaaggttcatcaacctccatttctccgagaatacgactcgaacgcaacgtgtgcttgtcatggagaagccccagggcattccattgagcattgtagggctctgaagcgtaaggtgcaaggtctaattgatgcatgctggctgaaatttggggagaatcgtgtaatgtgggtgcaagccattggtctgtttgctcaagtgacctgtgctcctgagtttggacttccaagaccgttcaatcagagattactcgtcttgcacgttggtgggggtgtcgtaaaacaacgaggacaacccttcccttgtgttcaggaatcctctacaacaagagacccacggtctcttaatcccttttcagaaataagaagaagagaagaagaaatctctcttaaaagagatagattgtataatgaagatcaatcaaaattctttattgaatatgcaagtggttga

SEQ ID NO: 62498 - DNA, 228 bp, Glycine max
  Peptide Sequence Number=SeqID_154183
atgataccagatgatgatgatgatgatctaagtctctttgtaaaaagattcaacaagtttcttaaagtaagaggaaatcagaggcgaccaaattttaaatcaaagagaaggacagaaaattcatcctctattctaaaatgctttgaatgcaatcaacctggacatctgagggttgattgtcccatcttcaagaaaaagatggaaaaatctggaaaagaaaaatcataa

SEQ ID NO: 62499 - DNA, 354 bp, Glycine max
  Peptide Sequence Number=SeqID_154184
atgggccccgacgggtgcagagaaacgcgagaaactggaatcagagaagcggcacacaaaccgaggcagaattttagcattcaaaagctttttcttcttccttcttctccacctttgttctccattgaaactctaaactttgctcatcatttctactccaaattgcaaaaggaagccattttcggagtcgtgaagcgcacctctacgttgtgggacttcgaatttcaggtagaaaagtgtgagattttgagggttagagaaaatgcttgtgcattgctggttatgggaaaggtagtacatattgggtttctgacattttcaagcttgaccaatcccgacccaacccgggcatag

SEQ ID NO: 62500 - DNA, 261 bp, Glycine max
  Peptide Sequence Number=SeqID_154185
atgtgtgcttgtcatggagaagccccgtggcattcctttgagcattgtaggggcctgaagcttacaatgttaaatgaaatggatgaagttgatatctttgtccctcatcctctcacaaacgcatctttgcttattcaactttcaccggaatgtgggtgcaagccattggtctgtttgctcaagcgacctgtgccccttagtttggacttccaagaccgttcaaaagattactcatcttgcacgttgttgggggcgccgtaa

SEQ ID NO: 62501 - DNA, 591 bp, Glycine max
  Peptide Sequence Number=SeqID_154186
atggattaccaaatgaggacccctatgcacatctggcaacgagaagcgaagaagtggctccattcattcaaaggtaacaatctgaagacgtggggggaggttgttgagaaatttatgaagaaatatttccccgagtcaaagactgcagaagggaaagctgttatttcatcatttcaccagttccctaatgaatcctttagtgaagcattggagaggttacaggttgtactatttgtggtggtgctcatgaatccgaccattgtattccttttgaagaacaaacgtaggaagtcagttacatgggaaatcaacaaaggaaaggatacaaccaaggaggattctcaggtttccataaaggtccctacaatcagcaaggacaatggagatcacaccctgaggactaccaaaatggaagaaactctgactcaattcatgcaagtgactatgtccaatcataagagtactgagtcaaccctgaaaaaccttgagattcaggtgggtcaactggccaagcagttagctgagaagtcatccaacagctttggggcaaatactgagaagaatcctaaagaagagtgtaaagtgttgtaa

SEQ ID NO: 62502 - DNA, 51 bp, Glycine max
  Peptide Sequence Number=SeqID_154187
ggaaatggaaaggaggattggtgtcatcccttgaagaattttgagtcatga

SEQ ID NO: 62503 - DNA, 336 bp, Glycine max
  Peptide Sequence Number=SeqID_154188
atgatactcaaatttcacgacgatccaacggtgaacgggttcgagatcgtcgtttttctgagactggtttgggatgttacagctaacggccaaaccaaatacgccaaatacagtgattcaaaaagcattcaaatgcctaagctgcgccgcatttcagagatgacgagagtgatgagcaaaatgacggcgacagcgacgaagtctatttcgttgaagcctttgggaagagacggcacagggaggtgccatttggtggaggagattccgattgtggtgcctaggtacgccgtcaagcctctggcgagggtgacattggaaagcacggaccaaaggtga

SEQ ID NO: 62504 - DNA, 348 bp, Glycine max
  Peptide Sequence Number=SeqID_154189
atggagagaagtatgatagatgctgccaatggtggagcccttggagacatgacgcatgtagaagccagaaatttaattgagaagatggcttcagactcccagcaatttagtgccagaaatgatgctattgtcattaaaggagtgcatgaagtagccacgaattcatcttcatcagctgagactaagaaccttgaaggtacaatcccgggtggaggaatcatcccaaccttagatggtcgaatcccttcacaacagcaacaacaacaacaacagccttattttcataattttgttggcccaagcagaccatacgttcctccaccaatccagcagcaacaacaacagtaa

SEQ ID NO: 62505 - DNA, 321 bp, Glycine max
  Peptide Sequence Number=SeqID_154190
atggtatggccaatcattgtaggaaaaccccaaggagttgcgggtttttttctaccaattggggccctcccttcaccacccccatgcggatggtctacggggttcataactactcctcttactacaggacgcttacctagccaacatttagatccggctctacctaaatttttctggtttactccaacatttcccacttgtccgactgttgccgagcagtttttggatatcaaacggacctccccagaaggtaattttaatgtggccgatttcccctcttttgcaattagtttcgcatacagcacctgctgctctagctaa

SEQ ID NO: 62506 - DNA, 549 bp, Glycine max
  Peptide Sequence Number=SeqID_154191
attcaagggactaatcgcctaaaaattctttgtcttagcacattggaggctacatcctttgtggtacaagtagagcatacatctacttgggttgtaatactgagaacaagagagggtacatctcttgtggatcagtttaagtggagggtacattcacttggttgttcaaagggaacaagggagggccacttgatccaacaagtagcatcagagtggtatcttgagaaaagtttcacaacttcaatattcatggcctcctcaaattctctgtttcccgaaggaaactccattcataggccacctatctttaatggtgagggttaccactactggaaaacccgaatgcaaatctttattgaagccatagactacaatatttgggaagccatagaaataggaccttatgttgcctccataatagatggaagcacatcaacaggcacaaaaatagaaaaacctagagataaatggtctgaagaagatagaagaatagttcaatataatcttaaagccaaaaacattattacttctgctctaggaataaattaa

SEQ ID NO: 62507 - DNA, 261 bp, Glycine max
  Peptide Sequence Number=SeqID_154192
atgggtttcctgacaaggtcgccacaggtttctaaatcagagaaagcagagtccagattctctgatgaggagtatcaggagtatttgaagctcaaatccgagaagcccagcaaccaagctcaaccctcgtctataccatgtttttcaacagcgtgtatctctcaatccattgaaggtcacagcccttggatactcaactccggtgcctctgatcatatttctggaacatggtacagggcgactgattggagaaggacatga

SEQ ID NO: 62508 - DNA, 252 bp, Glycine max
  Peptide Sequence Number=SeqID_154193
atgataacaaaggtgatgacaaaaagctcaaaggtcaatcaaagaataagttcaaaatgttcaagatggaatcaagaacaattcaagactcaagaggaaaagttgaagaacacttcaagattcaagaggaaagttgaattcaagaatcaagattcaaggatcaagcttcgagaattaagatcaagattcaagattcaagattcaagattcaagattcaagattcaagattcaagaatcaagtaaagacttaa

SEQ ID NO: 62509 - DNA, 247 bp, Glycine max
  Peptide Sequence Number=SeqID_154194
gtcgactctagaggatccccagcaggggttatggctaccattgaattatcaagtagatatgagagtaagtttagcatatgacaccggaatttgggggatgacctttgtggataattgggtggtgggaaaggagaaaggttgttactggctgagtaatgacattgttgggttggtgggaaactcagccatacccactttgatcctttcgtcggcgacaaccaaatcagcaaagcttgaaggtgtgtag

SEQ ID NO: 62510 - DNA, 315 bp, Glycine max
  Peptide Sequence Number=SeqID_154195
atggtggtgagcttcttcttgactcatcttctccttcaagtggcatctccaatcatctttcttccatctccattccattgccatgatcttcaagaagcaaaggaatccattgatgaagaagatccaaagcctacaagctccacatggagctacatcaatatggtgaactttgtcttcatcctcactaaaggaaccaagttcgtagttaatgaggtaggatctactgcaggggtactcaagaataggcgaggtcgatgcttagtagcatctgtaagaccctatgatgcaatcctaccccccaaaggcattggataa

SEQ ID NO: 62511 - DNA, 393 bp, Glycine max
  Peptide Sequence Number=SeqID_154196
atgtaccctcccttgttctctttgaacaacctagtggatgtaccatccactagaactgatccacaagagatgtgccctctcttattctcagtcacaacaacccaagtagatgtaccctctacttgtaccacaaagaatgtaccctccaatgtgttaagacaaagttctcaggcgggaaagggaagaatcaaaagaattctcagactgtgtcgttttgaattctttgacaagggagaagggagactcaaaagaattcaggcggttagtccttcgttcttttggaaaagggagaagagagacacaaaaataattcaggcgtcactggtaatcgattaccatcaaggtgtaatcgattacgcatcaacagatgtgactcttcattttgaattttga

SEQ ID NO: 62512 - DNA, 441 bp, Glycine max
  Peptide Sequence Number=SeqID_154197
gtggacgtcacctacgagaactggaaaaaggtccctactactcagaaggacttgatttgggaggatattccggtggaatttgatatcttagaggcttctgatagtaggacgaaaaggaagttacttcagaccatgggagagagatcgagccagtttaaatcagacctcacgaggaaatgggcccttgtagccgatcaggacgaagtcgaggacactgtctgtgagaaatacgacatcagcaaggaaaagtgggcccagttttgccagactcgtagagacccttcttgggaggatgtgcgcaagaaggcacaggccatccagaagcagaatattgccccccacgttttgtctcgtgggggttatgactatttggagcagaagctcctagttgagaagacaaagaagaagttggaggaagcttcacagtcaggaatcctttga

SEQ ID NO: 62513 - DNA, 822 bp, Glycine max
  Peptide Sequence Number=SeqID_154198
gtaaccaatatcacggggctgagcggtgtgacccacagcggtcgcgtgttcgtgccccccgacctaccaattcagcccacgaacgtcaagggtaaggcaaaggtaatggaagaacaagatgataaaccgcccctcactccgaatgaggatattccggtgaaaagtcttctggagaaaagggatggttatggcaagaaggaggtgtcgctagaggaagccagcgagtttctccgcataattcagcagagcgagttcaagcccactcccaatgacgtacgaggacctcttgccgtccctcattgccaaccaactggccgtaataactcccaggaagatcttccaaccccctttcccaaagtggatcagcccaatgtgaaaacttacccgctcgctaatcatggagggggagtggttaatgccattgagtcagataggtcgcacaggtctaagcctttaagggacgtagcaacccctaggaggtttatttatgaggccctacaaaaagggggtgtcattccccacggtgggcatgaagaggattcttgtctgttgcatcccgacgagctacataacatggaaacatgtttggcagtggaggaccttttgcagaggatgatagatcaaggtcgactggaagtcgacaatgagggaagggaagagcagcatatatgtatgcagtccacggatgagagaagtttcggaaggcctaaacctttggtggtatacttcaccaagggcgcaacttcacaaaatccccgatacccctcggcagctaaacctgtcccttttcccataccaaaacagccacgcagtcccatggag

SEQ ID NO: 62514 - DNA, 378 bp, Glycine max
  Peptide Sequence Number=SeqID_154199
atggcatatcatgctagctcaaaagccaatcaaaattcaatgaaaaatcatgaaattcattttggcaagagctactcaatagaaaactttcaaggggaccagagttacaaccttactatcaaaatgaagcagaaagaggttggtgtgctggtagaagaagtgactcaatttatgaccaaacgagaaaaatactttgtaaaggttgaagctcaagaggaaaaccttgtaaaagagcatgagtcaagagaaaaagatgaggaacaagcacaacaacaatgggagaagtactcaacagtagaaaacaatcaagaaagtattctccaaatcaataaccttcctcgtcaacggattcaagaaaaaaagccaagaagagcatga

SEQ ID NO: 62515 - DNA, 285 bp, Glycine max
  Peptide Sequence Number=SeqID_154200
atgctttgtcttaacaccttggagggtacatcctttgtggtacaagtagaagatacatctacttgggttgttttaactgagaacaagagaggtacatttcttgtggatcagttcaagtggagggtacatccacttggttgttcaaagagaactagggagggattttacaaggttgaaaagaaatctcaagaactggtggttgcttggggactggatgtagccacgggttgttgccgagccagtataaattcttgtgtttgtcttcttcttccctacactctttaa

SEQ ID NO: 62516 - DNA, 384 bp, Glycine max
  Peptide Sequence Number=SeqID_154201
atggctttgtgttcagtttttctcaatcttcatcttctgctttttgtttgtttgaccatagaagcgttaggtgtggcaaagccttcagtagctagttaccttagccaggagatactggcaaagcaagaacctcatagagtgcatggattacctgtgcagcctccggtgaagttcaacaatatggtggttatatcactgtcaatgaaactcaaggaagagcactgttctattggttttccaaggccactcacaaaccagaacaaaaacccgttctcttatggctcaatggagaatcacaaaccaaaaggtcaggaagtgagtgcagtaggagtaaacattgataatcacatgaatgaaggcagtggctggattaactcagcataa

SEQ ID NO: 62517 - DNA, 210 bp, Glycine max
  Peptide Sequence Number=SeqID_154202
atgacggagaaggagatgataacaatgatagttgacacactaccagtgttctactttgaaaagatggtgggttacacgccttcaagctttgccgatttagtttttgccggtgaaaggatcgaagtaggtttgaaaagaggcaaatttgattatcctgctttgacaaataaaaggcatagagcaaatggagagcatgagaaggaggaatga

SEQ ID NO: 62518 - DNA, 288 bp, Glycine max
  Peptide Sequence Number=SeqID_154203
atgaataacacaagttttcaaggtttggaaaaccagaaaacttcagaaagattttggtacaaagaagaagaagacattcaaagagattcaagccttgtaaaggattctcaaagatcaatcaagaaaaattcaagagttcaagataagaatcaagaagaattcaagactcaagaagaaagtctagagacaagaatcaagattcaaggttcaagatctcaagaatcaagatcaagattcaagactcaagattcaagaatgaagagaagactcaatcaagataagtattaa

SEQ ID NO: 62519 - DNA, 396 bp, Glycine max
  Peptide Sequence Number=SeqID_154204
atgtgttcagatatctattccaatcttgctactttttcatcaagattcttggatatgtcaaagcaggttcatgatgaagtcatattggaaggaccaacggaatcggctgaggttgcgaagtccatagttattgagtgcattgtgctcaaaactggtacagtagaaagcttggatgtcttggttaaggagtttgtagctgccagcgatgaagagaagaaatccgtgtttacccgaatggaagaggaagttgagaagctgaagggttctgcctcaaggcacgggaagatttacttgaaagctgccaagaattacttggaaaaaaaaacaaatgaaacttatgctgaattcttatgtcttctgcagaaattcatccataacaggatttatgttaaatag

SEQ ID NO: 62520 - DNA, 246 bp, Glycine max
  Peptide Sequence Number=SeqID_154205
atgaattttgcagcgagaaagcctgtagaattcaccccaattccggtgtcctatgctgacttgctcccatatctacttgataattcaatggtagcccataaccccaaccaaggattttcaactttcaccggaattgggtgcaagccattggtctattttctcaagcgacctatgctcctgagtttgggacttccaagatcgttcaatcagagattactcgtcttgcacattggtggggtgccgtaa

SEQ ID NO: 62521 - DNA, 373 bp, Glycine max
  Peptide Sequence Number=SeqID_154206
tcaaatttcccatgagcccaacaatgtcattactcaaccaataacagtccctctcacccagtcatccacaaaggctatcccaaaatcatccacaaagtttgttggccgcacatccaatgccaagcgcaaaccaaaacaccaaccaagaaatgaatttggcagcgaaaaagtctgtagaattcaccccaattccgccataaccacaaccaaggttcctcagcctccatttctccgaggatacgactcgaacgcaacgtgtgcttatcatggaggagccccggggcattccattgagcattgtagggccctgaagcataatgtgcaaggtctaattgatgcgggctggctgaaatttgaggagaatcacgtgtaa

SEQ ID NO: 62522 - DNA, 378 bp, Glycine max
  Peptide Sequence Number=SeqID_154207
atggggatacaaaagaattctcaggcgattagtcctttgaacacttttgtattagggaatgggaagaatcaaaggattctcagactgtgtcgttttgaattctttgacaagggagaagggagacacaaaagaatcaggcggttagtcctttgttcttttggaaaagggagaagagagacacaaaaagaattcaggcggttagtccttcacgaattctttttggcaaagggagaagagaatgaaaagatgaataacacaagttttcaaggtttagaaaaccagaaaactttggaaagcttttggcacaaagaagaagaagttcaaagagattcaaggcttgtaaagaaatgtaatagattgattggaaaagtatattga

SEQ ID NO: 62523 - DNA, 246 bp, Glycine max
  Peptide Sequence Number=SeqID_154208
atggtggtcatcctgcccaaggaacacctagttgtctggttttgttcatggcataacaggccagacaactaccttaaggggattattaacagcctaaatcaaaggctcctgctaggtggattgtcgtcaagtgtaatagacaaaaaggaatattttaacgatcctagaccattggagccagagagattaaaggcattgcagatccagtgggcacagtattatctccgagttagagatcagacctag

SEQ ID NO: 62524 - DNA, 264 bp, Glycine max
  Peptide Sequence Number=SeqID_154209
atgttgtggaagcttggagggattgatggggacccggtgctgagaggaacgaggataagggctacgtgggagtacgtgagctcagttgaaggtgggcaactgaggatagtggattcatgtgtgatttgtggatgtggagagatgatttataccatcgcccgatcgccacctagtaccacatatgacgggagaccttggggacgtcaggtggggtgctattgcccaaaaccaagcttgaccaatcccgacccaactcgggcatag

SEQ ID NO: 62525 - DNA, 581 bp, Glycine max
  Peptide Sequence Number=SeqID_154210
ggtacatccttcgtggtacaagtagagggtacatctcatgtggatcagttctagtggagggcttttacatggttgaaaagaaatctcaaggaccgcaggtcgcttgtggagggtacatcccttgtggatcttctcattccattattgatccaaaattcattgatatggatttcttttcaaatgagagttttgaatgcattcaggcatttgaaaactccaatcttattcctttcatgtctttaaaatttcctgtttactctgatttagttaaagccttctattcaaacctagaaatccaagaaggcactttaatttctgaagtttatgggattaaaatggtcaatgaccaatccctattctatgacttgacccaattatccaatgaaggtgtatcatttgaaggtacattgattgatgattggaaatatgatttctctgtgcatgatgcccatcggttggtttgcaccaaccaagcggatatgaccggaaggcttcttgccggttcattggcttttgagagccgcatccttcattatctcattgtgcgtatcttgcttccaagaccttcaaaacttgcacag

SEQ ID NO: 62526 - DNA, 480 bp, Glycine max
  Peptide Sequence Number=SeqID_154211
atgtaccctctcttgttctcagttacaacaacccaagtagatgtaccctctacttgtaccacaaaggatgtaccctccaatgtgttaagacaaagttctcaggcgggagaagggagacacaaaagaattcaagaggttagtcctttgttcttttggaaaagggagaagggagacacaaaagaattcaggcagttagttcttcgttcttttggaaaagggagaagagagacacaaaaagagttcaggcggttagtccttgtcgaattctttttggcaaagggagaagagagacacaaaagaattcaggcagttagtccttcgttcttttggaaaagggagaagagagacacaaaaagaattcaggcggttagtccttgtcgaattctttttggcaaagggagaagagagaagagtgacacaaaaagaattcaggcggttagtccttgtcaaattctttttggcaaagggagaagagaatga

SEQ ID NO: 62527 - DNA, 282 bp, Glycine max
  Peptide Sequence Number=SeqID_154212
atgaaaccaccagatgtccaggaggatcacatatttatgaaggcctttcctcattctttagagggagtgccaaagcactggctatattaccttgccccaaggtccatcacgagctgggatgacctcaagagaatttcagagcagcttctcctccaatatttttatgaaggactcagcaacatggagagaagtatgatagatgctacatgtggtggagcccttggagacatgacccctgctgaagctagaaatttaattgagaagatggcttccaactcctag

SEQ ID NO: 62528 - DNA, 354 bp, Glycine max
  Peptide Sequence Number=SeqID_154213
atgtcaggatttacacgcgattctcctcaaatttcagccagcccgaatcaattagaccttgcaccttatgctttagggccctaccatgttcaatggaatgccctggggcttctctatgacaagcacacgttgtgttcgagtcgtattctcagagaaatggaggttgatgaaccttggctggggttatggctaccattgaattatcaagtggtgttcgtcattggaagtgcggtagacaggctttgtgttgatttagggatggcctttgtggatagttgggtggtgggtaaggagaagggttgttattggctgagtaatgacattgttgggctggtgggaaacttggtcgtatag

SEQ ID NO: 62529 - DNA, 858 bp, Glycine max
  Peptide Sequence Number=SeqID_154214
atggtaagcatttgggacctagctagggtagaagtctccatggaaccaattgcctccctcgcccagtattatgatcagccgttgaggtgcttcatctttggggacttccagctatcaccaatggtggaagaatttgaagagatcctaggatgtcctctaaggggaaggaaaccatacctcttctcagggttctacccctcattggccagaatttctaaaataagtccaaatctcggcgcaggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccggttgtcgctatgctagccgacctatatgacaccttcgaccgaagatgcccgtctatccgctacaaggttaccgctcgtgcgtcgaaaaaggaaaggcgaattgggaccaactcttggctagcatgggggggcgtcttgaccacaacgcgagggtactccaaggagttcgcaaggcatgggatgcggcgtgaagaaaggacagatagcttagggggaagcagtaatgggatcatcggcggttatcataagtggctgagagtccgaacacaaggattggattggctccccaatctaaagactgtgagagacgatgaggttaaagcttcggaagaaagtgatgaggtacaagccctaaaggcagagcttgaaagagcccgggcagcaatagtgagctcaagctccgaagaggtgaaaggaatcatcacgggtcaaaggcatgatcttgaaggacgagctgaaggcttgccttag

SEQ ID NO: 62530 - DNA, 477 bp, Glycine max
  Peptide Sequence Number=SeqID_154215
catcctgagcattctgttattggtgagtctgtgcattctgttactggtgaggctgtgcattctgttactggtgaggctgtgcattctgttattggtgattttgaacatcctgattttgagcattataattttgaacattctgagaacatggcacaacctccaccccgtgagaggactctaagggaaatggctgcacctgatttcacttatggaagcttgtgcattcaataccctgatgaggatgtcccatatgttcttaaaactggactgatccacttgttacccaagtttcatggtcttgcagagggagtggcaaaggactggctatattaccttgctccaaggtccatcacgagctgggatgacctcaagagagtattcttagaaaaaaatttccctgcttccaggaccatggccatcagaaaggatatttcagacattaggcaactcaatggagagagcctatatgaatactag

SEQ ID NO: 62531 - DNA, 234 bp, Glycine max
  Peptide Sequence Number=SeqID_154216
atgatgggagaaaggtctatgtttctcgacctaaagtcaattgaaggaggaacaattgcctttggtggtatgggtaagggaaaaattactggtatagaccaatgtatagtcaagacagaagatgacaagttcttcttcaccgtcagacaacacaacaatatgtatgagattgatctgacaggtctaagtaaacagaatgtaatgtgtctgctttcgagagaagatgagaaatga

SEQ ID NO: 62532 - DNA, 327 bp, Glycine max
  Peptide Sequence Number=SeqID_154217
atggggtgtagcaagcaaatgctcacctggcccttaggaaggattcacgatgtcggatacaatgtccaggacatcctgcccgaaaatactggagttgctgaaagcattgaagttgcaggatccacgatgtcggatacaatgtccaggacatcctgcccgaaaatactggagttgctgaaagcattgaagttgcaggatccgcgatgtcggatacgatgtccaggacatcttgcccgaaaatactggacatataaatctgttatatctttaacagattattgtgcagttagcaagagattagatgatctatctttaggaacgaattaa

SEQ ID NO: 62533 - DNA, 398 bp, Glycine max
  Peptide Sequence Number=SeqID_154218
gactctgccagtcgttcggagtccccgtcacacctagcaaggccgcagacgcgccgccacctcatcaggctggcccagctggatcatttgatacggagcagtatttgcggcatttggttcaccagcaggcggccaaccaccgggcgcatgtacagacccatgattgtctttaccagttgagcctcagcctgcagagccaggattttacttcttttccgtgccctactccggatcagttcagggcagaggtcgcatggcccggagattggcctgaggcccgggcaggagaggcaccagtagaggcaccagcagaggctcccgacgaggcagatgaggcccgcgaggacgaggagattatcgatttacttgatttcttaggagggagcggagccacatga

SEQ ID NO: 62534 - DNA, 207 bp, Glycine max
  Peptide Sequence Number=SeqID_154219
atgtatcctctacttgtaccacaaaggatgtaccctcccaatgtgttaagacaaagttctcaggcagttagtcctttgaaactttgtgaaatggggaaacaaaagaaattctcaggcgggagaagagagacacaaaaagaatttaggtggttagtccttggcgaattctttttggcaaagggagaagggaatgaaaaagatgaatag

SEQ ID NO: 62535 - DNA, 657 bp, Glycine max
  Peptide Sequence Number=SeqID_154220
gatcccacgttgcctggccaagtaaaggtgggtgtcgaggaggttacagatgcagatgctccagttcctgtacccactgatgaggtttccttaatggggcagacacttcacaccttccttgcttggccgacacatctggtcaagtctttatcacagcaggtagctgtgtctccggcaaaaccacctccaaagcccgatccggaggtcgatgatctgctttatctgatgacattgagcatcccagagcttttcttgaggccttatcaggttacatgggatgccaccgtgttcggggtctttaatccagatttcccgctgtacataaagcacgaagacctctctgaaatcacacatggtggtcaatgtctcagcatatcagtgttacaacatctcactgaaacaagtatgcgagcggggaattctgatatctatggattcctcaagccacagtccattcagaggtctgggcaatcacaatttgagtctgaaagttacagaaagacttggatgcagagttcaaaacacgatgtctatcttagagcctacctaaatgggccagacaactaccttaaggggattattaacattgctttaaaaggtcttgatgatggtccacaacctaaatcaaaggctcctgctaggtggattgtcgtcaag

SEQ ID NO: 62536 - DNA, 203 bp, Glycine max
  Peptide Sequence Number=SeqID_154221
gttttgatgatgtcaaaaagaatttgcttgataatgattgccatcatcaaaaagggggagaatgtgaatccttgcttcaagatttcttcaagatcaagccttgcctcaaaacaaagggtttcaaagtcatgcaaggctctagtaatcgattaccaggaagtgtaattgattaccaaaagggaagtttgaaaaagggttgttga

SEQ ID NO: 62537 - DNA, 373 bp, Glycine max
  Peptide Sequence Number=SeqID_154222
gcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaa

SEQ ID NO: 62538 - DNA, 129 bp, Glycine max
  Peptide Sequence Number=SeqID_154223
gttccttgctacaaggtcatgacgaaagacaacgatggtacctctaagccctacactagggcaatgaaaggcaccatgcataaacctccaagcgaacctaggggcagattagaagttctcaccgaatag

SEQ ID NO: 62539 - DNA, 263 bp, Glycine max
  Peptide Sequence Number=SeqID_154224
ccccgcgaattcattgcctagcactgttcgccaattctccattctcaattttattcggagacccatgaattcattgcctagcgctgttcatgtctcctccaccatcgagtctggagccccgcgaattcattgcctagcgctccccgcgaattcatttcctagcgctgttcgccaattctccattctccatcttattcggagacccatgaattcattgcctagcgctgttcatgtgtccttcgttatgaagcgcggagcctctg

SEQ ID NO: 62540 - DNA, 384 bp, Glycine max
  Peptide Sequence Number=SeqID_154225
atgttcaggagttcttctattcaatccttttccttctccttgttgctggatatctcgttcgtacacatcttctctttgtttctcgagtctatagtgagttacagacagagttcgaaaaggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaaatcccatcaatcgaatcgctttttcgagaaatacgagacatctaagtcatccaagtaa

SEQ ID NO: 62541 - DNA, 99 bp, Glycine max
  Peptide Sequence Number=SeqID_154226
atggctagagttgctaagcaaaaccggaatgaggtagtcagagtaccaaggaggtgtttggaggagaaggcaaaggccttggcaaatcaaggcgaatga

SEQ ID NO: 62542 - DNA, 277 bp, Glycine max
  Peptide Sequence Number=SeqID_154227
ggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagatgcaccgccatcacctctagagttcacctcaactatccacaaaaaggttag

SEQ ID NO: 62543 - DNA, 270 bp, Glycine max
  Peptide Sequence Number=SeqID_154228
atggtctcctataaggacaatagcatcatttcttgcactgaattgttgggagttggaagccatcttctcaatcagattcctagcctcaacaggtgtcatatcaccaagagctccaccactagcagcatcaatcatattcctctccatgttgctaagtccctcagaaatattgcagaaggagttgctcggaaatctggtttactcattcaagctctctccaccatggttgttaaactcacgattctacgtagaatcgtgaaggttccataa

SEQ ID NO: 62544 - DNA, 110 bp, Glycine max
  Peptide Sequence Number=SeqID_154229
atggagttgtttgatgctcatgcacggtgcccctcattgccccagtgtaaggcttttgaggtttcaatcgttgcctttcgtcatgaccttgtagctagggaacctattgg

SEQ ID NO: 62545 - DNA, 234 bp, Glycine max
  Peptide Sequence Number=SeqID_154230
atgaagatgctcttgataccacatgatgatcttcttcatcaatggattcctttgcttctggaagatgaatggcagcggaatggagaaaggaagagagaggagacgcacttcaaggagaagatgagtctagaagaagctcaccaccataggaggccatggataagagcttggaggaagaaggagatgaatgaagggagagggagagaagagcacgaaattttgtgctccaaatga

SEQ ID NO: 62546 - DNA, 141 bp, Glycine max
  Peptide Sequence Number=SeqID_154231
atgaaaaaagctattgaattaactgaacaggcgggtacaaaaggagttcaagtacaaattgcaggacgtatcgacggaaaagaaattgcacgtgttgaatggatcagagaagggatcaaagtttggatattttctaaataa

SEQ ID NO: 62547 - DNA, 456 bp, Glycine max
  Peptide Sequence Number=SeqID_154232
atgcagtcccagtttcaatcccagatgcagtctcagggacttgcattgcctccagagcctatggctggtccctcaggaagattttacgagggatcaacagttcacaatattcctttgttgcctggccaagtgaaggttggtgttgaggaggttaaagatgcactggctcccgttcctgtacccactgatgaggaaattgtttctccaacaaaacctccacaaagggtggatcctgaggtcaatgatccactatatatgatgatattgaccatcctagagcttttcttgaagcctttccaggttaattgggatgctaccgtgttcaaagtgtttaatccagacttcccgctgtacataaagcacaaagatctctccaaaatcgcacacggtggtcaatgtctcagcatatctatcatacagttgtggattctgtatgtcaatttagcttattgttaa

SEQ ID NO: 62548 - DNA, 231 bp, Glycine max
  Peptide Sequence Number=SeqID_154233
atgccagcggaatggagaaggaagagagagaggagacgccacttcaaggagaagatgagtctagaagaagctcaccaccataggaggccatggataagagcttggaggaagaaggagatgaatgaagggagagggagagaagagcacaaaattttgtgctctaaaagagctttgagatctgaagccacaaatcccagatcaatttccagattctccactaagtgtgcttag

SEQ ID NO: 62549 - DNA, 605 bp, Glycine max
  Peptide Sequence Number=SeqID_154234
tttttgaagttcttagatgattataaaggtgatggcccaattacagttctattaagccattgtaggatcaaggaagcgcaaggatcttatcttgcatcgatcagcaattctttcaaggcttcaaagttaattattaaccagcccgtgatggagattcaagaattcaatgaacggcttgcagagttgggcattgaggcccggtcaggttttaaatcccatggtgaagggagtacacagctttcaggttctatccaattatcatcaaaagaatcattctttggcaaggctgaggcaaagactattgttgagattaacaccatctctgaagaaattgtttgtgtcactgttggcacaattactaggattgttcttgacaatcattcatggtgttatacagcttgcattcagtgccataaaaaaagtgatacaaagatggcgccctttacatgtgcatgcgacaaatacaataaggaagttgtgcttaggtataggcttgaggtgatgatcaaccagggaaatgaaagcacaaaattcctgctttgggaccgtgaatgcagtgaattaattggccaatcagctgatgcagttaataagcttaaattgaa

SEQ ID NO: 62550 - DNA, 387 bp, Glycine max
  Peptide Sequence Number=SeqID_154235
atgtcaggatttacacgcgattctcaccaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggagcaagtggtgttcgtcattggaagtgcggtagacagactttgtggttgattttagggatggcctttgtggataaatgggcggtaggaatggcagtcacagcatgggtttctccctcatcgtcaccctctttatttgccccagttttctcattcgtccaagcaggatga

SEQ ID NO: 62551 - DNA, 462 bp, Glycine max
  Peptide Sequence Number=SeqID_154236
atgtaccctccactagaacttatccacaagagatgtaccgtctcttgttctcagtcaacaacccaagtaccctctacttgtaccacaaaggatgtacccttcaatgtgttaagacaaagatctcaggcggttaaacctttgatactttgtgaatggggatacaaaagaattctcaagcgggagaagggagacacaaaagaattcaggcggttagtcctttgttcttttggaaaagggagaagagagacacaaaaagaattcaggcggttagtccttggcgaattatttttggcaaagggagaagagatgaaaagaatgaatagcacaagttttcaaggtttagaaaaccagaaaactttggaaagcttttggcacaaagaagaagaagaagttcaaagagattcaaggcttgtaaaggattgtaatgaattgattggattgatagacagattgattgaatga

SEQ ID NO: 62552 - DNA, 173 bp, Glycine max
  Peptide Sequence Number=SeqID_154237
ctccatttgagcttataggccttggatcttcttcatcaatggagtcctttgcttcttggagatcaatcgcagcagaatggagaaggaagatagatgatcggagaagccacttcaaggagaagatgaatcaagaagaagctcaccaccataggaagccatggataagagcttga

SEQ ID NO: 62553 - DNA, 216 bp, Glycine max
  Peptide Sequence Number=SeqID_154238
atggtagccataacccctgctaggtttcctcaacctccatttttccgaggatacgactcgaacgcaacgtgtgcttgtcatggaaaagccccggggcattccattgagcactgtatgacctcaaagcataaggtgcaaggtccaattgatgcgggctggctgaaatttgaggagaatcgcgtgattttcaagtttatgccacagttacaacgctaa

SEQ ID NO: 62554 - DNA, 294 bp, Glycine max
  Peptide Sequence Number=SeqID_154239
atgtgccctcctccaacaaaggttaagacgaaaggtgccccgaaaaaggtaatgaaaagaagcgaaagatcgacaaagcgtgatccatcttattgggagtatgttgatgcttatcatttagttcaaaacagaaacacctcagtcagacccagtgcatcatcttttaaaccaccgaagccagcaaggatgatccccatgttggatcaatttccgccatttatgcatggtttcattgaggatgttgttgatgttgttagacaagtggcctcagatatcttaagaagggggggttga

SEQ ID NO: 62555 - DNA, 486 bp, Glycine max
  Peptide Sequence Number=SeqID_154240
atggcttctaacactatcatccaatgcagtccttcaactcatacaaaaaggaaatatgacgtgtttgtgagcttccatggtgaagactcacacaacaactccactagttttctctttgaagctctccgaaaaaaaggcattgatgccttcagagatgatgcaggtctcaacaaaggagaatccatagcacccaagctgcttcaagccattgaagggtctcgccttttcattgtggtgttctcaaagtactatgcttcctctacttggtgcttgcgtgaactaacacacatctgcaactgcattgaaatatcgccaagactgcctattttttacgatgttggtccatcagaggctacaacaatatgcagagagattgaagaaattgttcaaaacatactaaaaattttgggtcccaaattttcaagtcttccaaatgatcatctagttgggatggaatcccgtgttgaagatttagtaaagctttaa

SEQ ID NO: 62556 - DNA, 231 bp, Glycine max
  Peptide Sequence Number=SeqID_154241
atggcagcggaatggagaaggaagagagagaggaaacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaacccactaatccaagatcaattccaagattctccactaagtgtgcttag

SEQ ID NO: 62557 - DNA, 128 bp, Glycine max
  Peptide Sequence Number=SeqID_154242
gtacaatcgttatctttcgtcatgaccttgtagcaaggaacctattgggtgaaaaggaacttctactggcccttaacgggagcggagttcgtagctctaaggagcatagggcctttcattctcctaag

SEQ ID NO: 62558 - DNA, 636 bp, Glycine max
  Peptide Sequence Number=SeqID_154243
atggcggaaccatcaaagaagcgaaagggttcttcaagtcggagtcaacaacattccgagactcaggaaacgccgattccttcctctattccttttacctcattgttttcatccgaagaacaacggatatggtacacaaatctcttttcttctcgttctattattgatccaaaattcattgatatggatttcttttcaaatgagagttttgaatgcattcaggcatttgaaaactccaatcttattcctttcatgtctttaaaattgcctgtttactctgatttagtcaaagccttctattcaaaccttgaaatccaagaagacactttaatttctaaagtttatgggagtaaaatggccattgaccaatccctattctatgattttacccaattatccagtgaaggtgtaccatttgaagaaggacatggtggagaagattcctctcttcttcaaaatattttggataggttcgatggtctacaaaccttttttggtgaaaggtttgatactttggagttacaagtggacatgcacttcaatgagatggagtcaagaatcaccaaggtcgaagaagatgtttcttatattcatacaagctttgatctaccaccaccgccgccatcatcatcttag

SEQ ID NO: 62559 - DNA, 357 bp, Glycine max
  Peptide Sequence Number=SeqID_154244
atgaacccttatgaaaacattcatagcatgcagaaaagatttacacatacaattaaccatcttgcctctttaggaaaaatctttcctaatgaagatttgattaataaagttttaagatgcttaagtagggaatggcagcccaaggaacacgagatggaactccaacgtcttaatcaaaatgatgaaaccgacaaaaagaagagaagtataacccttaaagcctcatcatcaatgcaagaagcaaatgaagaagaagattcagatgatgaagaagacttctcactctttgtgaagaagtttcaaaaatttgtcaagaaaagaagaatcgagaggcgtcagaatttcaacaatggatga

SEQ ID NO: 62560 - DNA, 135 bp, Glycine max
  Peptide Sequence Number=SeqID_154245
atggataagagcttgaaggtaggagaagatgaatggagggggagggagagggagagaaggggcacgaaattttgtgcctcaaaagagcctactaatccaagatcaagtccaagattctccactaagtgtgcttag

SEQ ID NO: 62561 - DNA, 462 bp, Glycine max
  Peptide Sequence Number=SeqID_154246
atgcatgctttgttagggtcattcaacactggaaactggtctgactctaaagttcttgatagtatagggttaagttgtcgtactatcacgaggaatcgggatattttatacacatgttcatattcacacttatctttacacaccggacacctatttgctgaaatagcttaccaaataacacaagttccccgagagttcgatactcgtttcttaccgttttatactacttgtgcgatccggtgcacttgccggaagcagaacaagtttttggcgccgttgccagggaacttctttttatttgggaaatctcccacaagcaatttagttcctctggacttcgaaattgaagctacattgcgaagtaacagggccgaggggagaagcaaacttctgcaagacagaacagttgcatccattcttgaggaagagactcatttctctgagttatcatcacctgattga

SEQ ID NO: 62562 - DNA, 150 bp, Glycine max
  Peptide Sequence Number=SeqID_154247
actcatcttctccttgaagtggcatctcctctctctcttcctttcttcattccgctgccatttatcttccaagaagcaaaggaatccattgatgaagaagatcctaggcctacaagctccaatggattgggcttctaccaattcaattaa

SEQ ID NO: 62563 - DNA, 327 bp, Glycine max
  Peptide Sequence Number=SeqID_154248
atgaagatgctcttgataccacatgatgtaagctccattggagcttgtaggcctaggatcttctttatcaatggattccattgcatcttggaagatgaatggcagcggaatggagaaggaagagagagaggagatgccacttggtcggaatggagaaggaagagagagaggagacgccacttcaaggagaagatgagtctagaagaagctcaccaccataggaggccatggataagagcttggaggaagaaggagatgaatgaagggagaggaagagaggagcacgaaattttgtgctctaaaagagctctgaaatctgaagtttaa

SEQ ID NO: 62564 - DNA, 321 bp, Glycine max
  Peptide Sequence Number=SeqID_154249
atgaagaattggatgcagaattcaaaacgggatgtctacctaggagcctatctgaatgatgcacattggcaaatggtcatccttttgcctaaggaaaatcttgtcgtctggttttgttccttgcataataggctagacaactacttgaaaggaataattaacagtgctttgaaaggacttgacgatactccacaacctaaatccaaggttggtgctaggtggattgttgttaaatgtaatcgacaaaaaggaagcattgagtgtggctactatgtgatgcactggatgtcaactataatcttaggaagttttcaagaataa

SEQ ID NO: 62565 - DNA, 144 bp, Glycine max
  Peptide Sequence Number=SeqID_154250
atgagcaaacgagaacatgaattgttcaaggagtatgcccaaagaaggaaggacttggtggctcaggtggcagcccctatggtggaaagggaaatgatcaccatgatagtagacactctaccagtgttctactacgagaagttg

SEQ ID NO: 62566 - DNA, 764 bp, Glycine max
  Peptide Sequence Number=SeqID_154251
atggataatgaagagggcgtgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcagcccgccttgaatccgggcctagacagaaacacggccgtgttcggtcgaaggtatagtcctcaagcctatccttatggcctgcctccgaacttcaccccccgtgccaccccggaagatttaagccaagcccctactttcgaggggcaactcccaccttatgaagattatcccgggcaagacgatggggaaggagatacccatcttggccccctgctccacctcaaagatctgtccccgcatgaaataccccaaccgaacatagtccgccataccccggcctcacccacacccgtaaaagaatctattccctttgcggaggataggggaaagattgaggcgcttgaagagaggttgagggaagtcgagggcctcggcaattacccgttctcggatttggcagatttatgtcttgtgcccaacatcgtcatccctcccaagttcaacgtaccagactttgatattttacaaagggacgacatgtccaaaggggcatctccggatgtatttccagaagatggggggcatattctgcggacgaaaaattttttggtccattttctttcaagacagctttggccggagcagctgtatcatgg

SEQ ID NO: 62567 - DNA, 489 bp, Glycine max
  Peptide Sequence Number=SeqID_154252
atgtgggcctttcataccgcgcgtcaacttggctgggcacacttagtcagatatcgcatgcataaggcattgcgattaaatgctccattgccatattcacaccttgtcactctctttcttcgccattttcaaattcctcttcattctgaaccttatgttccaatcaagagatcctttttaattggtgctgctgtgattgcctcctttggttaccgcaaagagcatgatggctcttgggtcaaaaagggtgctcaacccgttgatgatgaaggcaacctaccagttgaagataattcctctcttcttcgaaggcttttggacaagttcgatggtcttcagacttttgttggtgacaagtttgatgccatggaattgcaagtcgacatgcggttcgatgccatggattcaaggatcaccaaggttgaagaagatgtctccttcatccgtacttgctttgatccaccaccaccgcctccatcatcatcttag

SEQ ID NO: 62568 - DNA, 603 bp, Glycine max
  Peptide Sequence Number=SeqID_154253
atgaagatttttctgagttttgacaagtttcttccccaacatgctccattcattagtcgagaggttggcccggcctggttcactgacgattttcctgctgtcgatccggacaatgaagaagaagtgaacgaaatatggtcattttacttgaatccacagatcctgtcttgtcgtacagttggagacactactatcatgatctcaaaacttgagagtggttttacacaaccaacggtcgagaatatccgctcaaaccttcaagctcgaggcaaaacaatcataacaaagaaaagcaccgaaacgtctcgagctgatgtgagacccaagaaacccattggggtgaagatccaagaagggaaacaagaagagaagagtcaaaagaaagatgatagcactgagactaccacgacctcaaaacgctcgaagcgtgtggtcatcgaattagacgaagagaaagatgcaagttttatttctaatgtcaatattataactctctttcaagtctatattctgacatttctttaccatcataacacaggaagaagaggaaagacctctcataagaaaaagaaaatcacctgcgacttcgaccaaatctgctga

SEQ ID NO: 62569 - DNA, 467 bp, Glycine max
  Peptide Sequence Number=SeqID_154254
gtccgcaaggcatgggaggtgttgcaaaagaaggacaaagaactcaggggcagtaacaatgggcccatcggtggctaccataagtggttgaaagctcacgtgcaaggtttggattggctcccaagtttgagaaccgctaaaagggaggaagtggaggcaccggaggaagacgaagaggtgcaggcccttagggcagaactcgagcatagcccaaacagtcaaagaaagaccaagagggctcgtagggaagagcacggccggaacaagttccgaggggctctgtggggcagcaacagcgagcttaagctccgaagagaggaaatggaccaatcacgagtagacagtttgatcttgaaagatgagttgaagaggcaacaatgtggatggaccgatttggcttaccttgaacgggagctcaagaacttccccgattggctagccaaggccaaagcgatggcggaaccagg

SEQ ID NO: 62570 - DNA, 130 bp, Glycine max
  Peptide Sequence Number=SeqID_154255
gagagagaaaaaggaatcacacgaagagagtacaaatggaggcttcaatcccttctccgtctctctgacgtttgggaactctatcggaacagtcgaagggaaaactgaaggaatctcagggaaccgctag

SEQ ID NO: 62571 - DNA, 243 bp, Glycine max
  Peptide Sequence Number=SeqID_154256
atgatgacaacaaaagatgatgataaaagtgatgaacaaaaagctcaagtgaatcaaagaacatccatctcaagagaatcaagaacaagtcaagaattcaagaatcaagaagaattcaagactcaagaagaaagcctacaatcaagaatcaagattcaagattcaagatctcaagaatcaagatcaagattcaagactcaagattcaagaatgaagaaaaaactcaatcaagataagtattaa

SEQ ID NO: 62572 - DNA, 144 bp, Glycine max
  Peptide Sequence Number=SeqID_154257
atggagaacacaatgaagaacaaggaattaaaatcaatggcagcagaatggagaaagaggaaaggtgattggagacgccacttcaaggagaaaatgagtcaagaacaagctcaccacaataggaagccatggataagagcttga

SEQ ID NO: 62573 - DNA, 169 bp, Glycine max
  Peptide Sequence Number=SeqID_154258
atgtggaagaaagcttagctggcctcgctctcaccctcctagcccctcggatagaaactgtttgatcctcaggattccaacacttcttcctgatgtaggccaagttaatcaccgagctcaagcgctcaaaagtaaggctgtcagagacaacctctctaactctacatag

SEQ ID NO: 62574 - DNA, 346 bp, Glycine max
  Peptide Sequence Number=SeqID_154259
ggttcctctcggtgtggagaacaacgatggtttgtggtggctaatggtggctgtgggtgatggagaaagtgcttggaaatttagaaatggcattggaagaaagaaagaagaagaaatgatgagatgctctcgggaaaggaagcttctagcacactccagacatcttctcaaagatcccaacggtcagatcatggtcaagtgtcttttgaagttgaataccaaatgtcgagaagatccaacggttaacgaaggctgggcagcctttttaccgaggcagctttatgtagttttctctagaagcttcattaagaggcttcctccagaagcttcattaagaggcttctag

SEQ ID NO: 62575 - DNA, 138 bp, Glycine max
  misc_feature (133)..(133): n is a, c, g, or t
  Peptide Sequence Number=SeqID_154260
atggcacatcacatgcccattggcatgtgtcccaaaggaaccctcgtggatctccttaatcatgaagatggtaccacgtacaaagaaaccaatagccaatctcctcaacgtccttttgtcattgtcagaaatnccctg

SEQ ID NO: 62576 - DNA, 513 bp, Glycine max
  Peptide Sequence Number=SeqID_154261
atggattcatgcgctaggaatggtcccttcgacacttcaccagaaattaaagttcgcggttggtggactcttggtgatagtgtcgggcgaagaggatatgttggtaagttgcccctcctcagcaccatatgtagaggcagcggaggaatcattggaaacagctttccaatccttcgaggtggcacggttatgagcccggaatgggtctgggcaaggacagccacgggaatgccgatgtggttgacgttaggggtaacctgcacaaatatgggttggtgtatgagcccgggaaacctggaagaaggaatgcaccatcaagactccgggcagatagggcatggcctagtcatgttagccagtgttcacaagttccgggataatgttcgaggaagaggtggcggcaataggagaggtggctccacaagatccgccaagtttcgtgcgaccgtgccatcccaatttccaagtggggaactggcacatgatgagccagtcggaagtctataccgctga

SEQ ID NO: 62577 - DNA, 336 bp, Glycine max
  Peptide Sequence Number=SeqID_154262
atgatcctttcatcatggcagaacaagctatataggcacatggctacaccacccaactcacctcctcctccttccgagtcagcaacaccttcttcactgtctacgtcgaagaagacaagtaaaacaacacgacttagattgttggctactagaccagttggggtgggaagaccaatggttaatgttgatcttgtcactaggaatgtcgatggtccccacagaaagaagttaagtacatatttggggattgtcgctcacgataaggtgaatgttatatatgacaatttggaaaaagtctttgtcgctcaaaaggatctgatatgggaggatatttag

SEQ ID NO: 62578 - DNA, 213 bp, Glycine max
  Peptide Sequence Number=SeqID_154263
atggcctcctatggtgtggcatctcctctctctcttcctttctccattccgctgccattcatcttccaagaagcaaaggaatccattgatgaagaagatcctaggcctacaagctccaatggagcttgcatcatgtggtatcagagcatcttcatcaagcttgatgttctagataaatgcttcctatctttttgttcgctgaattctctttaa

SEQ ID NO: 62579 - DNA, 397 bp, Glycine max
  Peptide Sequence Number=SeqID_154264
gcttggctttcatgccctaatcactgctttatgtaaagcccggggagtccactctgattccttgaccttggagagcctgagtcctgccaataatttggcttatattaagaagaactattggaatcttgatgatccaacagtaactttcagaggacccaagaaggctagaggaaagagatctgaggccccttccatagcaccatcagagacagaaggtccttcttcttctacacttcctccctcttcctccacaaagatcccagtgattcctccaacaccttcacagattccactaccagctcttctttctacaaatccagcagattttattttcacttcccagatgcttcactccatgctccagagcatccatagagggcagtccatcatcatgtag

SEQ ID NO: 62580 - DNA, 305 bp, Glycine max
  Peptide Sequence Number=SeqID_154265
tgacctcctttaggtaccgtaaagatcggaatggtcaatggctgaagaaggatgcacttcctcctcaagatgaacgtactccttcacctcctcctccactcgaagattccgcactcatgaatgaagtcctctctgaattacggggtcttcgttcttatgttggtgaccgcttcgactcgttagatacacgctttgccgatatggacattcgcctcacacagcttgaagaggaggtcggatacattcgtcagagtttcgatcttccaccaccccctctgttagacaagtggcctcagatatcttaa

SEQ ID NO: 62581 - DNA, 312 bp, Glycine max
  Peptide Sequence Number=SeqID_154266
atgtcgctgcatgttctttatctttatgcgttttctggatttcccccagggatttcctgtctgttgtatctctcgttacaatctttcaaagagatgaacgtggattcgaggctttttagtcctcacgggcaggatcaccttgggctaccttctggagtgaagacaaaacatgaatggcagaaaccagtcaaggtacttaaggatgaacgcaagcggggatggggtcacgagcgaccgatcgttgctcttctctgtgcgaaacaagcagggaatgtcgctgcaaggcagccccgtatcctttctattttgtag

SEQ ID NO: 62582 - DNA, 345 bp, Glycine max
  Peptide Sequence Number=SeqID_154267
atgggaaaaatcaaaagaattctcagactgtatcgctttgaattctttgacaagggagacacaaaagaattcaggtggttagtccttcgttcttttggaaaagggagaagagagacacgaaaagaattcaggcggttagtccttccttcttttggaaaagagagaagagagacagaaaaagaattcaggcggttagtccatggcgaattctttttggcaaagggagaagagaatgaaaagatgaatagcacaagttttcaaggtttagaaaaccagaaaacttcagaaagcttttggtacaaaagaagaagaagaagaacttcaaagagatttcaaggcttgtaa

SEQ ID NO: 62583 - DNA, 300 bp, Glycine max
  Peptide Sequence Number=SeqID_154268
atgaggtggcttcattcatttaaaggcaatagtcttaagacatgggatgaggttgtggagaaatttctcaagaaatattttcctgagtctaagattgtagaaggcaaagccgccatctcttcttttcaccaatttcctgatgaatctttgagtgaggccttggaaagattctgtggtgggaaaatcaaattgaagacccctgaagaagccatggacctcattgaaaatatggctgcaagtgacattgctattttgagagatagagcccacattcctactaaaaagagtttattgagctaa

SEQ ID NO: 62584 - DNA, 225 bp, Glycine max
  Peptide Sequence Number=SeqID_154269
atgtcgcaatgtgcccttcacgggcgaggctcacgggtgcgcttcccaaaggacgaaagatgcgcggagtcgccaccaacgtttattggtggaaaacgtcgggaaaaccgaaggaaaccggtcgacaaaagcggggcttttgctcctacgtaccctccatcaaagaggaaatcagacctacgtagttcttccttaagcgtgaatcaagcgattctttttacttga

SEQ ID NO: 62585 - DNA, 138 bp, Glycine max
  Peptide Sequence Number=SeqID_154270
atgacgggaaatgcatcaaaatttactcatatatctcctaagaaaagtgaacatgtgacttatggagacaacaacaaagataaaacatcaaatcatgctcaatgttttcttagtaaagatgatgatttttggttatga

SEQ ID NO: 62586 - DNA, 60 bp, Glycine max
  Peptide Sequence Number=SeqID_154271
atggcacagggccttactagttggatggaacagaagaaaaagaagctaggaaaaatgtga

SEQ ID NO: 62587 - DNA, 858 bp, Glycine max
  Peptide Sequence Number=SeqID_154272
atgaatatgttgctctggctcccagcatacccaacaatccaacctggctgggacctagatgatgaaatccatgccacattcttcaaatgcatcagttggcaagtggaggaaaccttggatacagtcaattgcccttaccattatttctgtgataaaacgtacccttcaaactaccctcttgttgttgatatcttggtccttctcttcacagcagcttcttactttgtgactcttgccatattggtaatggacatgagttcaggaagaggcagaatctttttgtgtcaatcaaaaagattccttctgccctcaggtcctatatccctccctctaataatattagcctttgcaaagggtcctcaaatcaacacaatattcccactcaattgcattggtcctgcaattcttctaatggttctcatttctgcatttgtctggcattttgcatgcaagcttgtatctggattccgttgtgctgccttactacacaggaaagaggccttgtttgtgggagggaaactagtgaggtataggggttggtcaatgaccacattttttgttgtgggggttttgtgtttgaggattgtgtgcaaaatctcaggagaaaactatgcagggaaatttctgttcatcaaagccttgatggaaaggtttagctggatcttaataactgtggattgtgtttacctcacactaaactcaccaccagaaagagtgatgttgagagttgcagcttttggaggcattttccttttgattttcctccaacttctcaaagaggcatgcagccaaatttactcaatggcttgtgtagcagaaaaattgagatgggtatcagcaccatcgcatacaatatga

SEQ ID NO: 62588 - DNA, 5331 bp, Glycine max
  Peptide Sequence Number=SeqID_154273
atggacagaagtggaaaagttcgttctacctggaataggcttcttctggaagatcttgtagctcctgcttttatgcatatgctacttggtataaaagaattgctagggccaacagacatttactactctttgtggcctattggttcatttgaagagccatggaatattttggttcaacaaatatacaaaaacattggtaatgctccagttatgtattctaattacaatggaggaagatgggtatcaccaagtgaagcctttcttcatgatgaaaaattcaccaaaagtgaagaccttggtttggctctgatgcaactgggaatgccagttgtgcatttgcctaattcattgtttgacatgcttttacaatatagttcatgcaaggtggttacttctggtacagtacgtcaatttcttagggagtgtggaatgttcaattatttgagcagacaatacaagcttctattgctggaatattgcctagaggacttggttgatgatgacgttggtaaagaggcttatgatctgcctttacttcctttagcaaatggcaattttgcatctttttcagaagcatcaaaaggagtctcttatttcatttgtgatgaatttgaatataagctgatgcagccagtttctgatagagtaattgatcagaacattcctcccaatatattgaacagactcactggtattgcgatgtcctcaaagaccaatgttattctttgtagtattcaccattttgctcagctattccctgcatttatgtcagctgactggaaatataggagtaaagtgttctgggaccctgaatcttgtcaaaagccaacgtcatcatggtttctgctattctggcaatatctaggaaagcagactgaaatattaccactatttagtgaatggccaattttaccttccacatctgggcatctgttaagaccttccagacaattgaaaatgatcaatggaagcaatctctctgatacagtacaggatatccttgttaaagttggatgtaatatattgagtccgaaatatgtagttgaacatccggatatatctaattatgtatgtgatggcagtgcaggtgctgttctggaatcaatatttaatgcagtttcaggtccagttgttatgcatgcttcatttgatagtctagtaactgaagaacgaaatgagctccggagattccttcttgaccctaaatggtatgttggacgctctatggatgaatttgtcataaggctttgcaagagattacctatatttcaagtctatggaagagactctgctcaagattaccaattctctgacttagaaaatcctcgaaagtacttaccaccattagatgtgccggaaattattctggtgggcatagaattcatggtcagatcctcaactatagaaggcgatattttgtcaagatattatggagttgagagaatgggaaaagcacagttttacaagcaacatgtttttaatagagttggtgatttgcaagctgatgttcgtgatagcataatgttatcagttctacaaaatttgccacttttgtctcttgaagacatatctatcaaggactcattgagaaatttgaaattcatcccgacgttcattggtgctcttaagtgtccttcagttttatatgatcctagtaatgaagaactatatgcattactagaagactcagatagtttccctgctggtgcttttcgagaatctgaaatacttaatattctgcgaggcctgggactcagaacttctgtctctcccaacactgttttagaatgtgctcgatgcatagagcgtttgatacacgaggatcaacaaaaagcatatttaagagggagagtgcttttctcttaccttgaagttaatgcattgaagtggcttcctgatcaagttattgataataaaggagcagttaaccgaatgttgtcacgagcaacaactgcttttaggtcttgcaacacaaaatctgatcttgaaaaattctggaatgatctacggctggtttcctggtgcccagttttagtctctactccttttcagtcattaccatggccagttgtgtcatcaatggttgctcctccaaaacttgtaaggccactgaatgatttgtggcttgtctcagctagcatgcggatactggatggtgaatgctcttcaacagccttattgtatggcctgggatggatgtctccaccaggaggaggtgtaattgctgcacagttactggagcttggaaaaaacaatgagattgtgtctgatcaagttcttaggcaggaattagccatggcaatgccaaggatatactcaatactgagtggaatgatggcttcagatgagattgagattgtaaaagctgttcttgaaggatgtcgatggatttgggtgggggatggatttgcaacttctgatgaggttgtccttgatggccctcttcatttggctccatacattcgagttatcccagttgacttggcagttttcaaaaaaatgtttctagaacttggtatccgtgaattcttgcaacctgctgattatgctcatattctttgtaggatggcagttagaaaaggatcatcccctcttgacacacaggagattagggttgtcacgctaatagtgcatcatctagctgaagtttatcatcatgaaccagtccagctctatctgccagatgtgtctggtagattatttcttgctggtgacttggtttataatgatgccccttggttgcttggctcagatgatcctaatggctcatttggcaatgcaccaactgtggctttgaatgcaaagagaacagttcaaaaatttgtgcacggaaacatttctaatgatgtagcagaaaagctgggagtctgttctcttcgccggatgatgctggctgagagttcagattcaatgaattttggcctgtctggtgctgctgaggcttttgggcagcacgaggctttgactacaaggcttaagcatatacttgaaatgtatgctgatggacctggtactctgtttgagatggtacaaaatgcagaagatgcaggagcttctgaagtaatgtttcttttggataaatctcactatgggacttcttctgttctttctcctgaaatggctgattggcaaggtcctgctctatactgtttcaatgactcagtttttagtccccaagatctttatgcaatttctcgtattggtcaagaaagtaaacttgagaaggcttttgcaattggaagatttggactaggatttaattgtgtctatcactttacagacatccctatgtttgtttctggagaaaatgttgtaatgtttgaccctcatgccagtaatttgcctgggatttctccttcacaccctggtttacgaattaagtttgtgggacaacagattttggagcaatttcctgaccaattttctccattgctacattttggctgtgatttgcaacacccttttcctggaacgctattccgattccctcttagaactgcaggtcttgcctcccggagccaaattaaaaaggaagcctatacacctgaagatgtcagatctctcttggctgctttttctgaggttgtttctgaaacattacttttcctgcgtaatgtgaaatctatctctatttttgtgaaggaaggaacagggcaagaaatgcgcctactgcaccgtgtacatagaacctgtattggtgagcctgaaattggatccactgaagcccaggacatgttcaactttttgaaggaaagtagacatgtcggaatgaatagagttcagtttctgaagaaactaagcctatccattggcagagatttgccttataaattccagaagatcctaattacagagcaaagcacatctagtcgtaattcacactattggataaccacagagtgtttaggtgatggaaatgctcaaaagagaacatctgaaacagccaatagtaactgttacaattttgttccttgggcatgtgttgctgcatatttgaattctgtcaagcttgatggggacctggttgaaagttcagaggtggaggatgattgcatggtttctcctgatctgtttaaaagtgttagtttgcctacatatccactggaaaattttgaaggtcgtgcgttctgctttttacctttaccaatcagtactggtcttcctgctcatgtaaatgcatactttgaattatcatcaaatcgcagggatatctggtttggttctgatatggctggaggtggaagaaagcgctcagactggaatatttacctcctcgaaaatgttgttgcccctgcatatggtcatttgcttgagaagatagcatcagagattggcccttgcaatttgttcttctcgttatggccaacatcattagggttagaaccttgggcatcagcagtacggaaactctatcaatttgttgctgaatttaatctccgtgtattatatactgaagctagaggaggtcagtggatttcatccaaacatgctatatttcctgattttacttttcccaaggcagctgagcttataaaagcgttgtctagggcttctctaccagttattacacttccacagtcacttttagaaaggtttatggaaatctgtccatcattgcattttctgacacctaggctgttaaggactttgttaatcagaaggaagcgtgaattccaggacagaaatgcaatgattctgactcttgaatattgcttacatgacttacaagaatccatgcagtttgataccctatgtggcttgcctttgttaccagttgctgatggttcctttacatcagttgatatgaagggggttggagaaagagtttacattgcacgtggtgatgaatatggccttctgaaagattccattcctcatcaacttgttgattgtgctattccagaagaagttcatagaaaactttgttacattgcacaaacagatggcacaaacatttctttcttgtcatgccagttgcttgagaaacttcttgtgaaattacttcctgtagagtggcaacatgctcgacagccggtaacagcaagaggtgtattaaatgtgtttctggctattgctggggaaccacagaagattgatgggatcttaacagatgtatctgaaggagagcttcatgaactcagaagttttattctccagtcaaaatggttctctgaagagcaaattgatgacactaatattgaaatcatcagacaccttccaatttttgagtcgtacaaaagcagaaaactagatctctctctcaaatcttcattctcttctgcacgatttgttctggcaggcaatggatcttggcaacaaccatctaggtaa

SEQ ID NO: 62589 - DNA, 990 bp, Glycine max
  Peptide Sequence Number=SeqID_154274
atgagagacagagggggagcgtttgatcaacacagtgagacacatagggcgcaaccgcgggagacacttagagagaggacgacgaggatgtgcaaggagttggagcaagtgaagtggaatactgaacacgaggataacaccgactatactaccaaccatggagaatgggtgaaggtatctcacaggagaagtaggaaagggtcggagattggaggtcgacaaactacgaggggagatcaaaagccagagagatatatgacgtggagagacaaggaacatgtcacgacgttctacttttcaagattcccggaggagataagggagagtgatctgtggaagcttttccagaaatggggtagagtgagggaagtttttattcccagatatagaaacaaggtggggcacaggttcggcttcgtcaggttcatagaagtggtggacgagaggaggctggaacgacaactggacaacaatattttcattggcggaatgaaactgtttgtcaacagtccaaagttcgacaggggaaagatgtttcaaacaaacctatatgaagaagacatccagaaagaggggaaatcccaggtgaagctcacagggaagcagcacgcttataagaatgaaccaggctttggccgtagacaacgatcctacgcggaggtggctaaggaagcgacaacgggggaaggaagttcttatatggtgataggagacgctcaagatattaaaggggatagacagagaaagatggttttaagcccaaccagagaggacaaagaatggcttcaaagggcatgggtcggaagattgaagaatagaggtatgttcgaaagattggaggaggagttaaaatggacgtttgaacatgaagttcaaccatgttactgggtggatgactgggtgattcttccatacctggatgacattaaggcgaaacatatgatcaacgaggagaggaagcacggatcttcacctatatcggagctctag

SEQ ID NO: 62590 - DNA, 237 bp, Glycine max
  Peptide Sequence Number=SeqID_154275
atggttaaagaggtggagataggtaagggtgttggtgaagctggagaggaagggagacatacacttgtaccctttaatactggtggaatatccaaggaagacacactcagtggagcgaaattcaagcttgtgagagtgataaggatgcagaaaaggatagcaagctctgccaaagactttaaggaatgtgtaatcaggaaaagacaagaagcctatgaagaatgcccacttcattaa

SEQ ID NO: 62591 - DNA, 5076 bp, Glycine max
  Peptide Sequence Number=SeqID_154276
atgcacgcaattgatgtgaatttatattcagaaggaactacagtcattgatagatggcttgtggcactcagcctgggttctgggcaaacaagaaatatggctcttgataggtacgattatttgaagaatgtagtggatatcatgtggcggtatcttgcgtacgacttgactcctgttgctggaatagcagcacttatatccagcaatggtcatcatgccaatgtttactcaaggagctcaattatggcccctcttcctatgtctggttgtataaacatgcctattactgtcttaggttgtttccttgtgtgtcacaatagaggccgttatctctttaaataccaagacagagggactttagccgagggacactttgatgctggaaatcaattaattgaatcttggaacagagaggtgatgtcttgtgtacgtgattcctatgttgaaatggttttggagattcaaaagctaagaagagatattccaagttctataattgattctagtgtctgttctgcaatcagtctctctttgaaggcttatggagataaaatctactccttctggccccgttcttgtgagaggcatgttctgagcgaccaacttggtaatcacgataacaaccatccaagtacaacagcagttgttcttaaagctgactgggaatgccttaaagatcgggtaatacatccattttattctcgtattgttgaccttccagtatggcagctgtactcaggaactttggtcaaggctgaagaaggtatgtttctttcacagccagggaatgggttgcttggtaatttacttccagctactgtttgcagctttgtaaaggagcattatcctgtattttcagtaccatgggaattggtgactgaaatcctagctgtgggtttttcagtgcgagaaattagacctaaaatggttcgggatctcctaaaagtctcttcaaaaccaattgctctgcgatcagttgacatgtatatagatgttcttgaatattgcttgtctgattttcagctagcagagtcatccagctctgccagagataatgatcctgctagtgccaatgttttctgtcgggagactgataacggaatcacttcttctcagatggggtctaatatccacggctccactggcatggccactcggggatcagccagttctggagatgcattggaaatgatgacaagtttggggaaggctctatttgattttggtcggggtgttgttgaagatatgggtagagcaggaacacctgtggcttacaatgcggcaggcatagatcaaattcgggaccagaagttcatatcaattgctgcagaactcaaaggcttaccatttccaactgcaactagccatttaaaaaaattgggcttttctgaactttggattgggaataaagagcaacagtcattaatggttcccttgggagaaaaatttattcatcctaaaattttagacaggcctctcttaggtgacattttttctaatttttcccttcaatcactattgaaactgcggaatttctctcttaatctactggccaatcatatgaaactaattttccatgaagattgggtgaaccatgtaatgggatcaaatatggctccatggctttcatgggagaaacttcctagttctggtagtcaaggtggcccttcccctgaatggattagaatattctggaaaagttttaggggctcacaggaagaattatcccttttctctgattggcccctaattcctgcttttcttggtaggccagtcttgtgccgtgtaagagaatgccatctggtattcattcctcctcttttggagtacccaacatcgacaagtgggatttcagaaagagaatctgctggaagttatgagagtggggttagggtgtcaaggggtaatacttctgaagctgagttagctgagtcctacatttcagcttttgaaagattcaaaaccagttattcctggttgtttcccatgttaaaccagtgtaacatacccatatttgatgaggcattcatagactgtgttgcttcaaacagttgtttttctatgcctggtcgatcactcggccatgttattgcatccaaacttgtggcagctaagcaagctgggtattttactgaacctactaatctctcaacttcaaattgtgatgcacttttttcacttttttctgatgaatttttctccaatgactgtcactatgcacgtgaagaaattgaagttttgcgttctctccctatatataaaacagttgttggttcttatactaagttgcgaggtcaagatcagtgtatgattccttcaaattcatttctaaaaccatatgatgaacgttgtctttcttatgccattgattcaaatgaaagttcatttcttcgatcccttggtgtgctggagttgcatgatcaacagatcttagtacgctttggcttgcctggctttgaggggaaacctcagaatgaacaggaggaaatattaatatacatttttaaaaattggcatgatcttcaatcagatcaatctgtggctgaagctttgaaagagactaaatttgtcagaaattctgatgagttttcaacagatctgttgaagcccacggatttatttgatcctggtgatgctatattaatttctatattctttggtgagagaagaaaatttcctggagaaaggttcagtacagatggatggcttcgaatactaaggaagcttgggcttcgaactgctactgaagtagaggtaataattgaatgcgccaaaagagttgagtttcttggaattgagtgcatgaaaacaggagatttggatgattttgaggcagacacaatcaacacttgttctgaagtttcgcctgaagtgtgggcattaggaggatctgtagttgagtttgttttctccaactttgctcttttctttagcaacaacttctgtgatcttcttggcaatattgcatgtgtacctgctgaactggggtttcctagtgttggttgcaagagggtgcttgcttcatataatgaagctattttgtctaaagattggcctctagcttggagttgtgctcccattctatccaaacaacacactgttcctccagagtattcatggggacctctgcatctacagagtcctcctcctttttgtacagttttgaagcacttgcaagtaattgggagaaatggaggggaagatactcttgctcattggcccattgcttcaggaatgaacattgaggaatgtacctgcgagattttgaaatatttagacaaagtttggagttcactttcttcatcagatgtggcagagctacacaaagtggccttcctgcctgttgcaaacggaacgcgccttgtggctgctgatgctctttttgctcgtttgatgattaatttgtctccatttgcttttgaacttcctactgtatatctcccatttgtaaagattcttaaagatttgggacttcaggacatgctaacactttctgctgcaaagggtcttctattaaatcttcagaaagcttgtggatatcagcgactaaatcccaatgagctccgtgcagtgatggaaattttgaatttcatttgtgatcagattgtcgaggggaacacattagatgggttaaactggaaatcagaagccatagttcctgatgatggctgcagactagttcattcagcgtcctgtgtctatgttgattcttatggttctcgatatgtcaaatgtattgatacttccagaattagatttgtccatgcagatcttccagagggagtctgtattatgctttgcataaaaaagttgtctgacattgtcttagaggaactggatgagaatcacacactacagactttaggttctctggggtctgtttcactagtgaccatcaaacagaagttatcaagcaagtctcttcaaactgctgtctggactattgttaatagcatgggcagctacattcctgcattcaatagcttttcattggacacaatggaatgcttattgaactctactgcagaaaagcttcaatttgtcaagtctcttaaaacaaaatttctgctcttgcccaatttggtagatgttacacgtgcaggcaaagatttcataatcccagagtggaagaatgattctgcacatcaaacgctttattttatgaaccaatcaagatcccgtattctagttgctgagccaccaacttatatttccctttttgatctcattgctattatagtcagccagatattaggctctcctatcatattgcctattgggtctttatttggttgtcctgaaggatctgagattgcagttgttaatgttttgaaactttgctctgataagaaagaagttgaacccgtaaatgggagcagcaatatggttggcaaagaaatattgccacaagatgcacgtcttgtgcagttccatccattgaggcccttttattctggcgaaatagtggcttggcggtctcaacatggtgaaaaactgaaatatggtaaggtttcagaagatgtaagatcatctgcaggtcaagctctgtacagacttaaaattgaagtttccccgggggatacacaaagtttcctttcatcacatgtattttcatttaaaagtgtatcagcaagcagtcccctaaaagaatcattggtgcatgaaagccatgtattaggcagtaacaggccccatgttgatttccccgagagctcaggaaggggagaaagctactctcaggtgcagcctgtgagagatcagtctggcaaagtttcagctgcagaactggtgcaggctgtcaatgaaatactctctgctgctgggatcaaaatggacgtggaaaagcaggctctatttcaaagaacaataaatttgcaagaaaatctgaaagagtctcaggcagctcttgtgttggaacaggaaagggttgaaaaggcaacaaaagaggctgatacagcaaaagcagcatgggtttgtcggatgttcttctgcagtgtcaaggtgtcccttttgtcggcttcaggttacaaaagctatcagaatttttcgtccgtaatatctccaatgcttttgtga

SEQ ID NO: 62592 - DNA, 455 bp, Glycine max
  Peptide Sequence Number=SeqID_154277
aagggcagaggaagctggtgtgggtgaagtgggacacagtatgtctccctaaggataaaggtggtctaggggttttggagtcaaagtatgggggatggaggaatttagatgaggcgaggaggaatcacaaggagtcgatatggtggtgggacttgtgttttgtgtgtggcttggaggaggaaggtgggtggctcaatgaaggtttgaagtggaaaataggttgtggattgcaacaacaccacactattcagcagatgggcgttgagatggaaatagaagctagctttatggagaacattgaggagttgaggattcagcctaatcaacaagatagatggatttggaagggggatgtgaatgggctgtactcagtgggaagtggatatcatttgcttaatgaagtggtgactgccaacaagagcaaacctaaggagaaggaatgtgcagctagatga

SEQ ID NO: 62593 - DNA, 591 bp, Glycine max
  Peptide Sequence Number=SeqID_154278
atgggggagggatattgtacgcagccttacccttgcagaggcaaagagactgtttccggattcgaacccatgaccaacaacaactggagcaagtcattccaccagagtgaacaaactaagcccatcaaaagtacagagagttcagagtactgtgaggaagaggttgagggaaaagcctccaatagttattgggaaagttctaaaagggtagctactctgaaagaacaaaatgctccaccaaagacaatatatgtcagaaacttgtcatacagagtggaacaggctgatatggaaaatcttttcaaagaatgtggaaaaattgttgatgttcgtctacatcggaatcacaatggtaggttaaatggctttggacaagttgagtttgcaacagcagaagctgcgaaaaaaccacaaccaacaaaagaaaattgcctcctccatcactttctgaccatcaaattcttcattggagaaaatcaacctgttcctatggtgccatatacgccatatcaaagctacctacattctgaaacacaccttccatatactgctgtaagaagtgttcctttggtgtttgtggcaatactgtag

SEQ ID NO: 62594 - DNA, 174 bp, Glycine max
  Peptide Sequence Number=SeqID_154279
atggagaaggtcgaagcgaggttcacagcgctggaatcatcagtgcaaaatcaagaaaggtatggaaaggctgaaagagataaaagatatggtaaaaaaatggatgcaaaagcaaggtattgctctagaggaggaataaagtgtggacaagaacgcattggaggaggaagttga

SEQ ID NO: 62595 - DNA, 858 bp, Glycine max
  Peptide Sequence Number=SeqID_154280
atggctttacaagaaatgaccagattaacaagcagtatagaatttgcaacctatgagctgggtacgacctcaacgcatcgacggcgacaacgcaagactggcggcgattggagcgaaccagaaattggagggacacttctaacatatcttcattctatttcatctgttttcctgatgaagttggcgttcaaaggtgtttcaaacgtccagtatctcgaacaacaactggacaatattgttctcgaaggcctgaagctgcacgtgaatgtgccaaaacatggaagagacctaagggtggctgaaaaagaagacgacgttgcaagggtggaaatgatcatgaaggacaaaggtatagcaaaggaggacactggaacatcgtcaatggcagtttttggtagcgagaaggataaacaaaccagcaatagagaggcaggatcaaacgtgaaggtggtgatgcttggaaatagaagcaatggcgcggagaagagatggctatctaggcataaccagcaccacagggcagagtcaaacaggggatttcatttatcgcattcttccatcgtactatcagtgccaatggaaaccaaagcatgtgcggaggaggtggacttgaaataccttggaggagatatggttctgatcacggggattggtgaagacataatcaaggagctctgcaaagagggtgttgttgcaggttggtttgggtgttgtgttgggggtatccctctccatgcttgggattctcagaacatcaagaagatagtagggagcatggacgatgttatagatgtcgacgatgacgtcgagaacttgcatagaattgactgcgctagagttcttgttaaaacagcatga

SEQ ID NO: 62596 - DNA, 1755 bp, Glycine max
  Peptide Sequence Number=SeqID_154281
atgaactcctcccatcctgagggtcttctggatattcttctgggcctaggtggcatgggaacttatctacttggcatgagcccatacattgcttctcaagttgatggggggaacacgccaatcaatacaaagactatctcacttggttggatgtttggttttctctttgttgttagttttgtgggcctcttctctattgtgcctctaagaaaggtgatgattctgaagtacaagctaacatacccgagtggaaccgccacggctctccttgtcaatagcttacacacaccaaaaggagcaaaactagcaaaaaaacagattgctttgctcttcaaaagcttttgtggcagctttgcttttgggtttttccagtggtttttcactgcaggagatgattgtgggttcagcacttttcccacatttggtctccaagcctacagtaaaaggttctactttgatttctcatctacctatgttggcgttggaatgatttgcccttacataataaatgcatctttgcttcttggagctatattttcatggggtattctatggccattgattgagctcaagaaaggaatctggtatagcacagatctaccttctggcagtctaagtggcatccaaggatatagggtcttcactgcaattgccatgattcttggtgacggtctttaccattgcatcatcatgctaataagagttgcctatagtctcatcacccaatacctaaagaaaagagtgtcatcagcggtagaccctgaagatgttgatcaaaactcaagtgaagattttgattctcaacgtcgcactgagtatttcttgaaagacgagattccctcttgggttgctatcattggctacagtgttcttgcagttatttccatcataacggtttcactcatctttcctcaactgaaatggtatcatgtactaatcacttacctcattgctcctattctggccttttgcaatgcatatggatgtggcctcactgattggtctttggcagcaaactatggaaaacttgcaatcattatattcagttcatgggttggccttgagcatggaggcctcattgctggccttgcatcttgtggtgtaatgatgagcattgtatccacggcttctgatttgatgcaagacttcaaaaccggatatctcactcttgcatctcctcggtccatgtttgtgagccaagttttaggcacagccactggttgtcttgtttcacctttgatgttttggttcttccacaaggcttacacacttggtgaccctcaaggctcttaccctgcaccctatggcgaagtgtaccgtgggatggcccttcttggagcaaagggtttctcttctcttcccaaaaattgtcttgaactggctatcattttctttttattggctgtgtttattaacatagtgcgcgatttgttggagcgttatgagaccaagtataggttacataggtttgttccaaaccccatggccttggccatcccattctatcttggtgggtactttgctattgacatgtgcattgggagcttgattctgtttctgtgggagaaaaagaacaaacagaaagcaaaagattatggtcctgctttggcatctggactcatctgtggtgattctttgtggagtgttcctgctgctatactgtctcttgctggagccaatccaccaatttgtatgaagttcttgtctagagctatgaataacaaggttgacaccttcttgagtggtggtcattga

SEQ ID NO: 62597 - DNA, 564 bp, Glycine max
  Peptide Sequence Number=SeqID_154282
atgggttcaaaccttgggggtgcactctataattccaagacaacactttatgcagcatgtcaatgggaggcctggaacaaagacatacaatacatggaagagctggtggatagcactgacttggtcgatttggcagcaaaggaatatggtcatcttccgaaacgaaccattcaatggagccaagctgctggagggtgcactgtttctgctgatagcaagcggcctgagggttatgtacatgtatctactgttaattactctggatcctatcagcttattgggaactgtgttggtgcagctaatcaccggagcttcattgccttcctcatttctgcagttttgagtacaatctatgtctctatcatgtcagtatattcaggcttgcgtacatggccaccattgaagtactctcttgggcacattaacggggggactcattcttgcttatcttttcattgcaagtgtttcattgcagataggattgagcgttcttttatggcagcagctctcctatatataccaggggaaaacttatttgagtcacttgagctcacaagcagatag

SEQ ID NO: 62598 - DNA, 990 bp, Glycine max
  Peptide Sequence Number=SeqID_154283
atgggattcttaatgctgattttttatacatggaaacaagaaagagaaatacttcattcattgcttaaaaggaagaagtttaagatcttccttcagctaaccattcagaagaagattgagaattgcctaatacctttcttgatgatgcatccaaagctggagctgaggtggacttgcaagatgcctttcagaggttcacctttgacacttcctgcaccagtgtttttggatatatatgatcctatttgccttccaaacatgttcactaagctctcacactttgcttatcagaaagctttaattgtgatggaggatgtagcattccacaggcacatcacaccaagatgtttgtggaagctgcaggagtggcttcaaattggtcaagaaaagaagtttaaggaggccataaaagcttttgataagttcttgcatgaacgtattgcatctaaacgtgaagagcaaagtagatgcaataatcacaccaaaaaagaagatgacaatactcattctgacctgataagggtgctaatggaggaaggagctgaaaaagggaaaataatggatgacaagtatcttagagacactgcatttacccttgtttctgctggaagtggcacagttagtgcagagtttggcaagctagtttacctccatggagctatatgcgaagccttgaggctttttccttcaattccctttgaccacaagtgtacaatcaaatctgatatactccttagtggacaccatgttagtccaaataccatgatattttactctttgtactcaatgggaaggatggaacgaatatgggggcctagaagttgtttgggtaaagacatcacttttattgaaatgaagatggttgcagttgctttactatggaggtttcacatgcaggtggtggaaggccatcctataaccccaaggctttctattacacttggaacggaacatggcttgaaggttaaagttactgaaagatgcatttga

SEQ ID NO: 62599 - DNA, 1398 bp, Glycine max
  Peptide Sequence Number=SeqID_154284
atgttcttccgaaagccatcaccaactccgccactccactctctatcatctctaccctccacagcaattagcttctcaaaaactaaagacccccacaacaacaaattaaggtacaccatattttcatgtctcttccttgcttcatggctccttattctccaccgcttcaacttcacaatattagcaccctccaccaccacaaccacacccacatgcgacggatcaaaaccgttattctacatctacaaccttccctcgcgcttcaacctaggactcctcgaacgttgtcaaagcctcaacatatacaccaacatgtgccctcatgtcgctaacaacggccttggccaaccactctccaccccagattggtactccacgcaccaattcatagccgagatgatcgtgcacgcgcgcctggagaaccacccgtgccgcacgtgggatccctacacggctgttttgttctacgtgcccttctacggcggcctctacgcctccagtgtgttccgcgaggccaatcttacgctccgcgactccttggccgttgatcttgttgactttctgcaaagtcaaccctggtggaagaggcactatggtaaggaccatttcgttgccctgggtcgaaccgcgtgggatttcatgcgcacagaaggtgggtccgacttcggagcaaacatcttccttaacctcccacctgtcctcaacatgtcggtgctaacagtcgaacgacaaccctggagaggccacaaccagttcgccatcccctacccctcctacttccaccccaaaaccctagcccaaacgctgacgtggcagtcccatctccgccgacgcgccaggccccacctcttctccttcgtcggtggcacgcgcccggggttacaaaaggcaaaagtccgcgaccacatcgtctcgcagtgccaagcctcaaaacgttgcgttttggtccggtgcgcgagtggagacagcaaatgccacaaccccatgaacgtgctcgaggtgatggaaaaatccaccttctgcctccaggcgccgggggattccttcacgcgccggtcgacgtttgattccgtactggcggggtgtattcccgtatttttttcggagcatacggcgtatacgcaatataagtggtattttcctagggagagggatacgtattcggtgttcattgatgagagggaagtgattgaaggaaaggagaagatgatgattgaggaggtactgttgggatttggggagaaagaggttgagagaatgcgtgaggtgctcattgggctaatccccaccctcacctacgcccaccccaacgccactgccgcctttccggatgttgtcgatgtcatgctgcgccgcctctctcgccgagttacccaccatttcaatcctataatttaa

SEQ ID NO: 62600 - DNA, 1881 bp, Glycine max
  Peptide Sequence Number=SeqID_154285
atgggttccgaagtagtagaagaaccaacggaaacgacgtcgttgagttccccccgaaaaattcaaaccaacgacgctcccaccgcaaactgtcacgtgtccgttactcccaccacgctctcaatcgtgcagccacattcacttctcccaaagccagtgcctccaacaaccacttattctccaaacgacgtcgtcgtttcctcctccgccacattcgcaaaattcctccgccagcgccgcaacgacctgtcgtccgcgatcagcaaggggatctccacgctgaagcactccatcaacgaccaaaacgactgcaactgcgtgacggagttcaacctctcggggctaaaggtctttgtgacggtggaaaacaaaaacgacgcgtcgtttgcgcggggaagaatgagaatcagcttcttctcgcgctccaactgcagagagtgttgcgcagtgcgaaggttcttcagagagagagcgttgaggttcgtcgagataaacgtcgacgttttcgcggagcgggagaaggagctgagagagagaacggggagcgcgacggtgccgaagatcttcttcggcgagaaactgatcggaggcttggtggagctgaacgcgctgaggaaggacggcggcgaggagttggagaggaggctgacggcggcggtaggcgaggggccgtcggcgccggcgtacggattcgacgaggcggcggaggtggaggaggaggaggaggaggaggaggagattgggagggtagttagggttttgaggcagaggttgccgattcaggatcggtggatgaagatgaagattgcgaggaactgcttcgcggggagcgagttggtggagcttctcgttcgacaccatggctgtgctccttccaaggctgttgagattggaaaacagttatgcaagaagcactttatccatcatgttttcggggaaaatgattttgaggaaggaaatcacttctatagattccttgagcacgaaccccttatctccaaatgctttaacttccgtggttccacaaatgatagtgaaccgaaggctgcagctgcagtgtgtgataggcttaccaagattatgtgtgccattcttgagtcttatgcttctgaagacaggcgacatgttgattatatggccattagcaaaagtgaagaatttcgaaggtatgtaaacatgacccaagatcttcagagggtgaatctcttggaactatcagaaaacgagacgcttgctttctttataaatttgtacaatgccatgatcatccatgctatgattagagtagggtgtgaagaaggtgtaattaataggagatccttctctgatttccactatttgattggagggcatccttattctcttggtgctattaaaaatggtatcctcagaagcaatcagaggccaccgtattccttaatcaagccctttggcacaggagacaggcgcttagagaacttgatggcaaggagacagggaactgggtctaaatgttgtcctataattaaaccaatgctgcagcctcaacttcatgctcttgtcaagatggatccgttagttcactttggactttgtaatggcacgaagtcaagcccaaaggtgaggtttttctcatcctatagagttgcagaagaattgagaagtgctgctagagagttttttgagaatgatggaattgaggtggacttggagaagaggaccattcatctcactccgattttcaagtggcactcttcggatttcggacaagagagaaacatactaaagtggataataaatttcttggatgcaaataaagcaggtcttttgacacatctcttaggtgatggtggtcatgttaatatctcttacatgagttatgactggtcaataaattcctga

SEQ ID NO: 62601 - DNA, 701 bp, Glycine max
  Peptide Sequence Number=SeqID_154286
atggcctgtgggaaaggaaacgaggcaacaacacaagttgtgtgtttgttggcaataagatacgaaacaagaaggagagataaggagaaactatttgctttctcaactttggaaattacaacatggcttctgcttcctcatccacacccttcttgggaatcagacaagaaaatcaaagtcacgttacacaacagcaacaacaccaatcctctactactgctgcttcctctactactactactagtgctactccaaccacagtgcctcaaaagaaaaggaggaatcaacccggaacaccatgcaaatccagatgctgaggtgatagcactatctccaaagactctaatggcaacaaacaggtttatatgtgaagtgtgcaataaagggttccaaagagagcaaaacctacagctacacagaagaggacacaacttgccttggaagctaaagcaaaagaccaacaaagagccaaagagaaaggtttatctgtgtcccgagcccacatgtgttcaccatgacccttcaagggctcttggagacctcactggcattaagaaacactactctcgcaaacatggtgagaagaagtggaagtgtgaaaagtgctccaagaaatatgctgttcaatcagattggaaggcacattctaaaacctgtggcactagagagtatagatgtgactgtggcaccctcttctccag

SEQ ID NO: 62602 - DNA, 4656 bp, Glycine max
  Peptide Sequence Number=SeqID_154287
atgacgaaagtttacggcacggggttatacgatttccggcgccaccgcgtcgccgagtatccggtggcggcggcaccagcagagtcgaaaacgttagttccaaagaccggcggcggcggcggcggcgttccgagcagcatcactctgtcggagattcagcgcgaccggctgacgaagattgcggaggcgaactggttgaaaagtggcgatgcggggaggcctaagaaggacttcgaccctgagcttgttcgcaagatctacgaaaccgaattgttggtgaaagagggttcgaaacccgttcccttgcaacgtgtcatgattctggaggttagccagtatctggagaattacctgtggccttatttcgaccctctcactgccaccttcgagcatgttatgtccatcatcatcatggtcaacgagaagttccgagaaaatgttgccgcttggacttgcttccatgagaggaaagacgctttcaaaggctttctcgagagtgttcttcgcttgaaggagggacgagaactaagtatagccgaaaagacgaattacctagtttttatgataaatgcctttcagagtttggaagatgaggttgttagcaggacaatcttgagactggcaaatttgaaatcttggtacagtttgtcttatggtcgatttcagatggagctttgtcttaatcctggcttgatcaagaaatggaaaaggatgataaagaaggaacctgtgaaaggagatggatcacatttagatccctcaactacagttgaagtgatgttcgtgagaaacctcatagaagaatttctggagatactggattcacaggtatttcccctgaaacaattatctggtgaggacgatgaacttattgatgctactggtttggggctagttaatgatgcctgtgtcctgtactgtgagaggtttatggaatttctaattgacctcttgagtcaattgccaacgaggaggtatttgaggcctcttgtggctgatgtagctgtagttgccaaatgccatttaagtgcactctataggcatgaaaaggggaaactttttgcgcagttggttgatttactgcaattctatgaagggtttgagattaatgatcatactggaacacagttaacagatcatgaggttcttgaatctcattacagccgaatgcagtcattccagctacttgcatttaaaaagatggaaaagctgcgggaacttgctttgactaacattggttcgattcacaagcgtgctaatctgtccaagaaattgtctgttctttctccggaggagttaagagattttgtttgctgtaagcttaaactggtctctaaggaagatccctggtcagagagggttgattttcttattgaagtaatggtgtcctattttgagaagcaacaatctcaaaaagaagctattaatgctcttcccctttatccaaatgagcagattatgtgggatgaaagtgttgtacccagcataaattactctggagaaggttgcttagcattacccaagctgaacttacagttcttaacacttcatgattatcttcttcgaaattttaatctttttcgacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatctgtgactgcagaggttacttatagcgtttccagttatagagcacatattagatcagaatgggatgcactcaaagagcatgatgtattgtttttactatctattcgcccatcatttgagcctcttagtacagaagaagaagacaaagctagtgtcccacaaaagcttggcctacaatttgtacgcggttgtgaagttattgagattcgtgatgaggaaggaaaccttatgaatgatttttctggaaagataaaacgtgatgagtggaagccaccaaagggggaactgagaacagtaactgtggctttggatacagctcaataccacatggatgtaagtaacattgccgaaaaaggggcagaagatgtttatggtacatttaatgtgttgatgaggaggaagccaaaagaaaacaattttaaagccatcctagaatcaataagggatttaatgaatgaatactgtattgttcccaagtggttggaaaacatttttcttggttatggggatccttcagctgcacagtggactaatatgcctgatctattggagacagtagatttcaaagacacttttgttgatgctgatcacttaaaagaaagttttttggattatgaggtgtcttttgttaatcctgatggctcaggaaatttgaatccaaggcctccttttaagatcaagcttccccgaacactcaaaccaaacaatggtgctcttactgggcatgcaatatctacttctggtgcaacaaatgaaatcaatgtggttgatgctaattatcagaaagaagcactaattattgagacatatactcctccagatcctggcccctatcctcaagatcagcctaaacaaaattcagttagatttacacccacccaggttgaagcaatcatctctggcattcagcctggtctaactatggttgtggggccacctggtacaggaaagactgatacagctgtacaaattctaaatgttctttatcataattgtccttctcagagaaccttaataattactcattcaaatcaggctttgaatgacctgttcgagaagataatgcagtacattactaagtgcttattttggggaaggggaagctctattattgctcctctttgtaagagggcaagccttgacacaaggagagatgttcctgcacgttatcttcttcgacttggtcaaggagaacaagagctagcaactgatcttgattttagccggcaaggtcgtgttaatgcaatgcttgttagacggttagaattgctgagtgaagtggagaggctagcaagatctcttcaattgcccgaggatgtgggttacacttgtgaaactgcaggatacttttggttgcttcatgtttattcacgctgggagcaatttcttgctgcttgtgctgagaataaagaaaagtcaacatttgttcgagatcgttttcccttcaaagagttcttctgtgatacaccacatcctgtatttacaggtgagtcttttgagaaagacatgcgggctgcaatggggtgctttcgtcatcttaagaccatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggatggtcatgcacggcttaaacgctgcattctgattggtgaccatcaccagttgcctcctgttgtgaagaatatggcttttcagaagtacagccacatggatcagagtctatttaccaggtttgtccgattgggcattccttacattgaactaaatgctcagggaagagccaggccaactatagctaaactttacaattggagatacagagatttgggagaccttccttctgtaaaggaggaagtcatattcaatagggcaaatgctggatttgcttatgattatcagttagtggatgttccagattaccttggtaagggggagacaactccatctccttggttttaccaaaatgagggagaagcagaatatgttgtcagtgtctatatatacatgcgtcttttagggtatcctgcaaataagatatcaattttgactacatacaatggtcagaaacttctcatccgtgatgttataaataggagatgcgttccatatgactttattggtcctcctagtaaggttactacagtggataagtttcaaggtcagcaaaatgattttatattgctatctcttgtgcgtactcgatttgttggtcacctacgtgatgtaagaagattggttgttgcaatgtcacgtgctcggcttggtttatatgtcttttgccgtcgttccctttttgaacaatgctatgagctgcaacctacatttcagctgcttcttaaaagacctgaccaccttgcccttaatgtgaatgagattacatcatatactgaacgaaatgttgaagatcctggaccggggcatcatttacatcttgtcagtggcattgaggagatgggtagtatcatagacagactgtatcaggaaaagttgagacatcagtttgatcaaaatggggcttattttagtcatttagaaccatcagcaaatacagattgggtgcaaagtgggcagcagactatggacactgatatgcctgaacaaacagaggaagctacaactgttgataaccatgtcgctgtagatatgccacctgaaaacagcatggaagatgttaccatggttgataatggtgatggtgttgcaaatgggaacccatcgccatag

SEQ ID NO: 62603 - DNA, 1848 bp, Glycine max
  Peptide Sequence Number=SeqID_154288
atggagaatctctttaagagcattgaaagtatccgaaggttccgctcctcgcagttcgacttgatcaaggccggcttcaaggccgaaggcgatgttgtttctgttaatatggtctttctcaaggctggaactccatctccaactggttttgtcatgaatttgcagccttctgaagcagaagctggatttgatattcgggtgccacccactgctgatccagaatcgttggagaggcgcattgctgaggaatgggcaccttcatcccgcaatatgtcatttactaacaaagaaaacaaaggacagaaaacggttgaaaattctatttctattctagctggtactgagttcaaacagaaggcgcacacacgagataagtctgggaaaccaatcctcaccaaaactgatagttccaatccctggtgggcccttttagaaaatgctgtccaaaaggctggtgggaaacttggtaagcccgaggtctttcccgccgctacagattcacgctacttccgtgaacgtggattaccagcaattggattctcacctatggcaaacactcctgttcttctacatgaccacaatgagggaatgttatcaggcttgtttgagttgggtagtattctagtgggagaagttgagttgagtttggaaggcgccgttgtagttgtagctgtagaagggtcacgtgcctccacttcctcacactctcactccgttagggtttacgaccaacctcgtcctccttgcactgatttcgacgtcgcctatttccattcctacgctcaccttggcatccaccaagagatgatcaaggatcgtgtgcgtactgatacttatagggatgcaatcatgcagcatcagagtttcattgcaggcaaagttgtcgttgatgttggatgcggtacaggaatcctttctatattttgtgctcaggctggtgcaaaacgggcaaatgaagttgtgaaagcaaataacttgtctgatgttgttgttgtattgcatgggcgagttgaggatgttgaaattaatgaagaagtggatgttataatttccgaatggatgggctatatgcttctgtatgagagcatgcttggaagtgttattaatgctagagatcgttggctcaaacctggtggtcttattcttccttcaagttcaacgttgtacatggctcctgtcactcatacggacagatacagtgacagtgttgacttctggcgcaatgtttatggaattgatagtgagttctctacttggactaagagagaacgagaatatccttctccagatcagtatgatccaagaggaaaagtgtctgccatggtatcactggctaaacaatgcgcatttgaagaaccttccgtggagactataactggtgaaaatgtcttgacatggccacatgtgggagtagaagggaggggaggggaatggaggaagaagggggagaaggaggggaatggggagggaagaggagtggcggaagggggagagggaggtcacacggtggcggttgctgtaagccttgcctcaaatcgctgtctcagaaagcagatccatggcaccttgttgagctgggggcacaacgatgaaaggttgctgtggactattgggactattgggtcttcaaagaaattaagggaccgactagaatgtgcatcagcagcagctttggtagcatccaagttaggccaagatattgcagccttcgtttaccatgatcttacacaacaaggtacgcttttcacaggccgctgtctgagaaaggcgcaattttcagacaagcgcacaacactctttcatgcgcagaaaaggaaatgtttcaaaaggccatgcacaacaccttga

SEQ ID NO: 62604 - DNA, 222 bp, Glycine max
  Peptide Sequence Number=SeqID_154289
atgcattttagttgtgactttttttccagcgacgatcatttcagtgcttatactgggcctcaaacaaatgcttccacctatgcgagcatcatcgtcgtcgttagcgaagttcttccatggtcccacgcggtgtccatactagtggcggtcgtgaagcattcttctttccgagagcgtcgccgagtcgctgttcatcttcttcctcttatagcggagcactaa

SEQ ID NO: 62605 - DNA, 411 bp, Glycine max
  Peptide Sequence Number=SeqID_154290
atgtctgcaacatccaaggtcctgcctgctctccaccctatcaaatcattgcctcccaagttcaagattacttctggtaatccgactgctggtctaatggaaaaccatggagatgctaagttcagaagcaatgatgtgatcagatcaggtagtccagaaaatgatgctttgataggggaggttgctgaggaagctcagaactgtgctggtgacatgggtgtttacggtgaggacttggcgtacagcagaaaaggtgtgtcgttagaagacaggccatcaattgctgatgaagacttagaatctgttcctctgcccttcccatcaatttcaatgtcctctagggaacgcaggtggagtgatacaacaccttatgcttcaaagaaggagcttcagagtactcataagtcataa

SEQ ID NO: 62606 - DNA, 246 bp, Glycine max
  Peptide Sequence Number=SeqID_154291
atgtggaaaagaattgcggcaacaaaaatatccatcaagcaaatgccattgaagaacatgatcatgagtagcaccttttctatgctacccaagattctagtgataaaattggtggaaactagtactttagatagcggttgcagcaaaattacaaggctaaagatgggagcatctttgaggatattgatgactccatcattggaaatggtgtatctctctttttcccgccatgtcttaggcatgtga

SEQ ID NO: 62607 - DNA, 270 bp, Glycine max
  Peptide Sequence Number=SeqID_154292
atggacgaagaacattggaggtatgatactaccatttttgaagaagttgatatgaatgttgaaaatgaggaagacactagcgtggaagtagaacacgttgattgctctgatgcctttaatacttctcaactaattttgggaggagaaggatggatgatgaagttaatttgtgggactaacaatcgtgagatggcaaagtcatttgttaggcatccatatgcgggtcgactgattaaagatgagaagattgttgttgctgatatgatgtaa

SEQ ID NO: 62608 - DNA, 705 bp, Glycine max
  Peptide Sequence Number=SeqID_154293
atgatatatgttgtaaaaaatgtaaggatccccaagtatttggacttggaatggttctctccacaagggttcaaatttcctaatctgctagaagcacaaggattttcaaagctggtgcagatgaaagaaacttttgatccagagctagtcaaggttttctacacctgtgcatgtgttgaccttgaaggtaacctcttctctactataaatggagtagatatggttattgatgctgctatgtggaaggaagtagttggtctggacatgggtggagtccacaagttcgatgaaaagcttgatgggtacaacaagatgcagacttatagggaaaaatgcttcttgacccagtatcaagatgaattggtattactgattgaaggcattatgttgaagagtcattgcctagtggattataaattttcttatgttgtgtttgccttaagattcattgattacttcagtgttgatatctttaatgagattgtggactttaccaaagcgtcaagtgagattatcgaaaggcatatcaagaagcttgaaatgaggtttgttgatcatgaatggataatggctggagagctagtgatgcaatcctaccccccaagggcactggatagaagactccaagaagattggaccaaagatgcaagagaaggccataggattctcatgagccttaaggtagatttcgagcccataggctaa

SEQ ID NO: 62609 - DNA, 434 bp, Glycine max
  Peptide Sequence Number=SeqID_154294
agtctttagacaaagatgacagtgttgacggtatatctgatacagacgatgaagtcaccgacatgattcaaccaataagaattgttcacccagcagaaggaattgaaaatccattttggaatgatgctttgcattataacaatatcaactggagttatcttgatgaggaggacatttgcggtttggagatgccgtcgacctttaatgttggccaagaattatatgttggcatgaaatttgatagtaaagatgcggtcaaaaatgcagtcaaacaatatgttatgaaggtgcatcaaagtttcaaagttgttgaaaacaaatcgaacaacatgatcagagaagatccatcaataaaagtttctttgattcaagagaggattaatagtgaatttgcgtacaaggtgtcgtacaaaaaagcttggttggcgaaatag

SEQ ID NO: 62610 - DNA, 663 bp, Glycine max
  Peptide Sequence Number=SeqID_154295
atggcttctccacctgcctcgcctcctcctcctcctccttctcctcctccgccttcagatgcatcagcttcaccgtgtgccgtgaagcggacacgcaaagcctcacgtctacgatccttgtctaccagaccacctggtgctgacaaaccagtggtccacgttgatcctactaccgacaaggccgacaatccccacaggaagaaattaagaacatacttggggattgtggcgcgtgataaggtggatgtcatgtacgagaactggaaagaggcggaatttgaaatcctagaggcttctgacaataggacgaaaaagaagttgcttcagactgtcggcgaaagatggaggcagtttaaatcagacctcacgagaaaatgggcccttgcagccgatcaggacggtgtggacgacactgtctgtgagaaatacgacataagcaaggaaaaatgggcccagttttgccagactcgcagagatccttcttgggaggatgtgcgcaaaaaggcaatggccatccagaaacagaacactgccccccacgttttgtctcgtgggggttatgaatatttggagcagaagctcctggctgagaaaacaaagaagaagctggaggaagttgcacagtcaggaagcgttgatggcgtcatcgaccctccatcccca

SEQ ID NO: 62611 - DNA, 166 bp, Glycine max
  Peptide Sequence Number=SeqID_154296
atgttcaaccctcctgatatttgtgaatcacttaaaattagtgagaaaaattgtttccgtgaagaaaatccaagccgaggcgcttctgtaacgcttccgagacatttccgtgggcgatttcgcgaagattttccaccgttcttcatcgttcttcggtcttcaaccg

SEQ ID NO: 62612 - DNA, 809 bp, Glycine max
  Peptide Sequence Number=SeqID_154297
cagaagctcctggctgagaagacgaagaagaaggtgcaggaagctgcacagtcaggaaacgttgatggcgtcatcgaccctccatccctggtcagacgccacgtgaagtggaagatggcccgtacgaagaagacaggggagatgacgactgaggccgcaaagaaaattgctgagaagattgatgttctggccgttgctattggatgtccagagcaccctggacgtgtccgtactgctgagccgcagctgacccaacaaatcagggaccagctagaggagtctatcacaaagaaagtgacgaggcaggtcatggcatccttcagccagcttcagtcacagatgcaatctcagggacttgcagtgcctcctgagcctctggggagttgtgttgatccctcaagaaacgatcctgagacgggtgactctaactggtgcggcttgtacatagaagcagatcctgcctgcctggtttccatggggagagtttatgagggatccactgttgttcacaacactcctttgttgcctggccaagtaaaggtgagtgtggaggaggttatagatgcagattctccagttcttgtacctactgatgaggttttcttagtgggacaggcacttcacaccttccttgcttggccgacacatctggtagctgtgtctccgccaaaaccatctccgaagccccatccggaggtcgataatccgctgtatctgatggcattgaccatcccagagcttttcttgaggccttatcaggttagatgggatgccaccgtgttcggggtcgttaatccagatttgcccct

SEQ ID NO: 62613 - DNA, 159 bp, Glycine max
  Peptide Sequence Number=SeqID_154298
atgaagaaacaacaatggaagaaaagatgcagcggaagacaaaggagaagaggtgagaggaagcgtcatccactagggaataagccatggaagaaggagcttcaccaccaagatgagccttggattagaagcttggagaggatgcttcaatggaggtaa

SEQ ID NO: 62614 - DNA, 178 bp, Glycine max
  Peptide Sequence Number=SeqID_154299
atgtcgcgggggtcaggagaccttggggatgtcagggcgaggctcacgggtgcgctttccaaaggaggaaagatgcgcggagtcaccaccaacgaaggtattagcacctctcacgtcgacaaaagcggagtttttgctcctatgtaccctcctttggagaggaaatcagacctacgta

SEQ ID NO: 62615 - DNA, 804 bp, Glycine max
  Peptide Sequence Number=SeqID_154300
atggccaagttcgatccagacatagtcctcgaattttatgccaatgcttggccaacagaggagggcgtgcgagatatgagatcctgggtgagggtgctggaagagggtcaggagtgcgagtatggccagaggaggaaccggtccgatgggttcgatgaggaggccatcgcccatttgctatgtataccggggcaggattttgcccggactgctaccgggagacgggtgcggatcatgcgcaccaacatgaccaccctgactcagatctggatgactttgctgctcaacaacatccagcccaacgatcataattccgacctccccctgccgaagtgtatggcacctaccaggcaccctctggacccggataagtccaacagggccctgggttttcccgccttgatcacaggactctgccagtcgtttggagtccctgtcgcacctagcaaggtgattcggccgcccatcacccgagcttttattgagaagtattgcacacagagacaggccagggggatgtttccgcggccaaccaccgggctcatgtatagacccatgattgtctttccagatgagcctcagcctgcagagccagggttttacttcttatccgtgccctactacggatcagttcagagcagaggtcacttggcctggagattggccagaggcccgagcaggagaggcacctgcagaggcacctgcagaggcccagcagaggctcccaacgaggcagatgaggcccgtgaagacgaggagattgccgatttacttgatttctgggggggggggggggccacatga

SEQ ID NO: 62616 - DNA, 534 bp, Glycine max
  Peptide Sequence Number=SeqID_154301
atgggcccagttttgtcagacctgttgagactcctcgtgggaggatctgcgaaaaaggcacaggccatccagaagcaaaacatcgccccccatgtgttgtctcgtggaggttatgaatatttagaacaaaagctcatggttgagaagacaaagaaaagactagaggaagctgcccaatccggaagcattgagggcatcattgaccctccatctcccatcagacgccacgtgaagtggaagatggctcgcaccaagaaaactgggcagatgacgtctgaggcagcaaaggaaatcactgagaagattgcgtcacagggatcgttcatcccccatggacgtcaggatgttctaactgctgccattgggcgactagaactccttggctatgtccgtgctgctggagccggtgtcaccataaagcaatacttcggatcggctccacgaacctcccgcggttcttcctctatgcctcctgaagacctacaacagctgacccaacaaatcaaggaccagttggaggatttgatcacataa

SEQ ID NO: 62617 - DNA, 669 bp, Glycine max
  Peptide Sequence Number=SeqID_154302
caaaatctcctggttgagaagactaagaagaagctggaggaagctgcacagtcaggaagcgttgatggcgtcatcgaccctctatcccttgtcagatgccacatgaagtggaagatggctcgcaccaagaaaacaggggagatgacgactaaggccgcaaaggaaatcgttgagaagattgattcctttaaggagcaggcgtcacagggatccttcgtcccccatggacgtcaggatgttctcaccgctgctattggatgtccagagcaccctggacgtgttcgtgctgctggagctggtgtcaccatcaagcaatacttcggatcggctccacgaacgtccctcagctcttcctcgctgcctcctaaagaattgcagcagctgacccaacaaatcagggaccaattagaggagtcgatcacagaaaaatcccagatgcaatctcagggacttgcactgcctccggagcctctagttggtccctcaggtcctcgagtaagcataaaggagagttgtgttgactcctcaggaaatgatcctgagacgggtgactcagacatgtgcgaattgtacatcgaagcaaatcctgcccgcttggttgccctgggaagagtttatgagggatccaatgttgttgataacactcctttgttgtctggccaagtaaag

SEQ ID NO: 62618 - DNA, 279 bp, Glycine max
  Peptide Sequence Number=SeqID_154303
atggcaaaggggtgcgaaatgaccaaattttgtctccgcgtgtcatcgggcctgccgcctctggatgacaaagggtgcagaatgaccaatttttgtctttgcgcgccatcggacacggctgtgtctaaaatggcaaaggggtgcggaatgaccaaattttctctccgcgtgtcatcgggccccccgcctctggatgacaaagggtgcagaatcaccaatttttttctctgcgcgccatcggacacggctgtgtctgaatggcaaaggggtgcggaatga

SEQ ID NO: 62619 - DNA, 385 bp, Glycine max
  Peptide Sequence Number=SeqID_154304
atggcttctacaagtggagatgctactccaccatctccaaaaaccgcaaggctcatggcggagatgattaaacttgatgatcaaatgagaagaatgggttatgaacaagaagaaagaatggagagaatgagaaaggataatgaagagagcttgggaagaatacaaatgagtagtgaagctttaagtgtgaggattgaaaatatagagcaaagaagagaggacaaattatctaattcttctcaagcagaagatgaatggtatggagaggatgatggaggaaggaggaatatgaggtataggaagagaagaaatcataaaagatatggagggaggcaaagagaggaagggattgagggagtaaaggtgaagatccctacttttaaag

SEQ ID NO: 62620 - DNA, 623 bp, Glycine max
  Peptide Sequence Number=SeqID_154305
gactagacgtcttcgccatcagagggctacacatcgtcaacctccgagggctacacgccctcacctttagaggactaaacatccttgccttcagaggactacacgtcctccccttcagaggactacacgtcctcgccatcggagggctacacgtcctccccttcagagggctacacaccctcgccttcagagggctgcacgccctcgccttcagaggactacatgtcctcaccttcagaggactacacgtcctcgccttcagagggttacacaccctcgccttcagaggactacacgtcctcgccttcagaggactacacgtccttgccttcagagggctacacgccctcgccctcagaggactacacgtcctatccttcagagggctacacgccctcaccttcagaggactacacgtcctcgccttcagaaggctgcacgccctcgccttcagaggactacacgtcctccacttcagaggactacacgtcctcgccttcggagggctgcacgccctcgccttcaaaggaatacacgcttttgccttcagagggctacacgccctcgccttcagaggactacacatccttgccttcagaggactgcacgtcctcgccttttga

SEQ ID NO: 62621 - DNA, 309 bp, Glycine max
  Peptide Sequence Number=SeqID_154306
atgaagttgctgagaggaaaggagatcgcgttggtgaaagttcagtggggacccgacgagggtgattcaacctgggagttggaggatagggtatattgggggaaagatacgcgggttaggctaattaacgaagagaaatccataactggacagttattgaggtggcctctgctgtgtaactcgagtttggcctctggtaatcgattaccaatgctgtgtaatcgattaccagagaagaaaacccttgaggcataccttttaactacatgtagcggttatgggacgcattgtgttgttacccgtagttag

SEQ ID NO: 62622 - DNA, 600 bp, Glycine max
  Peptide Sequence Number=SeqID_154307
atgattatgaggggccaagacatttataatagccaagataaggctactacttcaccttcatttagtgaaagtgaagaagcaaaaggggaagaatctaataaagaaatctacccccaagaagaaggacaaccattagtggttaaagagaagtgtaaggaggtaagtgtttcctccaagaggttagctaagaaggaaactcattttacaataaagacaaacattaaagaaactttccctcttagacaacctccacattttctcttttgtaagaagacacttgctagcattgccacacctcttgtgcttgagtttattcctcaagtaaagaagttgttggatgagggtttggttcgcaagagcttaaatccttgtgctttgttggtgcccaaaataggtattattaggcaccaagtccctaaaaataggtgtgatcaacgggttcccatgaaccctaagagaataaaggtcattcctgagtggctcactccaccaagtgttgagggaaggagcccagagtatgaagaacctcgggatttgaggtcaaatcctttccaaggtggagggaatgatgcaatcctaccccgcaagggcattggctag

SEQ ID NO: 62623 - DNA, 216 bp, Glycine max
  Peptide Sequence Number=SeqID_154308
atggtgaatttcatgttatcctattcgggttcaagtgaaggattttggggtgaggctatgttggcagcctgttacttgttgaaccgaattcctaacaaaaggaataagagattggaacacatcatcgaaagtatcccaaaaggtgcaagaaagaaaatgactacctatataaccatgaagtttagccgcttcaagaagcctgggacttggctttga

SEQ ID NO: 62624 - DNA, 246 bp, Glycine max
  Peptide Sequence Number=SeqID_154309
atggctctgtgtatggattctttgagcctcaatgcatccaaaatagtaggaatgcgtaacaacaatgtcaagagtacattcaaacatggatccaagaatcataaaaaggaagtctacctaggagtttacttgaaccaacaacgttggcaacttgtggtgatctttcatagcgagaatgttgttgtatggttttgttccttgcacaagaatggtggccctaaattcaaaagcatggttaaccaataa

SEQ ID NO: 62625 - DNA, 189 bp, Glycine max
  Peptide Sequence Number=SeqID_154310
atgggtgccaagcacctcacgaggaccaaagaatggtcgcacgtcatcgagcaaaggtccccggacgaaattagggaaatggcaccgaaaaagctttccgcgaagagatctaggagggacgccgcggctgaagggaccagtgccgcccccgagtttgatagccaccgttttaggagtgccgagcactag

SEQ ID NO: 62626 - DNA, 268 bp, Glycine max
  Peptide Sequence Number=SeqID_154311
atggcttccatctcggaggtcatgttaaaactccagaaaactatagaggataaagccacgacaaccgcctccagtacatcgcaagcttacccttatgagctcagctccgaagagaggaaagagaccggttcacgggtgcatggaatgatcttaaaagaagagtctagctgcttgcgcaaggggccaaaaggagtttggctcccaccttatgacgaagcccggcaaagcatgctagctatcgatgaggaaggaagaattacccatctcg

SEQ ID NO: 62627 - DNA, 255 bp, Glycine max
  Peptide Sequence Number=SeqID_154312
atgtcgccttatcgggttgtctttggcaaggcatgccatcttcctgtagagatagagcacaaagcctactgggctaaagttttattgtataactctaggcttggactcatgagtgttgagatcaaaagtgaatccacagataagagcttcaaggtcaatggacagcggctgaaaccattcctcacaaatccctccttagtggatgtagtggtggaggagacctccttacttcaccctacttctcttccgccatga

SEQ ID NO: 62628 - DNA, 339 bp, Glycine max
  Peptide Sequence Number=SeqID_154313
agcttaactaatcagatgggacaattggctacacagttaaatcaacaacaatctcagaattatgacagattaccttctcaatctgtccagaatcccaaaaatgtgagtgccattacattgaggtcgggaaagcagtgtcaaggacctcaaccaacaatatcttcctcatccgcaaatgaacctgtccaacttcactctactccagaaacagatgatgacaaaaatttaaagagtaagttgcgtaacaatttctatgcaggtgaatcttccactggtaattctgacttacaaaagcagcatatccctcttccattccctccaagagcaatttccaactaa

SEQ ID NO: 62629 - DNA, 652 bp, Glycine max
  Peptide Sequence Number=SeqID_154314
aaagctctgctggattgttgccaaaaatggggagtcaagttttcattctcagctcatgaaagtggttggctggtgtttaaatttgagtctgaggacgatctgaaccaagtcctctctgcaggcccttacttcatatttcaaagacccctacttctgaaggttatgccagcattctttgactttggcaatgaggagctcagcaagatccctgtttgggttaaactcagaaatcttcctctggagctttggaatcctcaagccttagggaaaatcctgtccaagattggttcgcccattcgatctaaccattttacttcttctaaggggtctatttcttttgctaaagctttagttgaggttgatgcttctttggagctcattgatgaaatgattgggcaccgcctcactaattgtaaagttgtcactgggaataagtttgctctcatcacagcctcccccaccttggatcagccacaagtgggtgatttagcaatgcccccacataccaatacagtaggcccctctgataatccaaagactgttcagactaatatgtctgtccctcctcacagaaagcatattctggttgcaaatcatgttcctgtccttcataattcttctgaccttaaagaaacagggaacactgagtttg

SEQ ID NO: 62630 - DNA, 240 bp, Glycine max
  Peptide Sequence Number=SeqID_154315
atgatgacaaaggtgatgacaaaaagctcaaagatcaatcaaagaacaactcaagtaaatcaaagatcaatcaagaacaattcaagagttcaagataagaatcaagaagaattcaagaatcaagaagaaagtctagagacaagaagcaagattcaaggttcaagatctcaagaatcaagatcaagattcaagactcaagattcaagaatgaagagaagactcaatcaagataagtattaa

SEQ ID NO: 62631 - DNA, 207 bp, Glycine max
  Peptide Sequence Number=SeqID_154316
atgttgattgatgtgggaaatgctttggcatgtgcatgttgtgtatgttcgtggagggcgaagtgcactgaccttccagggtctttggcacttgctttgggccatgttcatacgttggatattgtgtatgttcgtggggggcaaagtgcactgaccttccaaggtctttggcacttgctttgggccacgttcatatgtcgtatgtag

SEQ ID NO: 62632 - DNA, 288 bp, Glycine max
  Peptide Sequence Number=SeqID_154317
atgcaaattttcattgaggcaatagacttaaacatttgggaagccatagaagttggaccttatgtacccaccatggtggctggaaatacaacaatagagaaacctagagaagagtggtctaaagaagaaagaagaatagtgcaggtgtcaaattgtaagagtgttaaggatatgtgggacactctacaagctacacatgagggaacaattgaggaacctgaaatggagttgcaaagactaaatcaacatgaagaaaatgataagaagaagaagggaaattgctcttaa

SEQ ID NO: 62633 - DNA, 231 bp, Glycine max
  Peptide Sequence Number=SeqID_154318
atggaggcctctggtaatcgattaccagtctgtgtaatcgattacacagagggatgggtcactggtaatcgattaccaggttttcatgtcctgaagctgtgtaattcgagtttggcctctggtaatcgattaccaaggctgtgtaatcgattatcggagatgaaaagcctaaagataccccttttacttgcatgtagtggttatgagacgaattgtgtgcggcatagttag

SEQ ID NO: 62634 - DNA, 472 bp, Glycine max
  Peptide Sequence Number=SeqID_154319
ggcgcaggagacgacgttagtctctgcgtgctatcaggcttttcgtcttacagatagcaaaaaggtttatacggatgaccactcgggtatctccgctcgtcagcgtgactcaaaagtcagtatggcagatcttgtgagcgcggagatgacggcgcaggagacgacattagtctctgcgtgctatcaggcttttcgtcttacagataacaaaaaggtttatacggatgaccactcgggtatctccgcccgtcagcgtgactcaaaagtcagtatgacagatcttgtgagcgcggaagatgacgtttttcgtcttacagatagcaaaaaggtttatacggatgaccactcgggtatctccgcccgtcagcgtgactcaaaagtcagtatgacagatcttgtgagcgcggaagatgacgagacgacgttagtctctgcgtgctatcaggcttttcgtcttacagatagcaaaaag

SEQ ID NO: 62635 - DNA, 456 bp, Glycine max
  Peptide Sequence Number=SeqID_154320
atgccacctgacaggtcgactcctttagaggcccaaaagatactgagaaatggccccaaggaagcttgcctcaaagagatctgcacaggaaggataaagcggctgaggaaccctcatcaggttgacctagttgggtcatttgacacggagaggtatttacggcatttggttcgccagcaggcggccaaccaccgggcgcacttcagggcagaggtgcatggccgggagattggcctgaggcccaggcagtggatccttttcgatgcggatgccctcagccaattcttgggataccctttagtgctggaggagggccaggagtgcgagtatggccagaggaggaaccgggccgatgggtttgataaggaggccatcgcccaattgctgtgtataccggggcaggattttgcccggactgctgcggggagacgactgcggatcatgcgcacaacatga

SEQ ID NO: 62636 - DNA, 182 bp, Glycine max
  Peptide Sequence Number=SeqID_154321
gatcgacgttgaccacaggtcattctgccccaggtggtctagtggccaatgatcgtagccgtgtcgccttgcgtgtccgcttcaacgtagatggagatgctgatgcgtctacaggaggaggaggtgtagatgcaattggctttgatgttttgatgatgatcatgatggtgtgttgcaattga

SEQ ID NO: 62637 - DNA, 177 bp, Glycine max
  Peptide Sequence Number=SeqID_154322
atgcgggggtccggggaatttgtccccttcctagatacgacgtctaggggtagcaaaatgccccaacgtacgtttttaagaaggcgacatggaccctccgttgttgtgaaaaatggcacgcagcgtattcgctccgtgcccctatttaagggacctataagggagagaactaactag

SEQ ID NO: 62638 - DNA, 1091 bp, Glycine max
  Peptide Sequence Number=SeqID_154323
caaggagtagaatcgtctcaggccacggtcagaagtcaagacaaatcaatggcagaaatcaaccaagggtcacgaccgaccgatcgttgccccttcccggcgctaaacaagcagagaacatcgctacaaggcagcccaaaatggccccgaggaaacttgcctcaaagagatcctaaaaggataaggcggccgaaggaactagttccgcttccgagtatgatagtcactgttttaggagcgctgaacaccagcagcgcttcgaggccatcaagggatggaggagatagttcgccggcggtgggtatcactggttacccctatggccaatggatctcgtttgatgccgacgctatcggccagctcctgggatatccgttggtgttggaagagggccaggaatgtgagtatggccagaggaggaaccggtctgatgggttcgatgaggaggccatcgcccagctgctatgtataccggggcaggatttcgcccggactgctgcagggaggcgagtgcgaatcatgcgcaccaagatgaccaccctaacccagatatggatgacgttgctcctcagcaacatcctgcccagcaatcataattccgacctccccctgccgaagtgtcagctggtgtacgccatcctgacgtggatgagcgtccatgtggctcagttaatcgctgatgccatttatatttttgcaggtatggcgcctaccaggcatcctttggatccagataagtccaacagggccctgggatttccctcgctgatcacaggactctgccagtcattcggagtccccgttgcacctaccaaggtaattcggccgcccatcacccaggcttttattgagaagtattgtacccagagacaggctcaaggtgatgctccacaggctgcaggcgcgccaccaccacctcatcaggctggccaggctggggcatttgacatggagcagtatttacggcatttggttcgccagcaggcggccaaccaccgagcacatgtacagacccatgattgtctgtaccagatgagcctcagcatgcagagccagggcttcccttctttttcatgccctactccagacca

SEQ ID NO: 62639 - DNA, 1050 bp, Glycine max
  Peptide Sequence Number=SeqID_154324
atggcatctaagaaaaggaaggcaccttttacacctacccaagccagatttgatagattcaggttcacatctcaagaggcttgggagagatacacggatattatggtgcctaggaagattctacctgaaaggaatgtcattctccatgactctgagttcgatgaatttactgaagaactcaagagtagaaactggcacaaggagttgacaaactttgtggatggcagtattgatgtggccatcataaaggagttttacgcaaacctctacgaccctgaggataaaccacctaagcaggtgaaggtgagaggtcgtttgatgaaattcgatgcagacgccttgaactcattcttgaagaccccaatgatacttgaagagggggagaactttccaatatactctaggttctatcattcgaagccagaaccacatgaactagcagctcgattatgcatccctagaaggggatttgagttaaatgctgatagactaccattaaatatcttatggaagaatctaaccacgctcgctcagacatggagcggtttttctttttctaacctggtccctacctctcacacctctaatatcacattagatagggctagccttaatcacactgctctgtgcaaggcaaggggagtcgtttctgattcattgacattggagagccttggtccagctactaatgtggcttatgtaaagaaaaactggtggaacctagatgacctatcagttaccttcagagggtcgcgcaaggccaaggggaagaggtctgaggctcccccttcctcagctcccgcaccaattccagctgccccatctgcatctacatctgttcttccaattcctttatctacaagaccatcagattttatttttacaccacagatgctgcactccatgctccagagtatccacaggagatcttcttcatcaatggattcctttgcttcttggaagatgaatgacatcgaaatggagaaggaagagagagagaagaggccacttcaaggagaagatgagtctagaagaagctcaccaccatag

SEQ ID NO: 62640 - DNA, 225 bp, Glycine max
  Peptide Sequence Number=SeqID_154325
atgcacgtggttgggcatgcgtttaaagttaccttgtacaaaaaactatcgggcatggtatcaaggtatgctttaaatgaaattgctgctaagtatgagcatgtaccttatgcaggcaaaaacccttcacgttgtggatgtgtcatgaggagtactcacggtcttccatgtgcatcggatgctaactgtggtcaccaggcaatagctgcgttattgggtatgtaa

SEQ ID NO: 62641 - DNA, 648 bp, Glycine max
  Peptide Sequence Number=SeqID_154326
atggcggaaccatcaaagaagcgaaagggctcttcgagccgaagccaacggcattccgagactcagaaaacgcagattccttcctccatttcctcttcctcattgttctcatccgaagaacaacagatacggtacccaaatcttttctcttctcgttccattattgatccaaaattcattgacatggatttcttttccaatgagagttttgaatgcattcaggcatttgagaactccaatctcattcctttcatgtctttaaaattacctgtttattctgaattagttaaagccttctattctaatcttgaaattcaagaaggcactttaatttctgaagtttatgggataaaaatggtcattgaccaatccctattctatgacttgacccaattatctagtgaaggtgtaccatttgaaggtacactgaatgatgattggaaatttgatttctctgtgcatgatgcccgccggttggtttgcaccaatcaagcggatatgaccgaaaggcttcttgccggttcattggcttttgaaggccgcatccttcattatctaattgtgcgtattttgcttccaagatcttcaaaccttgcacaggtttctgaggaagatcttattgtcatgtgggcttttcatacaggctaa

SEQ ID NO: 62642 - DNA, 237 bp, Glycine max
  Peptide Sequence Number=SeqID_154327
atgagggacgacaagagatcttcgtacgtcattgggattggggtgaattctagaattggcctcgggggaaagtttctcatcgcgttggaaccggcaccaaagtgggcattgtcggtcgggcaagtcgtagttggagtcggagcttggggggcctccctctggatgggggtgggcgctctaggttgtacgggtgctgaattggaggagctcccagcgcgagctgagaagctcagatga

SEQ ID NO: 62643 - DNA, 246 bp, Glycine max
  Peptide Sequence Number=SeqID_154328
atgcacagggacagaacatacatccccataattgggtttcctaaccccaactatgtgatccgatggcaagcaaaggcggctcgtagcgatcactggtggtcaatgggggtggaggaagaggttgggggtgttggggaagggtatagtggaagagaaggagaaggaaatggctcttttacactgttggacgtatttgtagcctgcaacactcgcccaagcaaaatttggctcgcctgggcgagctga

SEQ ID NO: 62644 - DNA, 183 bp, Glycine max
  Peptide Sequence Number=SeqID_154329
atggagaattggcgaacagcgctaggcaatgaattcatggggctccgaaaaaaagtggagaatggagaattcgcgaacagcgctaggcagtcaattcgaggggctccagactcgaaggcctccagactcgtttgtggaggatgcatgaacagcgctaggcaatattcatggggctccgaataa

SEQ ID NO: 62645 - DNA, 163 bp, Glycine max
  Peptide Sequence Number=SeqID_154330
ttcaagtggagggtacatccacttggttgttcaaagagaacaaggaaggatagcaaatgagactttttcattgtcttggccggaagacgctgacatctccggggaaggtgctgatgacgatgttagtcaatgcatgctatcgggctttgagtctgacggatag

SEQ ID NO: 62646 - DNA, 45 bp, Glycine max
  Peptide Sequence Number=SeqID_154331
atggagaagatacatggagaagatgatgaagaacaaggaattaaa

SEQ ID NO: 62647 - DNA, 204 bp, Glycine max
  Peptide Sequence Number=SeqID_154332
atggaggagacacatggagaagaagatgaagaacaagaaattaaagccttggatcttcttcatcaatacatgatgcagctccatgtggaacttgtaggccttggatcttcttcatcaatggagtcctttgcttttggagatcaatggcaatggaatggaaaagaaggaaaggtgattgcagacgccacttcaaggagaagatga

SEQ ID NO: 62648 - DNA, 105 bp, Glycine max
  Peptide Sequence Number=SeqID_154333
atggaaaaatccgacaagaggaatttcaaagagaagaaagaaaagaaagcatacatcacttgggaagataatgtcataaattcttcaagttatgttgattattga

SEQ ID NO: 62649 - DNA, 664 bp, Glycine max
  Peptide Sequence Number=SeqID_154334
atgtggctacatccagaagattcatctaccagtcgctgcaggaagcatgcatggtctctcgtggaggagacaaaagcgacgaatgtctgtttcatctcgggaagttacacgacatggaaacctgccccgcggtggaagagctacttcaacggctcatggactgggggcagctcgatgtgtctgagaggtagggaagaaccacagatttgcacgcagtcggcagaaaggaaggctccaccaacccccaaagccctagtaatatgtttcactaggaatatgaccagccccaggtccgagtacccccagacagtgcccaagccgacgccattttccaatcaaagcaataaggtcgtcccatggaaatatgcccctcccgcttttggagaaggggctgcaaccgaggttgactccttgtcagccaaggtgaccaacattaccggccttagtggagtaacccgcagtggccaggtgttcgctccccctcactcagcggaattgccctccaaggggaaagcacccatgacccaagagtccgcaggcgcggccaccccctcaaaagaagtggatcccccgatagtaaagggagctaaaaagaaggaaggtctccaaggaagggaggtgaccttggaagaggctcatgagtttcttcgtctcatccaacaaa

SEQ ID NO: 62650 - DNA, 756 bp, Glycine max
  Peptide Sequence Number=SeqID_154335
atggccccgaggaagcttgcctcaaagagatctaggaaggataaagtggctgaaggaaccagttccgctcccgaatatgacagccaccgttttaggagtgctgagcaccagcagcgcttcgaggccatcaaggacgacgagtataccaacttccaggaggagatagttcgccggcggtgggcatcactagttacccccatggccaagttcgacccagacatagtcctcgaattttatgctaatgcttggcctacagaggagggcgtgcgagatatgcgatcctgggtgaggggtcagtggatcccgttcgatgcggatgctctcagccagttcctgggataccctttagtgctggaagagggccaggaatgcgagtatggccagaggaggaaccggtctgatgggttcgatgagaaggccatcgcccagttgctatgtataccggggcaggattttgcccggattgctgctggaagacgggtgcagatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatctatctatttgcaggtatggcgcctaccaggcacccttctagacccgataacttcaacagggccctgggatttcccgccttgatcacaggactcttgcca

SEQ ID NO: 62651 - DNA, 504 bp, Glycine max
  Peptide Sequence Number=SeqID_154336
atggtcattaaccaatccctattctatgacttgacccaattatctagtgaaggtgtaccatttgaagttcgatatcgcatgcataaggcattgcgattaaatgctccattgccatatccacacctagtcaccctctttcttcaacacttcaacatccctcttgattttgaaccttatgttccaatcaagagatcctttctaataggcgctgcagtgattgcatcctttggttaccgcatagagcataatggctcttgggtgaaaaagggtgctcaacccattgatgaagaaggacacttacatggtggagaagattcctctcttcttcaaaagattttggacaggtttgatggtcttcaaacctttgttggtgaaaggtttgatactttggagttacaagtggacatgcgattcaatgagatggaatcaaggatcaccatggtcgaagaagatgtctcttacattcgtacaagctttgatctaccaccaccaccgccaccataa

SEQ ID NO: 62652 - DNA, 550 bp, Glycine max
  Peptide Sequence Number=SeqID_154337
tcttctctctcccgcggttcttgttcttcattggtcttcttcccagcagtcttcttgccattggtcttcttcccagcagttcttcatttggttccctcccttcgtcttcttcattggctttctgtgagcgtttcttccgccattgaggttgaagatgaagttcttccgcaagaagaaccttcttctgcgcgtgtgttaggggatgaaaatggagcctacggaagaaggtgttctgctccattttctgctcgcggaagaacctgcgaaccttcttccgcaggctttcaatccttctcgtggaagaacctaccaaacttcttccgcaggatacattttgctgctgatgttcctcggcatcgtaggcccactgcctcaacacgtaggcaacgggttacccagagagtcaaggatgttcctcagttgcctgaggatgttcctcagttggctgaggatgtgcctcatgcgtctgatggtagcctagagaggacaggagccgccgatggtgttgagacagatcgagtggctagtgatgtagaagcaaagcttcatg

SEQ ID NO: 62653 - DNA, 255 bp, Glycine max
  Peptide Sequence Number=SeqID_154338
atgacgaacaaggccaaaggaaaaggcaaggaggtcgccggaaaaggttcttccggaaagcgcaagggtgccttcgacgatgacaagattggtggcggccgaaagagaaacaagcgaggccctgttcgaatgaactggtgtctcctgttattttttttggattcgttggcgtgcaaacatgagacgggcgacctttggagagtcttacggctttcccagataattttaaaaacaaccccgaacaggggtacttag

SEQ ID NO: 62654 - DNA, 234 bp, Glycine max
  Peptide Sequence Number=SeqID_154339
atgaataatgagaatgtattctggaactttgcagttaatcaatcggcaaatatttctgatattaagtgtgatattcccgaattgaaaggggacaattataaggtttggagggagaaaattctccttcgtttaggctggatggatattgactatgctattaggaaagacgaaccaccaggcattactgaaactagcactccagacgttgccgatctttatggtgggatcctctag

SEQ ID NO: 62655 - DNA, 144 bp, Glycine max
  Peptide Sequence Number=SeqID_154340
atgggcgaggaagagaaaaaaccagaggaaaacaaagtggaggagaaaaaagcaaatgaagaagaaaagaaaaaagagaaaaaaccagatgaatcaaaagatgacaaggaatccaaagaggaatctgcgctgcaactttcgtag

SEQ ID NO: 62656 - DNA, 318 bp, Glycine max
  Peptide Sequence Number=SeqID_154341
atgtctcttgccactctctttgaaaaacttcaagaacatgaaatggaacttatgagactccatcaacatgaagagaatgatataaagagaaaaggaatagcactcagagcctcatcatcttttattcaagaagaaagtgacaaagaggacttgactgaaacagaagaagatgatgatgatttcagactctttgtgaaaaggttcaataaatttctgagaaacaaaagaaataacagggaatcaaacatcaatacaaagaagaaagaagaagactcctccttagccccaacatgctatgaaagtaatcaacctgggcac

SEQ ID NO: 62657 - DNA, 462 bp, Glycine max
  Peptide Sequence Number=SeqID_154342
atgggggtttttccctttctgctttgtaatctttctgcaatgccaggtgccaacttgttggcaatgggttcctcatcagattctacttcttctaggtcaatgaggtcacctggagcagagaggacttcagcatttggggtggaggatgttggaacatctttatcagcatcagggacagaagcattttttcagaatgctactcacaatactgcggatcttcttatccatctccgtgtctacttccctaggacttgttgcagggctagggttttcaggaaatcttcactccctgttgtcttttggggaccagtttctcaggaacaggggcttgaccaggaatcatttgtatgggttggatatttgaattcaggttgctcctggtgcggagatgatggtacagagggtgaaccaggagctgcagtatcttttggtgaggtagccatggagaagcagagcttttga

SEQ ID NO: 62658 - DNA, 378 bp, Glycine max
  Peptide Sequence Number=SeqID_154343
atgaaggtgaaaacgtgtagtcctcttaagatgaggacgtgtagtcctctgaagatgaggatgtttggtcctctgaaggtgagggcgtgcagccctctgatggtgaggacgcgtagtcctctgaaggtgagggcgtgcagccctctgatggcgaggacgtgtagtcctctgaaggtgaggacgtgtagtcctctgaaggcgaggatgtctagtcctctaatggcgaggacatgtagtcctctgaaggtgaggacgtctagtcatctaaaggtgaggacatgcagtcctctgaaggtgagggcgtgtagccctttgaaggcgaggacatgtagtcctctgaaggagagggtactagtacccaagggtccacccttatga

SEQ ID NO: 62659 - DNA, 400 bp, Glycine max
  Peptide Sequence Number=SeqID_154344
cagaagctcctagctgagaagaccaggaagaaactggaggaagctgcacagtcaggaagcgttgatggcgtcatcgaccctccatcccctgccagacgccacgtgaagtggaagatggcctgcaccaagaaaacaggggagatgacgactgaggccgcaaaggaaatcgctgagaagatcataagtcattttcaagatgttatcaccgctgctattggacgtccagagcaccctagacgtgcctgtgctactggagccggtgtcaccatcaagcaatacttcggatcggctccatggacaaaaagtgactcggtagctcatggcaacgttcaactagatgccgtcccagtttcagtcccagatgaaatctcagggacttgcattgcctccggagcctctg

SEQ ID NO: 62660 - DNA, 270 bp, Glycine max
  Peptide Sequence Number=SeqID_154345
atggttaaggaggagtgtaagggaggtattattaggcaccaaatccctaaaataagtgatatgatgaatgtgttgagtgttgccaccttcttttgtaaaatcggtcatgcacacaacatcttcatgattcatgtacatagggactcattaggtaggaataatcaacacaaaaatatagaaaaaggggttcccatgaaccctaagagaataaaggtcactcctgagtggcccactccaccaagtataagaaaaatttggggcttcccatga

SEQ ID NO: 62661 - DNA, 297 bp, Glycine max
  Peptide Sequence Number=SeqID_154346
atgccatcactcagaagtggagaatgtcttagaccctttgggaggcatataagatggataggagaacttgcgtttatcgcaaatggcctcgctgctatcccaattctcccaggagaactttatactgccccacggccacgcgctgcatatgggcatatggcagtggcacgttctgtgaccccgttcgtccagcatgcatattatgctcggaatcatcaggatagaagtagacgcgcgcccgtcgtcggagaccacacgatcgacgacatcagcacgtcacaaggtcctacggattag

SEQ ID NO: 62662 - DNA, 135 bp, Glycine max
  Peptide Sequence Number=SeqID_154347
atggaggttgaggaaccttgggtggggttatggctaccattgaattatcgagtggatatgggatcaagtttagcatatgacaacggaatttggggtgaaccctacagggggccttcgtcattgaaagtgcggtag

SEQ ID NO: 62663 - DNA, 748 bp, Glycine max
  Peptide Sequence Number=SeqID_154348
gatgttctcgctgctgctattggacgtctagagcaccttggacgtgtccgtgctgctggagccggtgtcaccatcaagcaatactttggatcggctccacggacgtcccgcagctcttcctccttgcctcctgaagaattgcagcagctgacccagcaaatcagggaccagctagaggagtccatcacagagagaggacttgcagtgcctcctgatcccctagttcgtccctccgatcctcaagtgagcataaaggggagttgtgttgatccctcaagaaacgatcctgagacgggtgactctgataggtgcgacttgtacatagaagtagatcctgcccgcctggttgccatggggagagtttatgaggaatccactgttgttcataacactcctttgttgcctggccaagtaaaggtgagtgtggaggatgttacagatgcagatgctccagttcctgtacccactgatgaggtttccttagtggggctgacacttcacaccttccttgcttggccgacacatctggtcaagtctttatcacagcaggtagctgtgtcttcaacaaaaccaactctaaagcccgatctggaggtcgatgatccgctttatctgatgacattgaccatcccagagcttttcttgaggccttatcaggttagatgggatgccactgtgttcgaggtctttaatccagatttcgccttctacataaagcatgaagacctctctgaaatcgcacacggtg

SEQ ID NO: 62664 - DNA, 587 bp, Glycine max
  Peptide Sequence Number=SeqID_154349
aggggcgccactagaggatgagctcacgcctgtcatttcacgaggtttcaataagaccaacgtggaggcacttcataaggtccgcaaggcatgggaggtgtttcaaaagaaggacaaggaactcaggggcagtaacaatgggcccatcggtggctatcgtaagtggttaaaagcccacgtgcaaggtttagattggcttccaagtttgagaaccgctaaaagagaggaagttgaggcaccggaggaagacgaagaagtgcaagcccttagggcagaactcgaggcttgtagggaagaacatggccggaacaaattccgaggggctctgtgggagaccaacatgttagctatcgtcagcaaataccaagaagagctcaatctagccacggcccacgagcataaagtggcagacgagtatgatagaggaagggtgatcaactcgttacatcaagaggcaacaatgtggatggaccgatttgctcttactttgaacgggagtcaagaacttccccgtttgctagccaaggcgaaagcgatggcagacacctactctgctcccgaggagatccacggacttctcggctatt

SEQ ID NO: 62665 - DNA, 357 bp, Glycine max
  Peptide Sequence Number=SeqID_154350
atggcagcgcagttgatccatgatcgcgttgtgatggagtgcctagaggtacatccggagcaacccgcacgcacacttcagcagcctgtggagtggatactacctacacctactccatatcgactagttgagccagttcaagtgatagaggtgtcatcctctgaaaaggatcttgaagaggacccagaggagttacctcctgaacctgctgtggatgcccttgacttcccagaggatgatgaggacccactccctgatgttgattctccagaggatattatgccagcatctgaggcaaactctacagaggagagtggccctggagggacaacgaatagtgacaactcttcatcgtag

SEQ ID NO: 62666 - DNA, 258 bp, Glycine max
  Peptide Sequence Number=SeqID_154351
atggagaattgcactaagaaatcactacgcaaagcttcaaactcgaaggtggaggttgagaatggagaattgcacaaagcaatcactacgcatagctccaaactcgaaggtggaggacacatgaacgaaaacgcaattcatggggctccgaaaaaggcaatcactacgcatagctccaaactcgatggtggaggacacatgaacgaaaacgaaattcatggggctccgaaaaaggttgagaatggagaattgcactaa

SEQ ID NO: 62667 - DNA, 141 bp, Glycine max
  Peptide Sequence Number=SeqID_154352
atggtcctttttggtaacctggttcagcctcctataagtcaatgcagactctccaactgttctgcacccgaaggcttcaattctggtgtggtcggttggacagtggtagaaggagatggtttctcatcctttacctcataa

SEQ ID NO: 62668 - DNA, 318 bp, Glycine max
  Peptide Sequence Number=SeqID_154353
atgggggaggcacatgaggcaccccgagaccataatctagctaactttgagcctcacctcggatatgccgctcgggggcaggcattttgcggcgtacccctgccaaacactttgggggagccctcagtatcacccacaaccacaacccttgcattttgtgaggggaagagtccctcctgctatggtggaaagggagaaattcaatcatatggagggaaggctgaggaggttagtttagttattagaggggtgtgggtagttaagactctagcttctcaaagaagcctctcaaggaagcttctcaaagaagcctcatga

SEQ ID NO: 62669 - DNA, 510 bp, Glycine max
  Peptide Sequence Number=SeqID_154354
ctcttgtgcctgtcaaaaatgaagatggaacaactaaacaaactgttgatgacattaagcactatcttgatggtaggtatatttctccttgtgaagcttgctggagaatattttcattccagattcacaagagatcacctgctgttgaaaggttgtacttttatttgcttggtgagaattcagtcatatttgaagatggtgatgaaattgatgccttgctgtccaagctaaccattaaagagtctatgtttacctcttggctgcaagctaatgccattttccaacaagcaaaagatcctacatatctgcttaactgggtgcctccaagtactagagaattgtattatcttaggatgatgttggatgtagttaaagggccaacaacttatgaacaaattcatatagtcaatggtcaattgtattctacatttagagaagcttgctttgctatgggtttcatggttaatgataaggaatatattgaggctttaagagaagcataccattggg

SEQ ID NO: 62670 - DNA, 399 bp, Glycine max
  Peptide Sequence Number=SeqID_154355
atgaaagtgagcaaagactatttgaactttcaaccttgtactttagaaggtgcggaagcaaacaagtggagatggtttgagagatgtattggagcacttgatgggactcatattccggttacagtttctcctgatgagagacctagatatcgtaatagaaagggtgatgtctctacaaatgagattctcgagtattacgagatgcattacgtcatcaaaacaaacttgaaattccaactggtatgtattttcttgtggatgcgggatataccaatggtccgggattttgagcacgagatcgagggactagatatcatctcaatgagtggattggaaacacccctcaaagttacaaggagttatttaatctttgtcatgcaagtgcccaaaatgcaatag

SEQ ID NO: 62671 - DNA, 135 bp, Glycine max
  Peptide Sequence Number=SeqID_154356
atgggtgatcaagaggagacgcagaaacagatgaaagccgacatgtcagctttgaaagaacaaatggcttctatgatgaaggccatgctaggaatgaggcaactcatggagaagaacgtggccacccctgccgct

SEQ ID NO: 62672 - DNA, 416 bp, Glycine max
  misc_feature (17)..(17): n is a, c, g, or t
  Peptide Sequence Number=SeqID_154357
tttgtctcaacacattnggagggtacatcctttgtggtacaagtagagggtacatctacttgggtttgactaagaacaagagagggtacatctcttgtggatcagttctagtggagggtacatccactaggttcaaagagaacaagggagggtacatcccttgtggatctttgcttataaaaggatttttacaaggttttgatagttgtttgttagatccaaaaacaaagtcaaaaggaagggcaaaatggtcatttttccaagatttcaaacatccactcgcccaggctagcaaccagctttcctgggctaataagatttcttcatccataagcaaccaacttgcctgggcgagctacaactcgcctgggcgaattggtgcctttagcactaagtcacaaattcgcctgggctaa

SEQ ID NO: 62673 - DNA, 303 bp, Glycine max
  Peptide Sequence Number=SeqID_154358
atggaggtcaatactgctacagttgttgccacaagtaccgccacagaggtggacccgactcacccacctggtttcaatcaagtaaatcgtcctacctcggatatggtaggttcagaacaagcattccttccccccatgtggattgcctcccaacttacaccacccaatgttgtacacgctcccgatgagaatgtcgacaactacgcacccgtacccattaaaagccaacaaccccaatctgatcatgcacatgtctctcaacccatgggggagacaatgaagtaccccgaggccacactctag

SEQ ID NO: 62674 - DNA, 525 bp, Glycine max
  Peptide Sequence Number=SeqID_154359
aaggtccgcaaggcatgggaggtgttgcaaaagaaggacaaggaactcaggggcagtaacaatgggcccatcggtggctaccgtaagtggttgaaagcccacgtgcaaggtttggattggctcccgagtttgagaaccgctaaaagggagaaagttgaggcaccggaggaagacgaagaggtgcaggcccttaggacggaactcaagcaagctcaaatagtcaaagaaaggttcaaatcagcagctctgaaaatccgaaaggagaataccaaactgagagatgaggctagaggaagggtgattgactcgttacaccaagaggcaaccatgtggatggaccgatttgctcttaccttgaatgggagtcaagaacttccccgattgctagccaaggccaaagcaatggcggacacctactctgcccccgaggagatccacggacttctcgactattgtcagcatatgatagatttaatggcccataaaccgctagggaacttgtattgttactcagatcttgactag

SEQ ID NO: 62675 - DNA, 180 bp, Glycine max
  Peptide Sequence Number=SeqID_154360
atgaagcatagctccaaactctttggtggaggatgcatgaacgaaaacgcaattcatggggctccgaaaaaaaggcgaggatggaggattgcactagagggatgcttaaacgaaaacgcaattgatggggctccgaaaactaggcgaggatggaggattgcactagagggtcctcactag

SEQ ID NO: 62676 - DNA, 507 bp, Glycine max
  Peptide Sequence Number=SeqID_154361
atgactacacaaatgcaacgtatgttgaaccgtaacaatgaagagctctatgaacaaattgaaggattggagaaccaattgaatcagaatgttggaagacattatggtgggtacatagggggcaatgatggacctagacaaaacagaatggaggggcagaacaaaattgagggagaaaaactcaatgtacctcctttcaaaggcagaagtgacccagacgcctaccttgacttggagataaagattgagcatggaagtctggctgtggaggagtactacaaagagatggagatgacactagtgagggcaaacattgaaaaggaaactgaggacacaatggctcattttctaagtggcctaaatcctgacattagagatgaaaagcacaacaagaaggaactcattcaataccttcaaccagaactggaccaacagatccaagaaggagggaggcaattcgtccagcccatcaacacaatccccacatggaaagttagcagtacctag

SEQ ID NO: 62677 - DNA, 506 bp, Glycine max
  Peptide Sequence Number=SeqID_154362
gtgatggcatccttcagccagatgcaatcccagtttcagtctcagatgcaatcacaaggacttgcattgcctccggagccataggaaaactttatgagggatacacagcggttcacaacatccctttgttgcatggccaagtgaaggttggtgttgaggaggttaaagatgcagaggcttctgttcctgtacccactgacgaggttgccttagtggggcaggcacttaaaaccttccttgcttggctgacacatctcgtgaagcgtttatcagaacaagcagctgtgtctccagcaaaacctccagaaagcccggatcatgaggtcgatgatcccctgtacctgatgacattgaccatcccacaactgtttttgaagcctctccaggttatgtgggatgctaccatgtttggggtgtttaatcaaaacttctcgttgtacataaagcacgaagatctctctaaaattgcacacggtggtcaatgtctcaacatatctgttatatag

SEQ ID NO: 62678 - DNA, 144 bp, Glycine max
  Peptide Sequence Number=SeqID_154363
atgccaagcacctcacaaggaccaaagaaaggtcgcatgtcatcaagcaaaggtccccggacgaaattagggtatgacaggttgaccggattcatctttgtcaagataacaactggtgttcataggagtagccaagtgttttga

SEQ ID NO: 62679 - DNA, 184 bp, Glycine max
  Peptide Sequence Number=SeqID_154364
tcctttcgctaagcacaagcctcgcgctaagcgcatcttttgtcatgtgctaagcggagagtctctagcgcttagcactcaacccttgcatctcaagctgatttggtccgctaagctggccaaggctaagctaagcccatttcaattcgatctaaattcggctaagcgatggcctgctcactaa

SEQ ID NO: 62680 - DNA, 249 bp, Glycine max
  Peptide Sequence Number=SeqID_154365
atgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttggctttagttcaagttgtaataagggcccaattggcaacctaggcatcagccttttgggagaccaaatggtggctgacttgttggctgttggggggtga

SEQ ID NO: 62681 - DNA, 543 bp, Glycine max
  Peptide Sequence Number=SeqID_154366
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcttatgaatttctaaaaagtccaaatctcagcgcaggaattagaccgccaaaggcaagtcgaaaatggggtggtcggaataccgagaaaatatttggagggagtcctctttccaaatgtggatgggttggtggacctggcagcgatcgacgttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttttccaagaaggtaggcccgtctatccgctacaaggttaccactcgtgcgtcgaaaaaggaaaggcgaattggaaccaactcttggctagcatgggggggggcgtctgttaa

SEQ ID NO: 62682 - DNA, 432 bp, Glycine max
  Peptide Sequence Number=SeqID_154367
atgcataaggcattgcaattaaatgctcctttaccatatccacattcagtcactcttttccttcaacatttcaacatccctcttgattctaaaccttatgttccaatcaagaaatccttcttgattggtgctattgtggttgcatcctttggttaccgcaaagagcgtgatggctcttgggtaaaaaagggtactcaaccaaatgatgatgaaggacaattatcggttgaaggagaatcttctctccttcaaagtattttggacaggttcgatggactccaaacttatgttggtgaaaggtttgatgctttggaacaacaagtggacatgcgattcgacgagatggactcaaggatcacaaaggttgaagaagatgtcaccttcattcgcacatgctttgatctaccaccaccaccaccaccatcgtcttag

SEQ ID NO: 62683 - DNA, 732 bp, Glycine max
  Peptide Sequence Number=SeqID_154368
atgcaatcccagattcagtcgcagatgcaatctcagggacttgcactgcctcctaaccctctggttggtccctccggtcctcgagtgagcacaaaggggagttgtgttgatccctcaggaaacgatcctgagacaggtgactctgataggtgtggcttgtacatagaagcagatcctgcccgcctggttggcatggggagagtttatgagggatccactgttcttcataaccctcctttgttgcctggccaagtaaaggtgagtgtggaggaggttacagatgcagatgctccagttcctgtacccactgatgaggtttccttagtggggcaggcacttcacaccttccttgcttggccgacacatctggtcaagtctttatcacagcaggtagctgtgtctccagcaaaaccacctccaaagcccgatccggaggtcgatgatccgctttatctgatgacattgaccatcccagagcttttcttgaggccttatcaggttagatggaatgccaccgtgttcggggtctttaatccagatttccccctctacataaagcacgaagacctctccgaaatcgcacacggtggtcaatgtctcagcatatcagtgttggtcatcctgcccaaggaacacctagttgtctggttttgttcattgcctaacaggccagacaactaccttaaggggattattaataggttagtgttcttttcaatacatttgcattga

SEQ ID NO: 62684 - DNA, 770 bp, Glycine max
  Peptide Sequence Number=SeqID_154369
atggctacctcagcaaaagaaacttcatctcctggttcaccctctgtaccatcatctccatcatccaccaaagcaccatcaaaccaggaacaacctgaattccatatccaacccatacaaatgattcctggtcaagctcctgtccctgagaaactggttcccaaacgacaacagggagtgaagacttctgaaaaccctagccttgcaacaagtcctagggaagtagacacagagatggataagaaaatccgcagcattgtgagtagcatttttgaagatgcttctgtccctgaagctgataaagatgttcaacatcttccaccccaaatcaaagaggaatcaacagaggaagatgatcaagccacagaggagacccctgcaccacgggcaccagaacctgctccaggtgacctcattgacctagaagatgtagaatctgatgaggaacccattgccaacaagttggcacctggcattgcagaaagattacaaagccgaaagggaaaaacccccattaagaggtctggacgaatcaaaactatggcacagaagaagagcactccaatcactcctaccacatccagaaggagcaaagttgcaatcccttccaagaagaggaaagaaatttcctcatctgattctgatgatgatgtcgaaccagatgttcccgacatcaagagggccaagacatcagggaaaaaggtgcctggaaatgtccctgatgcaccattggacaacatctcattccactccattggcaatgctgaaag

SEQ ID NO: 62685 - DNA, 219 bp, Glycine max
  Peptide Sequence Number=SeqID_154370
atgatggcaacaaaaggtgatgaacaaaaagctcagagatcaaagaacaactcaagagaatcaagaacaattcaagagttcaagaatcaagaagaattcaagactcaagaagaaagcctagaatcaagaatcaaggttcaaggttcaagatctcaagaatcaagattcaagactcaagattcaagaatgaagaaaatactcaatcaagataagtattaa

SEQ ID NO: 62686 - DNA, 249 bp, Glycine max
  Peptide Sequence Number=SeqID_154371
atgggaggcttgggaattaaagacattaaggcacataacaatgctctcctaattaaatggaaatggctgatatttcaccaatcagaccagctttggagcaggatcctaatttctaagtacaagggatggagtggtttggaccagaggccatcaaagaaatacttctctcaatggtggtctgacttaagatcatatcgcagctatcagaataagtggcaatctgaaggacacctggctgtggggagctaa

SEQ ID NO: 62687 - DNA, 438 bp, Glycine max
  Peptide Sequence Number=SeqID_154372
atggcggttcctctcggtgtgggttttcaatggagaacaatgatgagatgctctcgggaacggaagcttctagcacactgcagatatcttctcaaagatcccaacggtcagatcatggaaaagtatcttgcgaagttgaaaaccaaatttcgagaagatccaacggttaacgaaggttggacagcgttttttccgaggcagcttcatgtagttttctctagaagcttcattaagaggcttcctctagaagcttcattaagagacttctggcgcactccagatatcttctcaaagatcccaacgttgaagaccaaatttcgagaagatccaacggttaacgaagattgggaagcgtttttgccgaggcagcttcatgtagctttctctagaagcttcattaagaggcttcctccagaagcttcctcgtggcttctttga

SEQ ID NO: 62688 - DNA, 326 bp, Glycine max
  Peptide Sequence Number=SeqID_154373
aattatcatttagctctacatttctccagcaattatgtggatctggggtgctagctgatggtcgactagctgatctgattcgaagagttgctacttttggcatggtgttaatgaagcttgacttgcgtcaggaatcaagcagacatgctgaaaccattgatgcaattacaaggtatttggatatgggcacgtacagtgaatgggatgaagaaaagaaactggacttcttaactagagagttgaaagggaagagaccactggttcctcccagtatagaggtgagattgttatacatagcaaagctttacaagctctatatccagtag

SEQ ID NO: 62689 - DNA, 429 bp, Glycine max
  Peptide Sequence Number=SeqID_154374
atgtgggcctttcatatcagccgacaaattgattgggcacatttagtccggtattgcatgcataaggcattgcgattaaatgctcctttaccatatccacatttagtcactctttcccttcaacattttaacatccctcttgattctgaaccttatgttccaatcaagagatctttcttgatcggtgttgttgtggttgcgtcctttggttaccgcaaagagcgtgatggctcttgggtaaaaaagggtactcaaccaaatgatgatgaaggacaattaccaattgaaggggactcatctctccttcaaagtattttggacagttttgatggactccaaacctatgttggtgaaaggatcataaaggttgaagaagatgtcaccatcattcgtgactgccttgatttacctccaccaccatcagtttag

SEQ ID NO: 62690 - DNA, 254 bp, Glycine max
  Peptide Sequence Number=SeqID_154375
tccaagtgggacagttggcaaaacagttggcggataggccatcaagcaactttagtgctaacactgagaagaatccaaaggaaaaatgtaaagctataatgacaaggagcagaatggcaattcaggctgatgaaggtagagctgaagagaaggtggggggatataaacaacagttgacagctgagccggcactggaaccagtttctgattttgttgaacttaaggaagttgtggaagatgaagatgaccaatag

SEQ ID NO: 62691 - DNA, 426 bp, Glycine max
  Peptide Sequence Number=SeqID_154376
atggcaaatcaagaagattgggtcccgtttatggatgtgttagcattgctaatctttggggtcgtccactttccaaacgtagatggtttggtggacctagccgcaatcgacgcgttccttgcataccgccatagcaaggaaagtccggtgcaagacacgaggcatccatgtccgctccaaagccatcgctcgtgtactgaaaagagaagaatagattgggaccagcttttggctgggataggaggtagaacaatcaattggttcccccgatggaaggaaggaaatgagggagtccttttctcatgtggagggtacccaaacattccgctgataggaacgaggggttgtattaactacaatcccgcgctcgctataagacaactagggtaccccatgaggggagcaccgatgaaggggatcctctag

SEQ ID NO: 62692 - DNA, 294 bp, Glycine max
  Peptide Sequence Number=SeqID_154377
atggaactccaatgtcttaatcaaaatgaagaaaccgaaaaaaagaagagaagtattgcccttaaagcctcatcatcaatgcaagaagcaaatgaagaagaagattcagatgatgaagaagacttctcactctttgtgaagaagtttcagaaatttgtcaagaaaagaagaatcgagaggcgtcagaatttcaacaatggaagaaaatcacaagaagaatctcaagttcttagatgttacaaatgcaaccaacttggtcacattcaagcaaattttccttcaaatgaagaatga

SEQ ID NO: 62693 - DNA, 408 bp, Glycine max
  Peptide Sequence Number=SeqID_154378
atggagggggagcagttaatgcagttgaatccgataggccccacagccaaacctgttcctttcccgtaccaaaatagtcacgcggtcccgtggagatatacacctccggggaagaaggaagaagaagtcactgacgtcagctcgctgtcagctaaagtaacaaatatcacgggactgagtggtgtgacccgtagtggtcgtgtgttcgcccccccggacctaccagtccaacccgccgacgtcaagggaaaaggaaaagtggtggaggaacaagatggcgaagcaccccacgcttcgaataaagatattccagcaaaggggcccccggagaaaaaggatggtagaaaggaggtgtcgctagaggaagccagcgagttccttcggataattcagcagagcgaattcaag

SEQ ID NO: 62694 - DNA, 513 bp, Glycine max
  Peptide Sequence Number=SeqID_154379
atgcaattaccgcaagagcccttgaacaagagaccaagagggctcgcaaggaagagtatggccggaacaaatttcgcggagctctatggggtagcaatagtgaactcaagttgcgaagggaagaaagagaccagtcgcgaacacatagcatggtccaaaagaagcttgtctcagcatttatgcgagacagagaccaacatgctagctatcatcgccaagtaccaagaagagttaggtctagccgcggcccacgagcataggattgcggacgaatatgcccaagtatacgcggaaaaagaggctagaggaagggtgattcgactctttacaccaagaggcaacccatgtggatggatcggtttgctcttacccttgaacgggagtcaagaacttccccgattgttagccaaggcccaagtgatggcagacacctactccgccccccgaagagattcatgggggggtggggcgtattgtcagcatatgataaacttaatggcccacataaattag

SEQ ID NO: 62695 - DNA, 276 bp, Glycine max
  Peptide Sequence Number=SeqID_154380
atggaggatgagtcatctgaggccaccatcccaaagccatttgatataggagaagaggcagaggagatgcaggtgagacaggtagttgttaccactcctgaacgatcccttgaggctacttcagagccttctacaccaatggtaaacctaccctcacctcagcctgcagcagatccctccactcctcttctacagatgccagaggacccaacgacaccagtcctagctgtggacacttctcctccccactactccagtgcttcaactgacagatga

SEQ ID NO: 62696 - DNA, 357 bp, Glycine max
  Peptide Sequence Number=SeqID_154381
atgggaaaaatcaaaagaattctcagactgtatcgctttgaattctttgacaagggagacacaaaagaattcaggtggttagtccttcgttcttttggaaaacggagaagagagacacgaaaagaattcaggcggttagtccttccttcttttggaaaagagagaagagagacagaaaaagaattcaggcggttagtccatggcgaattctttttggcaaagggagaagagaatgaaaagatgaatagcacaaagttttcaaggtttagaaaaccagaaaacttcagaaaagcttttggtacaaaagaagaagaagaagaacttccaaagagaatttcaaggcttgtaaatgattga

SEQ ID NO: 62697 - DNA, 399 bp, Glycine max
  Peptide Sequence Number=SeqID_154382
atggtagcccgggtaatgttggggaatggctacgagcccggaataggtttaggcaaggacaacgacgacataactagcctaataagcgccaagggaaatcgtgggaagtttgggttgggttataaacccacacaggcagatataaggaaaagcattgcgggaaggaaaagcggaagtcaaggttcgcgattaagacaagaagacgaaggaggcccgccctgccacataactaggagctttataagcgcgggtctaggggacgaaggccaagtcgttgcaatatgcggagatgatgctccggctgggtcggatttggtacgaccatgccctcctaatttccgactaggaaattggcaagtgaaggagcgcccggacatttacgcgacaagcataatgtaa

SEQ ID NO: 62698 - DNA, 309 bp, Glycine max
  Peptide Sequence Number=SeqID_154383
atggatgccatatttgctaattttcatgttgggatacctttggtagtttgtcatagcctctgccagggaataaataccttgaattcaaatgtcaaatcagacactgcattcaaaggcggttattacataataaccgtctttgaatgtcgatcagatgtaacattcaaaggcggttattacataataaccgtctttgaatatcgatcagatgtaacattcaaaggcggttattatgtaataaccgtctttgaatgtcgaccagacgtaacattcaaaaacggttattacataataaccgtctttgaatag

SEQ ID NO: 62699 - DNA, 171 bp, Glycine max
  Peptide Sequence Number=SeqID_154384
atgcatgctcatcttccatttgatagtggctttgtggagagggtggagcgttgttatgcctacaagtggcttcaatctccagatttaggggagctaaatcttcggttgcagttccacctcgcatacacaaaaacaagcactactgtgcaaattatagaagaaaaagaatag

SEQ ID NO: 62700 - DNA, 219 bp, Glycine max
  Peptide Sequence Number=SeqID_154385
atgtcttgggagaggtcacattgccttcaatgccccacaaagaaaaccatgattatgaggggtcaagacatttatagtagtcaagaggagactacttcttccccttcctctagtggaagtgaagatgaagtaaggggtgcagagtctagtgagaaagtctacccccatgaagaaggtgacctcctaacggttagaaggctccttgaagcacaagattag

SEQ ID NO: 62701 - DNA, 144 bp, Glycine max
  Peptide Sequence Number=SeqID_154386
atggagaataagatgaagaacaaggaattaaaatcaatggaagtggaatggaaatggaagaaagatgattggagacaccactttaaggagaagatgagtcaagaagaagttcgccaccataggaagccatggataagagcttga

SEQ ID NO: 62702 - DNA, 432 bp, Glycine max
  Peptide Sequence Number=SeqID_154387
atggtaattgatttccagcaatttattcaaattttaaagcctgtgatctattacacaagtcttgtaatcgattaccagaggagattttcagaaaataatttccaagagtcacatctattcaaatggtttatgaatggccatcaaaggattcacgatgtcggatataatgtccaggacatcctgcctgaaaatactggaattgctaaaagcattgaagctgcaggatccacgatgtcggatacaatgtccaggacatcctgcccgaaaatactggagttgctaaaagcattgaagttgcaggatccacgatgtcggatacgatgtccaggacatcttgcccgaaaatactggacatataaatctgttatatctttaacagattattgtgcagttagcaagagattagatgatctatctttaggagcgaattaa

SEQ ID NO: 62703 - DNA, 342 bp, Glycine max
  Peptide Sequence Number=SeqID_154388
atgtatcaatcatgtctaacccaaaatcaagctttacagcacagcaacacagaatctaggtgtccaacacccctcaattcaatgggttttctaggtttgaaaagtgaaattgagaatgagcatataaacatcacaaatatcatcacaaaaaccctaaaacagaatggaaaactagcaagaccacccatcatatctcccaaaaccccatacccacgaaatttaagagagaaagaagtccacccaaacctgaaatttcgaagtcccactcgtagccacgcacttcacgactccaaaaacgccctcctttcacgatttggggcagaaatgatggccaaaggttga

SEQ ID NO: 62704 - DNA, 299 bp, Glycine max
  Peptide Sequence Number=SeqID_154389
gatgtcctggacattgtatccgacatcgtggatcctgcattgtgcattgtgcagcaactccagtattttcgggcaggatgtcctggacattgtatccgacatcttatgcaagtgggatcagcaactttcattatcagagtaatcaagcacagcggtatctgtagtggtaacagcaaaattctgcaagttgcaagtcgtttccaggatgtcaagacatctcacgtgacatcagctttctgctccccctgtctccatgctcctactgctgtgaagcagttcactgcagcatcttctatcag

SEQ ID NO: 62705 - DNA, 294 bp, Glycine max
  Peptide Sequence Number=SeqID_154390
atgaagatgctcctgatatcacatgatgtaagttccattggagcttgtaggctgtcacaacctacccttttgcgggcgagtgaggcgaggctcatgggtgcgtcttccaaaggaggaaaatgcgcggagtctccaccaacgtttatttgtggaaaacgtcggaaaaaccgaaggaaaccggtcatgaagaatattccagattcgggagttgtatttacgtttgaggaaggtcgacaaaagcggggctcttgctcctacgtaccctccatcgaagaggaaattagacctacgtag

SEQ ID NO: 62706 - DNA, 549 bp, Glycine max
  Peptide Sequence Number=SeqID_154391
atggccaagttcgacccagacatagtcttcgaattttatgccaatgcttggcctacacaggagggcgtgcgggatatgcgatcttgggtgaggggtcagtggatcccttttgatgctgatgccctcagccagttcctgggataccctttagtgctagaggagggccaggagtgcgagtatggccagaggaggaatcgggccgatgggtttgatgaggaggccatcgcccagttgttgtgcataccgagacaggattttgcccggactgctgtcgggagacgtgtgcgaatcatacgcaccaacatgactaccctgactcagacatggatgacgttgctgcttagcaacatcctgcccagtgatcataattctgacctccctctgccgaagtgtatgccaccgaccaggcaccctctagacccgaataagtctaacagggccttgggtttttcggcattgatcacgggtctctgccagtcattcggggttccggtcacacctagtaaggtaattcgaccgccgatcacccgggctttcatagagaagtaa

SEQ ID NO: 62707 - DNA, 384 bp, Glycine max
  Peptide Sequence Number=SeqID_154392
taccctggtcttcagaggactacactcctcgccaacagagggctgcacgccctcaccttaagaggactgtgtgtcctcaacttcagagggctacacgccctcgccatcagaggactgtgtgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttcagaggactatttctcgtccttggaccattcctcagccatcagaggctgcttctcacctccggactacagcgtcctcgccttga

SEQ ID NO: 62708 - DNA, 169 bp, Glycine max
  Peptide Sequence Number=SeqID_154393
gggtgagcttagctattatagggggaatcttcttaagcaagcttctcaaagaggtgagcttagttatgagagggtgtgtgtagctaagctctatcttctcaaggaagttttctcaaggaagcttctcaaggaagttttctcaagaaatcttctcaaggaagctacctag

SEQ ID NO: 62709 - DNA, 137 bp, Glycine max
  Peptide Sequence Number=SeqID_154394
atgtgtgttcaagaagatgagagattgataatggaagagggtgagaagagtatggaaagcctaaggaagccagtaggaagtgagcagtgcatctacttagggagaaggatgagcttgcatgtagaggccattggaac

SEQ ID NO: 62710 - DNA, 598 bp, Glycine max
  Peptide Sequence Number=SeqID_154395
acaatcaactggtttcctcgatggaaggaaggaaaggagggagttctcttctcatgtggggactacccaaacattccgttgatagggacgaggggttgtattaactacaatcccgcacttgctataagacagctagggtaccccatgaggggagcactgacggaagagagcctctcgcctttccttgtgagagatttcggcacgcaaagtttcaagattgtacaaagagtccacaaggagtgggaaagcccgttaagaaaagataaagaacttaggggcatccgtaatggcatcatcgatggttatcatgaatggctgaaagttcatacacgagggttagattggctctccaagttgaaaattatcaacgaggagaacttcgaagctccggaagaggatgaaaaaatgtccggaaagagtgtgctgagttacgagaagaaaatgcagctaccgcaagagcccttgaacaagaaaccaagagggctcgcaaggaagagcatggccgagacaaattccgagttagctgcttgctcaagatccaagaggagggcggtgaccttggaagaggctcatgagtttcttcgtctcatccaacaaa

SEQ ID NO: 62711 - DNA, 366 bp, Glycine max
  Peptide Sequence Number=SeqID_154396
atgatgcataatgaattgattaaagaacttggcaaatggtcgcaagactacataaagatctttggtggcacggagagatatgaacagctgaggttgtccctacacgtggatgggttatccaaggttagtatggacaaatggatggatataacgaatatgagatatgtaattgcgtctagatataatagcttcacattttttcctctcagaagtcgaccatcggccgattctgctgcgcaccgcataatatgcgtcggtcatgtgcatgacagtcattttgttcaggtttttctgaaagatcgttgtcccttaccgcctatggcgttgttgtggtcaagcaatgcgtatccggaggcaaaacaatag

SEQ ID NO: 62712 - DNA, 475 bp, Glycine max
  Peptide Sequence Number=SeqID_154397
aattgcaactgtggtcaaggattcagcaagaggtttggaccgcataaaacagactcggaacggcatagcgggcctaccacagaagtacctagtagacaaggcaaggggtatggccaatcaaggagactgggtcccgtttatggatgtgttagctttgctaattttcggggttgtcctctttccaaacgtggatggtttggtagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctataggagaatagattgggaccagctcttggccgggataggaggtagaacaatcagttggttcccccgatggaaggaaggaaaagaaggagtccttttctcatgtggaggatacccagacatttcgctg

SEQ ID NO: 62713 - DNA, 273 bp, Glycine max
  Peptide Sequence Number=SeqID_154398
atggtcattgaccagtcccttttccatgacttaaccaaattaaccagtgacggtgtaccatttgaaggtacactcaatgacgactggaaatttgatttctctgcacatgatgcccgccagttggtttgcaccaacaatgcggatatgaccggacgtcttcttgccgggtcattggcttttgaaagccgcatccttcactatttaattgtgcgtattctgcttccacggtcttccaaccttgcccagggcgtcaacttgactgggcacacttag

SEQ ID NO: 62714 - DNA, 795 bp, Glycine max
  Peptide Sequence Number=SeqID_154399
atggaaatatatcatacagagctggatgaattcaaggctaaattggagaggcgtaacttccataagcgcctcaccaatttagctgacaatagcattgacctagcattggtgaaggagttctacgccaacctttacagtcctgaaggaccttctccaaaacaagtcagaatacagggccacttgataaggattgatgcagacaaccttaatgtctttttagaaacacctatggtgcttgctgagggtgaatctttacccgcttactcaagatactacaggatgcctactgacatcagggaaattgaggctgctctgtgcatacccggccaagggtttattttaaatgttgaaggtcaccctgggaagatcctcagaaaagatctaaccacacttgctcagctggacatgaatgtcagagctctcatctctaggcaaatcacttcaatggcccagtctaactcctctagactcgggttccctgctcttatcacaactttatgtaagtccagaggagttgtttctgacagcttagcctttgaacgtttgagctcagtcattaatttggcttacataaggaaaaactgttggaacccagatgacccaacagttattattagagggggcagaagaccaagggcaaggccagctgaggttctttctacatcagcagctcctcatccaacttctacattagcagctccttctaccctacctcctgcagatttccaacgtttcgaggccatgcttcggagcatacatcaggggcagattattttactgcaaagcctacaactg

SEQ ID NO: 62715 - DNA, 159 bp, Glycine max
  Peptide Sequence Number=SeqID_154400
atgtcagtgaaaaacctcgttgggcgcctaggagtgcatgacaagacaaatcacacactagcaagtcaagtcactctcactaggattaaaggagcactcaaaccgtgtgacccccaaggcctatactccgaagagtccgtcagggcctctccctcctga

SEQ ID NO: 62716 - DNA, 405 bp, Glycine max
  Peptide Sequence Number=SeqID_154401
atggcccaagccacccacggtacccaccaatatgcacaacatcacttgagtttttcggctcgcgccgaggcctcttccgatacagcactcacccaaccaagggcgcccacacccctacaggggggagctcttcaggctccggctccgactcggcctcacccgaccaacaacgctcactttggcgcaaacacggcgaggaacttttcgccaaggcaggcacagattttcgccccgatcccaatgacatatggggaactcttaccatctctcattgccaaccaattggtcgtggtggtcccgggaaagatcttccagtctccattcccaaaatggtataaccttagcgcaacctgcgcataccatgggggtccccaggccactcgatcgaacagtgcttggccttga

SEQ ID NO: 62717 - DNA, 535 bp, Glycine max
  Peptide Sequence Number=SeqID_154402
agagcttaggggaagcagtaatgggatcatcggcggctatcataagtggctgagagtccgaacacaagaatttgattggctcccaaatctaaagactgtgagagacgatgaggttaaagcctcggaagaaagtgatgaggtacaagccctaaaggcagagcttgaaagagcccgggtagtcgaagagaagttcaaggcagcaatagtgagctcaagctccgaagaggtgaaaggaatcattacgggtcaaaggcatgatcttgaaggacgagctaaagggaatatgtgggccatcatcgataagtgcaaagagaagctaaatctagcggcgactcatgagcaaaggctagaggatgagtacgccaagatatcagcagaaagggaagcaagggaagggagtcaagaacttccccgattgctagccaaggccaaagcagtggcggacacctactccgcccccgaggagatccacggacttctcagctattgtcagcatatgatagacttaatggaccatatgattggaaaccgctag

SEQ ID NO: 62718 - DNA, 282 bp, Glycine max
  Peptide Sequence Number=SeqID_154403
atggctctgagaaagctttccgcaaagagatctaggaaggacgccgtgactgaagggaccagtgccgcccccgagtttgacagccatcgtttcaggagtgctgagcaccagcagcgtttcgaggccatcaaaggatggtcattccaccgagagagacgcgtccagctcagggacgatgagtacacggatttccaggaagagataactcgccggcgttggacgtcgctggtcactcctgatggaagcttgcttgtggggcttctatggaggctggatctttga

SEQ ID NO: 62719 - DNA, 192 bp, Glycine max
  Peptide Sequence Number=SeqID_154404
acatgctagtggacttagcattgatcgacacttttcttgcttatcaccacaacaaggaaagcctagccattgttgttttggccgatgcctgtgccacatttgacctgagatgcaaaaagagcagtgcaagaattgtctgttgtaaacccgctctttatgtatggttggtctcccacgtttttcgtcatgaag

SEQ ID NO: 62720 - DNA, 99 bp, Glycine max
  Peptide Sequence Number=SeqID_154405
atgacgtccaacttaaaagacattaaagaagcgctcctgggaggcaacccggaggaggatgaagacatgacagatcctgttgattatttcattggatga

SEQ ID NO: 62721 - DNA, 99 bp, Glycine max
  Peptide Sequence Number=SeqID_154406
agaagaagggaaacaaacggggaaaggaataaaagagagaagggatctagcttgtaatgttggggcagacggatgtgttttcaacgtttgcgtctgcgg

SEQ ID NO: 62722 - DNA, 204 bp, Glycine max
  Peptide Sequence Number=SeqID_154407
agggtacatctacttggggattgctatgctgagaacaagagagggtacatctcttgtggatcagttcacgtggaaggtacatccacttgggttttcaaagagaacaagggagggtacagcccttgtggatctttggcttgtaaaggattttacatggttgaaagaaatcttaagaaccataggttgcttggggactggatatag

SEQ ID NO: 62723 - DNA, 399 bp, Glycine max
  Peptide Sequence Number=SeqID_154408
atggagtgcctagagggagtttgggagaccctcaaaggcaatgcgaggtgccgattccgtggcacgatccgactcacggctacttcgttggtacatccggaggaaccagcacacacgcttcagcgcacggtggagtggatattacctacacctactccatatcgactagtggagccagtccaagtgatagaggtgacgtcatctgaggaagaccctgaggaggacccagaggagctacctcctgagcctgctgtggatgctcttgactttctagagggtgatgaggatccactccctgaggtggattctcccgaggacgtcatgtcggcatctgaggcagactctacggaggagagcggtcatggagggatagcgactagcagaggttcttcatcatag

SEQ ID NO: 62724 - DNA, 267 bp, Glycine max
  Peptide Sequence Number=SeqID_154409
atgtgggatacactacaactttcacatgaaggcaccactgatgtgaaaagatctaaagaagaagaagaagaagaagaaactgatgatgaagaggacttctcactctttatgaagaagtttcataaattcgtcaaaaatagaagaatggagagaagccataacttaaacaatgggaagagatcccaagaagtttctccaacacttaaatgctataagtgtaatcaacccgatcacataaaggcaaactgcccctcaaatgagtcatga

SEQ ID NO: 62725 - DNA, 138 bp, Glycine max
  Peptide Sequence Number=SeqID_154410
atggtgattttcaaccatggagttgcagcagaagataaaggagaagagcctagcacatgggaagctcccttgggaagcaagaaaggtagcttccttggaaagctagaggggggctactcacacccctccaatagctaa

SEQ ID NO: 62726 - DNA, 355 bp, Glycine max
  Peptide Sequence Number=SeqID_154411
tattatggcacattctccagacaagataaagagcatcgatggctcaaaagaaactcttaaacttagtgtgaggatcagtgatctatggtttattggcacgcctaacaaatctgagcaagctgaaatggtgtttgtggacttcgatgaggttgtctttcgccaagtttcaggaaaaggtagaagggtagtcttcaaactaaaggacttgagccagcaattgctatcttgcacttcgtgggatgattattgcttgcagtttttgaagttcttagatgattatgaaggtgatggcccaattacagttctattgagccattgtaggatcaaggaagcgcagggtatatcctcatcttga

SEQ ID NO: 62727 - DNA, 255 bp, Glycine max
  Peptide Sequence Number=SeqID_154412
atgtgcacatgtgcaatttttggtaccccaaatgctttgagtatgcatgaatggccccgaggaagcttgcctcaaagaggtccaggaaggacaaggcggccgaagggactagttccgctccggagtacgacagtcaccgctttaggagcgctgtacaccagtagcgcttcgaggccatcaagggatggtcgtttctccgggagcgacgcgtccagctcagggacgacgagtatactgatttccaggaggaaatag

SEQ ID NO: 62728 - DNA, 447 bp, Glycine max
  Peptide Sequence Number=SeqID_154413
atgacgaatagggagatgatcacaatcatggtagatatgttgcctatgttctactatgaaaagctgataggctacatgccagctaaatttgcggatctcatcttcaccggagaaagaattgagtctggactgagaaaaggcaagttcgaatatgcctccaacacgaccctcaataacaacagaagaaccccaaatcatttggtggtggccatacccggaaaggtcttccagccaccctaccccaagtggtacgacccgggtgccaagtgtgcgtaccatagtggagctgccggatacaacattgactcctgcatcccattcaagtataaggaaggcccaaatgttaaaactaatccgctagctagtcatggaggggctagcgtgaaatgccgtcgaagaggatgggccatcgcgggcaaagagattaggagaggtggctacttctag

SEQ ID NO: 62729 - DNA, 543 bp, Glycine max
  Peptide Sequence Number=SeqID_154414
atgacagctgtacaccagcaacgcttcgaggccatcaagggatggtcatttctccgggagcgacgcgtccagctcagggacgatgagtataccgagttccaggaagaaataggtcgccggcggtgggcatcactggttacccccatggccaagttcgatctagaaatagtcctcaaattttatgccaatgcttggccaacagaggagggcgtgcgtgacatgaggtcctgggtgaggggtcagtggatcccgtttgatgcagttgctatcggccagctcctgggatatccgttagtgctggaagagggccaggagtgcgagtatggccagaggaggaaccggtctgatgggttcgatgaggaggccatcgcccagttgctatgtataccggggcaagattttgcccggactgctaccaggagacgggtgcggatcatgcgcaccaacatgaccaccctgactcagatatggatgactttgctgctcagcaacatcctgcccaccgatcataattctgacctccccctgctgaagtgtcagctg

SEQ ID NO: 62730 - DNA, 921 bp, Glycine max
  Peptide Sequence Number=SeqID_154415
gaagcaagtcaaaaatggggtggttgggataccgagaaagtgtttgaaggcaaaagcaaggaacttggcagaggagtcctctttccgaatgtggatgggttggtggacctggcagcgatcgacgcttttctcgcctatcataaccacaaggaaagctcggttgtcgctatgctaaccgacctatatgacaccttcgaccgaagatgtgaaaagagcaatacaaggattgtttgctgtactccagctctttatgtatggttagtttcacacctttttcaccaagaggtgaggcatacttgcccgctagaaagccaccgttcatgcacagagaaaggaagggcaaattgggaccaactcttagcaagaaaagaaggaacatctgtcaactggttccctcgatggaaggaaggaagaaccgaagttcttatttcatgcggaggatttccaaatgttcccttgatggggacaagggggtgcatcagctacaatcccgttcttaagacaacttggctatcctatgagaggagcaccactagaggaagagatcgtgccaaccaatgtggagcacttcagaaggtccgcaaggcatggaaggtgttgcaaaagaaagacaaggaactcagaggcagtaacaatgggcccatcggtggatactgtgagtggttgaaagcccacgtgcaaggtttggattggctcccaagtctgagaaccactaaaagggaggaagatgaggcaccggaggaagaagaagaggtgcaggcccttaggacagaactcaagcaagctcaaacagtcaaagaaaggttcaaatctgcagctcttaaaatccgaaaggagaatgccgaattgagagatgggctctgtggggcagtaacagcgaacttaaactccgaagagaagaaagggaccaatcgcgagtag

SEQ ID NO: 62731 - DNA, 831 bp, Glycine max
  Peptide Sequence Number=SeqID_154416
atggtagaagtctccatagaggccattgcctcccttgcccagtattatgatcagccgttgaggtgcttcacctttggggacttccagctatcacctatggtagaaaaatttgaagagatcctaggatgccctctagggggaaggaaaccatacctcttcttagggttctatccctcattagctagaatttccaagatagtccaaatctcgacgcaggaattagaccacaggaagcaagtcaaaaatggggtggttgggataccgagaaagtgtttgaaggcaaaagcaaggaacttggcaggtaaaggcgaatgggccccgttcatagatattcttgcactgttgattttcagaggagtcctctttccgaatgtggatgggttggtggacctggcagcgatcgacgcttttctcgcctatcataaccacaaggaaagctcggttgtcgctatgctaaccgacctatatgacaccttcgaccgaagatgtgaaaagagcaatacaaggattgtttgctgtactccagctctttatgtatggttagtttcacacctttttcaccaagaggtgaggcatacttgcccgctagaaagccaccgttcatgcacagagaaaggaagggcaaattgggaccaactcttagcaagaaaagaaggaacatctgtcaactggttccctcgatggaaggaaggaagaaccgaagttcttatttcatgcggaggatttccaaatgttcccttgatggggacgaggggttgcatcagctacaatcccgttcttgctataagacaacttggctaccctatgaaaggggcgccacctagaggatga

SEQ ID NO: 62732 - DNA, 438 bp, Glycine max
  Peptide Sequence Number=SeqID_154417
atggctaagtttgacccagagatagtcctggaattttatgccaatgcttggcccacagaagagggagtgcgggaaatgcgatcatgggtgaggggtcagtggattccctttgatgcagatgccctcagccagttcctaggtgacctgctggtgttagaggaaggccaggagtgcgagttaagtcagagaaggaacagggccgacgggtttgacaaagaggccattgcccaactattatgtatatcaggtcaggattttgcccggaccgctacagggaggcaggcctctgctagtccattcggggttcccatcaaacctagtaaggtgatccggtcgccgatctcccgagccttcattaagaagtattgcacgcctaggcaggcgcagggtgatgcgccacaggctgcagacgcaccgccgccaccatcatcaggctga

SEQ ID NO: 62733 - DNA, 189 bp, Glycine max
  Peptide Sequence Number=SeqID_154418
atgagccccaaaggatgtcccttcctttgtggtcagtgtaacaccaagtggatgtatgctccacttgaactgatccacaagagatgtaccctctcttgttctcagtattacaaccctagtagatgtacgctctacttgtaccacaaaggatgtacgctccaatgtgtcaagacaaagatatctcaggcg

SEQ ID NO: 62734 - DNA, 153 bp, Glycine max
  Peptide Sequence Number=SeqID_154419
atgtgggatcggcacaagcttaaaggagcactcaaaccaagtgtatttacccccaaggcctacacttcgaagagtccatcagggtctctccctcctgattcagacactgctcatgaattatacaatacccatgacctcacactcgtgttttaa

SEQ ID NO: 62735 - DNA, 492 bp, Glycine max
  Peptide Sequence Number=SeqID_154420
atgcagcagcaacagcagtattcaaaacaaagacaacaagcaactgaggctcctccccaaacttccttagaagagttagtgaggcaaatgaccatccagaatatgcaatttcagcaagagacaagagcctccattcagagtctgacaaatcagatggggcagatggctactcagttgaaccaagctcagtcccaaaattctgacaaattgccttcacaaactgtgcagaatctgaaaaatgtgagtgtcatcaccttgaggtctagcaaccaaattcaagtgccttcaccagtagcagcacctgcacctgaacctgtcaagcttcattctacacctgaaaaagaggatgagataattgcacaaaagagaaagcttcctaacaaaaattttcatgcaggtggaccttcctctactaattctgacttaccgcagcctcttatcccccttccattcccacctagagcaattccaaacaaaaaaaattggaagtag

SEQ ID NO: 62736 - DNA, 426 bp, Glycine max
  Peptide Sequence Number=SeqID_154421
atgcagtttcaacaagagaccagagcctccgttcagagcttaactaatcagatgggacacttggctacacagttaaatcaacaacagtcccagaattctgatagattaccttctcaatctgtccagaatcccaaaaatgtgagtgccattacattgaggtcgggaaagcagtatcaaggacctcaaccagtagcatcttcctcatccgcaaatgaacctgcccaacttcactctactccagaaaaagatgatgacaaaaatttaaagagtaggttgcctaataatttctatgcaggtgaatcttctactggtaattctgacttacagcaacaacatatccctcttccattccctccaagagcaattcccaacaaaaaaatggaagaggcagagaaggagatcttggaaacatttagaaaagtagag

SEQ ID NO: 62737 - DNA, 363 bp, Glycine max
  Peptide Sequence Number=SeqID_154422
atggctgctcagtttaatgcttttctagattccactgaagaactgtgtaaaacacaacagctttcaggcaaacctgttgcaatcatcaccggcaccaattcccaaggtggtggacaagagactacagtgcttactgctatcaccccgctggctcatcatggaatgatatttgttccatttggaataagatttgcatacagtaatgagtttggcaatgtgaaggaagtgaaaggtggaagtccatatggtgcaggaacttatgctgaaacagaggggccaacttccatagagtcgatgcatgcattcgaccatggatattactttgccaacatcacaaagcagctcaaggaagctactgcataa

SEQ ID NO: 62738 - DNA, 714 bp, Glycine max
  Peptide Sequence Number=SeqID_154423
atggtcattgaccaatccctattctatgagttaacccaattatccagtgaaggtgtaccatttgacggtacactgattgatgattggaaatatgaattctctgtgcatgatgcccgccggttggtttgcaccaaccaagtggatatgaccggaaggcttcttgccagttcattggcttttgagagccgcatccttcattaccttattgttcgtatcttgcttccaagatcttcaaaccttgcacaggtttctgaagaagatcttattgttatgtgggcttttcatgaaggccgacaaattgattgggcacacttagtcggatatcgcatgcataaggcattgcgattaaatgctccattgccatatccacatctagtcaccctcttccctcaacactttaacgtccctcttgattatgaactctatgttccaatcaagagatcctttctaataggtgttgttgtcattgcatcctttggctatcaaaaagagcatgatggctcttgggtgaaaaaggattcctctcttcttcaaaattttttggataggttcgatggtcttctaacctttgttggtgaaaggtttgatactttggagttacaagtggacatgtgcttcagtgagatggattcaagaatcaccaaggtcgaagaagatgtttcttatattcgtacaagctttgatctaccaccaccgccgccaccatcattttag

SEQ ID NO: 62739 - DNA, 513 bp, Glycine max
  Peptide Sequence Number=SeqID_154424
atgggaaatcaacagagacaaggatacaaccaaggaggatttttaggattccagcaaggtccctacaatcagccacctcaacaagggccaaatatttttcagaggaccaccaaattggaggagacactagctcagtttatgcaagtgaccatgtccaaccataagagtactgagtcagccttgaaaaaccttgagatccaggtgggtcaaatggccaaaatgttagctgagaagtcatccaacagctttggagcaaataccaagaaaaataccaaagaagagtgtaaagctgttatgacaagaagcatgaagcttgtggcggctgaggataaggatgttgttgctttgaaggagcaagtttctttgaaggacactactgttaaaaagaagaatagggtaacaaataagaggagtcagtggagagaaaagccaataattgttcgaaaggaagaaatgaaagacaatgaaaaagaaatagagggaggaaaacaaaaagaaaaagaaaaagtttaa

SEQ ID NO: 62740 - DNA, 342 bp, Glycine max
  Peptide Sequence Number=SeqID_154425
atgaatggaaaaagtggagcttggacatcatttgtctgcatgacattcacaccactcacaaaaagtgagtggaaatttttagacaaaatagatgaagaattattaatgttcaaccatcattggaagtggaaagttcattatgagaaagaaaagcagttcgccaaaatggaaagcagtatagttatagtatcaaatgttgtatcttcaaatttggctgctttctacgaaataaagttgcaaaaacggaagaccgagagcttaattagacatagaattcaaatggagcatgtcatcattggcatgaagactgatgagaagtttgaaataacatttcttacatag

SEQ ID NO: 62741 - DNA, 157 bp, Glycine max
  Peptide Sequence Number=SeqID_154426
caacaccggtgtacgcaccgatgatataggatttacactggtagacctaaagaaacttggttaccacaatgaccctttcatcatggcagaacaagctagacaaggcaaaacaattggtgttaatgtagaagatgatgattcatacatggacacctat

SEQ ID NO: 62742 - DNA, 138 bp, Glycine max
  Peptide Sequence Number=SeqID_154427
atgaggatcaaaaggtcttttagggttgtaatggggccaaggacaagcttgtcataccctaatttcgtccggggacctttgcttgatgacatgcgacctttctttggtccttgtgaggtgcttggcacccatcattag

SEQ ID NO: 62743 - DNA, 273 bp, Glycine max
  Peptide Sequence Number=SeqID_154428
atgtgggcctttcataccggccgacaaattgattgggcacatttagtccagattgtcatcatcaaaaagggggagattgtggaagcaatgccttccaagattattttgatgatgccaaagaatcaagagttaagcaaattccaaagattcaagaatcaagtttcaagaatcaagattcaagattcaagaaccaagtttcaagaattaagattcaagaacaatcaagatcaagattcaagaatcaagagaacactcaatcaagataagtactaa

SEQ ID NO: 62744 - DNA, 438 bp, Glycine max
  Peptide Sequence Number=SeqID_154429
atgtatccaggtccaggattttgcccggactgttgccgggagacgggtatgccgcctaccaggcaccctctagacccagataagtctaatagggccctgggttttccagcattgatcacgggtctctgccagtcgttcggggttcctggtacacctagtaaggtgattcgaccgctgatcgcccgggctttcatagagaactattgcacgcctagacaggtgcagggtggcgacctgcaggccccagactcaccgccgccacctcatcaggctgatccagctgggtcatttgacacggagcggtatttacgacatttggtttgccagcaggcggccaaccacagggcacacatgcagacccatgattgtctctaccagctcagcctcagtcagcagagccagggtttcgctccttttccgtgccatactccagattag

SEQ ID NO: 62745 - DNA, 297 bp, Glycine max
  Peptide Sequence Number=SeqID_154430
atgggtattttagaaatcaagatattatattttttcaaagctttaaaattaagcataaattcaaaaagaaagggggagaaagagatgagtgaacggattgtcatcataaaaaagggggagattgtggaagctatgccttccaagattattttgatgatgccaaagaatcaagagttaagcaaattagaaagattcaagaatcaagtttcaagaatcaagattcaagaacaatcaagatcaagattcaagactcaagattcaagaatcaagagaagactcaatcaagataagtactaa

SEQ ID NO: 62746 - DNA, 177 bp, Glycine max
  Peptide Sequence Number=SeqID_154431
gggcaggatcatcttgagctaccttctggggtagagacaaagctagaacagcagaaaccaatcaaggtacatagggacggatgcaagtggggatggggtcacgatcgaccgatcgttgccccttctctgcgccaaacaagcagagaacgtcacgcaaggcagcccagtatcctttga

SEQ ID NO: 62747 - DNA, 204 bp, Glycine max
  Peptide Sequence Number=SeqID_154432
atgcaaattttgaattcaaattttaatagctgttgtaaatcagttttggccactggtaatcgattacatcctctggatccacgatgtcggatacaatgtcctgacatcctgctcgagaatactggagttgctgtgcactgcaagataaaagtcaagtgcagaagtgaagctgcaggatccacgatgttggacacgatgtcctga

SEQ ID NO: 62748 - DNA, 129 bp, Glycine max
  Peptide Sequence Number=SeqID_154433
atggataagagcatgaaggtaaaagaagatgagtggagggagaaggagagaaggagcacgaaattttgtgtctcaaaagagcccactaatccaagatcaagtcctagattcttcactaagtgtgcttag

SEQ ID NO: 62749 - DNA, 354 bp, Glycine max
  Peptide Sequence Number=SeqID_154434
gacttggaggacctatgacaagggctagagcaaggaaagccaaggaagctcttcaacaagtgttgtccatactatttgagtacaagcccatgtttcaaggagaaaagtccaaggttggtccaattggcaacctaggcatcagccttttgggagaccaaatggtggctgacttgatggttgttgggggaacaaatcctaatgatggagtggggctttcacaattccaaatgcaagctttgatgcaccatttggagaggttaatgaaacaacgagatgatgcgctccatgagagtttggatcaaatggagaatagagatcataatgaagaagaaaggaggagaagagggaatgatg

SEQ ID NO: 62750 - DNA, 558 bp, Glycine max
  Peptide Sequence Number=SeqID_154435
atgtggcccccaacaacaacagaaagccctagtgggcgctttactaggaaaaaggaagagaccggctccacacccgtatacccccgggcggcgcccaagccaacgccatttgcatatcaaagtaataaggccgttccgtggaagtatacccctcccgcgtccagcgaaagagttgcaaccgaagttgactccttatcagctaaggtaatcaacatcagccggcctcagtggcgtaacccgcagtggtcgggtgttcgcttcccctcacccggcggaattgccctccaaagggaaagtgcctatggtccaagagcccacacacatagcaccaccccctcgaaagaagtagatccctcctttcagtggcatactcgaaaagaaagaaggtcttcattaggaaaaacagtgactttggtggtggcccatacccggaagttcctccgccaccctacccaacagagtggtatgacccgggtgccaagtgtgcgtaccatagtggagtttccggacacaacattgactcctgcctcccgttcaaatataaggtacggcacctaa

SEQ ID NO: 62751 - DNA, 399 bp, Glycine max
  Peptide Sequence Number=SeqID_154436
atggcacctcccatggtggaaagagagatgattactatgatagtaaacactctgccagtgttctactatgagaagttggtaggttacatgccctctagcttcacagatttagtgttcgcaggcgagaggattaaagtgggcttgaagagagggaaatttgactatgtcttccctactggcatcaacaatagaaggatcggagcagttggggcaaaaagaaaggaaggagacgcctatgccatcacctcgacacctgcttggccaacaaaagaacgaatgactaaccgcctgaattcttttgtgtctctcttctccctttccaagagaattcaaaggaccctgcctgagaattcttttgattcttccctttcccttaaacaaaagatctcaaaggactaa

SEQ ID NO: 62752 - DNA, 519 bp, Glycine max
  Peptide Sequence Number=SeqID_154437
atgcttactacctcaaaagattggaaagccgtttccaatgactcctccgcggcttccacatatggcatagaggaagggcaacttaccaagatgtcttcctctcccgatactatgaccaaatgcccctccactacgaacttcagcttttggtggagtgtagagggaatgactcccactgagtggatccacgggtcgatctctccccccacctctcggcggctgccgtcgaaggcacggaccaccatggaacttgtgggaagcgttaaacggcaatttctccaacgtgtttttgggcatcacgttcaaactagagtcgttatcgatgagtaccttggccatgacgtggtccatgcatttgaccgacacatgcaaagccctgttatgtcctctcccctcggtagggatttcctcttcagcgaaggtgaggtagttgttggctgtgatgttattgacgagtcccccaaatccttctacaaagatgtcttgggctacatgagcttcattcaagacttttactag

SEQ ID NO: 62753 - DNA, 369 bp, Glycine max
  Peptide Sequence Number=SeqID_154438
atggtagtctggtctggggcccaaccttctcttcacagggaacatgaaggtcccacagcccaggtaccacaacatgtggaggatgagtcatctgaggccaccgtcccagagccattcattgtaggagaggaggcaggtgagacacaagtgagacaggtagctgcagtcactcctgagagatctcttgtggccacttcagagcctcttgcaccagtggtggacctatcctcgactcagcacgtagcagacctctccactcctatcctagagatacatgaggacctaaccacaccagtcctgactatggacacttctcctccagctactccagtacttcatctgaaagatgcggagggtgttcagacatag

SEQ ID NO: 62754 - DNA, 507 bp, Glycine max
  Peptide Sequence Number=SeqID_154439
atgccttatgtggaagccgcaaaggagtcattagaaaccgctttccagtcttttgaggtggtaagcatttcctccgtggactccttctctgggcagccttgcctgtccgatgcagcagtaatgatggcccgggttatgttggggaacggttacgaacccggaatgggtttaggcaaagacaacggcggcataactaacctgataaatgccaaaggaaatcgtgggaagtatgggttaggctataagcccactcaggcagatataaagagaagcatcgcgggaaggaagagcggtagtcaaggctcgcggttgagacaagaaggtgaaggaagcccgccctgccacataagtaggagctttataagcgcgggtctgggggacgaaggtcaagtggtcgcgatatacgaagatgatgttccgagtacattggatttggatctttcttcatctgttcctacgtctctacccattctcatccatttgcatgtttacttctttactttttaa

SEQ ID NO: 62755 - DNA, 309 bp, Glycine max
  Peptide Sequence Number=SeqID_154440
atgaggaaaggcaagagtgaggtaaacattgacaagaagaaggatactactccaaatgaaggcaaggaagtaccttatcctttggtaccttcccgagaagagaaagaaagacatctggccagatttcttgatatcttcaagaaactggaaattactttaccctttggagaagcacttcaacaactgtcactatatgccaaatttttaaaagatatgctgacaaagaagaatcggtacatccacaatgacataattgtggtggaacgtgttggatcgagtggcctcagaataattaagaaggggggttga

SEQ ID NO: 62756 - DNA, 534 bp, Glycine max
  Peptide Sequence Number=SeqID_154441
atggcccaaggagtcacctcagattccttgacttttaagtcgctcagcccagccattaacctggcttacataaagaagaactgttggaacttggacaaccccacggtcagctttccagggacccgcaaggccaggactagaggatctgagggtccatcttctgttgctccccagacatctactgcaccagctcctattccttcaacatcggttcccgatacttccgatccctccgctcagagcacatacctcatgatggcgatgctacaaagcattcaccagggtcaatacctggtggcctggccaggagtccaaccttcttctcatggaggaggtgaggcctctgcagctcaggagcctcaaccagatctggagactacacctgctgctcaggaggatgatttagaggccactcccccagagtcatttgtaccagaaactaatccagagaaagatgtagtgattgtggaggccagtccacaggcatcaccagtatctacaccagtgttggagctgagcaccctgcaaggatga

SEQ ID NO: 62757 - DNA, 321 bp, Glycine max
  Peptide Sequence Number=SeqID_154442
atgggaagaatcaaaagaattctcagactgtgtcgttctgaattctttgacaagggagaagggagacacaaaacaattcaggcagttagtccttccttcttttggaaaagggagaagggagacacaaaagaattcaggcggttagtccttccttcttttggaaaagggagaagagagacacaaaaagaattcagggagaagagaatgaaaaggatgaatagcacaagttttcaaggtttggaaaaaccagaaaacttcagaaaacttttggtacaaagaagaagaagttcaaagagattcaaggcttgtaaaggattgtaa

SEQ ID NO: 62758 - DNA, 761 bp, Glycine max
  Peptide Sequence Number=SeqID_154443
tcattggatgatggaagcaggaaaggcctaaataaaggtaaaagagtcattttgccttcaacttttgttggcagtctgcgctatatggatcaactttattttgatggtatgaccatatgtagccatgtgggcttcccaaatctgtttattactttaacctgcaatccaaactggcctgaaatccatagattgctgaatccgttgaatctgaaagcagcagataggctagacataatctccagagtcttcaaactaaagtatgaacaaatgcttatggacctgacaaagaatcacatgctaggcaaagttattgcatatatgtatacaatagaatttcaaaaacgaggcctgcctcatgctcatttgttgctttttttacatcttgataacaaatacccatcctcagataaaattgatcaaattatattagcagagataccttcacagcaagatgatccagaactgtattcattagtaaaaacccatatggttcatggtccatgtggaactctgaatcctggatctccatgcatgaaagaaggcaagtgtagtcgtttcgatcctaaaatgttccagccgcatactgttttagatgttgatggttttccagtctatcgtagaagaaacaatggtcatgcaattgagaaaaatggtgttataattgataacagagtaactgttgttttgattcatgaagataacgatcaaactgagaatggtggcactcataatgatgagatcaaagaatatctagattgcag

SEQ ID NO: 62759 - DNA, 249 bp, Glycine max
  Peptide Sequence Number=SeqID_154444
atgcatattgttgtggtaaaacaggggcaggatcatcttgagctaccttctgggtggggacaaaacatgaacagcagaaaccaatcaaggtacttaggaacggatgcaagtggggatggggtcacaaccgaccgatcgttgccccttctctgcgctaaacaagcagagaacgccgcgcaaggcggcccagtatcctttggagtcgcagtattttactaccattgtttgtttttagtaattaacgcctaa

SEQ ID NO: 62760 - DNA, 138 bp, Glycine max
  Peptide Sequence Number=SeqID_154445
atgtttcgtggggcccccggcgcgtccggcgtagaaggacgatcaaaaaacggcccgcccgggcgggcggaaggaagatacactaatgctccggatccccccataacacctccgttaagcgtgcttgggggagggtag

SEQ ID NO: 62761 - DNA, 261 bp, Glycine max
  Peptide Sequence Number=SeqID_154446
atgattatgaggggccaagaaactgaaaaagcaaaaggggaagaatctagtgaagaaatctacccccaagaagaaggacaaccattagtggttaaagagaagtgtaaggaggtaagtgtctcctccaagaggttagctaagaaggaaactcattttacaatagagacaaacattaaagaaacattccctcttagacaacctccatattttctcttttgtaaaaagacacttgctagcattgccacaccctcttgggcttga

SEQ ID NO: 62762 - DNA, 378 bp, Glycine max
  Peptide Sequence Number=SeqID_154447
atgtctattggtcaaccttcacagtcttttgttttgcaggttacaggttgtaccatttgtggtggtgctcatgaatccggccattgtattccttttgaagaacaaatgaaagaagttagttacatgggaaatcagcaaaggcaaggatacaaccaaggaggattctcaggtttccagcaaggtccctacaaccagcaaggacaatggagatcacaccttggtaatcaattcaataaggaccagggtggaccttccaacaggccacctcaacaagggcctaatattttccagaggactaccaaactggaagaaactttggcacaattcatgcaagtgaccatgtctgatgcaatcctaccccccaaggatattggatag

SEQ ID NO: 62763 - DNA, 351 bp, Glycine max
  Peptide Sequence Number=SeqID_154448
atgttaggattcacaagtgattctcaattttcagccagcccgcatcaattagactttgcaccttacgcttcaaggccctacaatgctcaatggaatgccccggggctcctccatgataagcacatgttgtgtttgagacgtatcctcggaaaaatggaggttgatgaaccttggctggggttatggctaccattgaattatcaagtggtgttcgtgttggttgtgtggcaggtgggttttgtggttgatttaggtatgacctttgtggataactgggtgataggtaaggagaagggttggtattggctaagtaatgacattgttgggttggtgggaaacttggccgtatag

SEQ ID NO: 62764 - DNA, 268 bp, Glycine max
  Peptide Sequence Number=SeqID_154449
atgaagaaagcgtacatcacatgggatgacaataatatggaatcttctgaagattccgaaaatgaagagataaacctctgtctaatggttaaaagttatgaaagcgatgaagaggtgtctttgaggaaggaatggtacatagatagcggatgttcaaaacatatgacaggagatgcatcaaagtttacacatatatctctcaagaaaagcaggcatgtaacttatggtgacaacaacaaaggtagaatccttggagttggtaaaatag

SEQ ID NO: 62765 - DNA, 131 bp, Glycine max
  Peptide Sequence Number=SeqID_154450
ggacatccgacaaggtcaatgcacctccccacgaacatacacaacatccaacgtatgaaacatgggcaccatcaagtacaatgaccatggatgaattaaagctcctaagaattcccctcaaagatgcttaa

SEQ ID NO: 62766 - DNA, 285 bp, Glycine max
  Peptide Sequence Number=SeqID_154451
atgtcgtggcaagcccacgcattgctgattgatagaggaggaacaagatgtgggctaagcgcgcatccaccactaagcatagcttcagcgtgcttagcacgaccgaagaatctggaagagcatcaatatcaaggctgcgcgctaagggcgagatcagtgtgttatgcgcagcagttgtcttcagccaggctcagtgcaagactggcgctaagctcaaatccacttactcgcgctaagcgtgagggtggcgctaagcgcaacgtcacggattcagagcctatttaa

SEQ ID NO: 62767 - DNA, 483 bp, Glycine max
  Peptide Sequence Number=SeqID_154452
atgtggggcatcccttttatccttgaaccaaaccaagccctgacatgtatcatgtctagccattctacgagctttgagccaaaatcccgactcatcataaaccttgacccaggtggagaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcatttagtgaccccaagtgtgattcacgagcagagaccaatatggtcatctgcgccctttccggagatgtcagcattttccgatggagacttttcaagtctcacaagttatccagaactacgtaggtctgagttcctcattggaggatacgtaggagcaagagctttgcttttgtcggccgccccataa

SEQ ID NO: 62768 - DNA, 366 bp, Glycine max
  Peptide Sequence Number=SeqID_154453
atggaatggagaaggaagagagagaggagatgccacttcaaggagaagatgagtctagaagaagctcaccaccataggaggtcatggataagagcttggaggaagaagaaagtaaaagcggaaattaaatgcacagcggaaagtaaaagagtatggaagaaggaaacaaacacacaagagtttttatactggttcggcaaaaacccgtgcctacatccagtccccaagcgacctgcggtccttgagatttctttcaaccttgtaaaaatccttttacaagcaaagatccacaagggatgtaccctctacttgtaccacaaaggatgtaccctccaatgtgttgagacaaagatctcaggcggttaa

SEQ ID NO: 62769 - DNA, 507 bp, Glycine max
  Peptide Sequence Number=SeqID_154454
atgaaagaaatgaaaagagaaaaacatgcctcctatagtagtcatgactcttgcaagagtttaagtgaagaacttagtgactattatagagggtgctataggtcacatactaaacatcactcccaaagaagagaaaaggatagaaggcttcaagaggttaacattagcctcccatatttccatggaaaagataatgttgaggcctacctagattgggaaatgaaggttgaacaactctttgcttgccatcatattagtgaagagagaaaagttccattggctacccttagctttcaaggagctggacttagggaggaggaaagaacaagcatagctaggttccttagtgggcttaatatggaagtgagggataaggttgaactccctccatatatggacctagatgagctagtccaactttgtataagagtggagcaacaacttaaaagaaagccttcttcaaaatcttatgggtttcactcttatctaaggaaggaccaagcttaa

SEQ ID NO: 62770 - DNA, 219 bp, Glycine max
  Peptide Sequence Number=SeqID_154455
atggaggctgtaatggtcgcgatggatgggaaagctctaggttggttccaatggtttcaaggttatagcctaggaaatccttttcaagtgttgctggcactggaacaagaagagacaatgcaaggattcataggccaatttgagaagtgcgttggaatggtgaaggggttggaggagccatttctggtggaagtgttgctcaatgggttaaaggaatag

SEQ ID NO: 62771 - DNA, 273 bp, Glycine max
  Peptide Sequence Number=SeqID_154456
atgtctggaaaagctataagagaaatcttagttaggtggttggatgaccttgtagaacaacaaggaggaggtgaagcaaaagctaaggagaatgaaacccgagacgtcgctgaagatcaaggacgaggtgaaaaagcaattccacgtcgatttcttggcggtggctcgataccccgagtgagtggccaacattgtgtcgatcccttagaaagatgggatggtatgaatgtgtgtggacaatcgggacctgaatcgagccagtcccaaagataa

SEQ ID NO: 62772 - DNA, 141 bp, Glycine max
  Peptide Sequence Number=SeqID_154457
atgaaaggatatgtcatcaaagaattctatcaacttcctaatgtaagcctgaagatgaatggcagcttaatggagaaggaagagagagaggagatgccacttcaaggagaagatgagtctagaagaagctcaccaccatag

SEQ ID NO: 62773 - DNA, 246 bp, Glycine max
  Peptide Sequence Number=SeqID_154458
atggcctcatcaaactttttatttcctgaagggaactctataaataggtctcctatattcaatggtgtggattatcattactggaaaacccgtatgcaaattttcatagaggctatagatttaaacatcagggaagccattgaaattggtccttacatccgtactatggtagtaggaaatgcaactatagaaaaacctagggaacaatggaatgaagaagaaaggaaatggtacaatataatttaa

SEQ ID NO: 62774 - DNA, 166 bp, Glycine max
  Peptide Sequence Number=SeqID_154459
atggctagatttaattcttcttggtacctactgatgatggctaacatgaaagctggagttgctgcacatgatgtccaacgttatgtcaaggaatcagattgggctccacaatgcacaaggcaagataaaatgccaaatgaagaactgaagctgcaggatccacgat

SEQ ID NO: 62775 - DNA, 417 bp, Glycine max
  Peptide Sequence Number=SeqID_154460
atgatgcatgcacatgacctcaactctcagatgcaatgcggtacgtaccgtatccaataccaaggaaatagccctaagcgtgtctacacgacacctcacttaggaaaccatgcagtatttgtcgaggtcacccagtcgtgcaccgtaactcccccccccctaggtgatcaacctggggccacaaggagttccctaccagggacgtccgacaaggtcaatgcacccccgcccccccccccccccatgaacatacactacatccaacgtatgaacgttgccaaaagccatccgacaaggtcagtgcactccgccccccacgaacatacacaacatgcacttgtcaatgcatttccaacatcatcaacattccatttcaatgacatccccaataaccacaacaacctcattccatattga

SEQ ID NO: 62776 - DNA, 276 bp, Glycine max
  Peptide Sequence Number=SeqID_154461
atggatcaagttcaacttcaagccttccgcaaggcatatgggaaaatctgggatttggccatgatagaagtgtctgctgaagccatcgcatccctcgctcaatattataaccagtcgttaagatgcttgacgtttggggactttcagttggtaccaaccatagaagagtttgaagggatcttggaatgcccgctaagagtaaggaaaccgtatctgttttccaaattctacccctccgtggaaagagtagcaaaaatggtcaagatctcgacataa

SEQ ID NO: 62777 - DNA, 696 bp, Glycine max
  Peptide Sequence Number=SeqID_154462
atggggacaaatcaaaccggcaagaggttttaccaagtcaaggttaaaggcctagataccaccaacatcaaggaattagggcggttgatggaacctctccaaatgcaagccttccgtaagacttacggaaagatcttagagttgaccatagcagaggtatccatagaagccattgcatcactcacccaatactacgaccagcctttgagatgcttcacgttcggagacttccaattggtaccaaccattgaagaatttgaggaaattctaggatgtcctctcagggaaagaaaaccatacctttcctccgggtgtctcccctctttgagcagaattgcaactgtggtcaaggattcagcaagaggtttggaccacataaaacagactcgaaacggcatagcgggcctaccacggaagtacctagaagacaaggcgaggggtatggccaatcaaggagattgggtcccgtttatggatgtgttagctttgctaatttttggggtcgtcctctttccaaacgtagatggtttggtggacctagcagcaatcgatgctttccttgcataccaccatagcaaggaaagtccggtggtagctgtcttggcagatttatttgacacatttaaccgaagcaagacacgaggcatccatgtccgctccagagccatcgctcatgtactgaaaagagaagaatag

SEQ ID NO: 62778 - DNA, 267 bp, Glycine max
  Peptide Sequence Number=SeqID_154463
gatcggaatggtcaatggctgaagaaagacgcactccctcctcaagatgagcgtactccttcacctcttcttcagcgtgaagattcagcactcctgaatgaagtccttaccgaattacgaggtcttcactcttatgttggtgaacgtttcaactcattggatacacgctttgccggcatggatattcgcctcacacaagttgaagaagatgtctccttcatccgtagttgctttgatccaccaccaccgcctccatcatcctcttag

SEQ ID NO: 62779 - DNA, 297 bp, Glycine max
  Peptide Sequence Number=SeqID_154464
atgtctgaagaagtttatatgaatgaacaaaatgaagataaagatggtgtgaaatcaaaacatgtcgattgttctaatgtgttcaatacttctcaggtgtttgctacccgcgatgatgttttgaattgggctcgagttgttgcttatgaaattggttttgtggtagtcattatgaggtcagacacaaacactggtataagaggaaggacttcatttgccttaattggttgtgaaaggagtggtcagtgtaagtctaggaagaaagaaatattttgtaagaagagatactggcagtag

SEQ ID NO: 62780 - DNA, 255 bp, Glycine max
  Peptide Sequence Number=SeqID_154465
atggagtggttctacatgatatctcatcccttcatgagtctgacacaacccggggatccttctagacatccactagtggtgcatgatgacacatttgttgaatcaaatcttcctcagcagccaatgacgacaggggccatggatgaagcacctgcagatgcacctgctgatgtagagaagcctcgacatgcagtggcttgccaagcaatagctaaaaggttggaaaagttgctcaacctaaggatagtgacttaa

SEQ ID NO: 62781 - DNA, 309 bp, Glycine max
  Peptide Sequence Number=SeqID_154466
atgggaggaatcaaaagaattctcagactgtgtcgttttgaattctttgataagggagaagggagacacaaaagaattcaggcggttagtcctttgttcttttggaaaagggagaagagagacacaaaaagaattcaggcgagggagaagggaatgaaaaagatgaatagcacaagttttcaaggtttggaaaaccagaaaatttcagaaagcttttggtacaaagaagaagaagaagttcaaagagatttcaaggcttgtaaaggattgattggaataagtgttcaagattgttgttcgaaagattga

SEQ ID NO: 62782 - DNA, 858 bp, Glycine max
  Peptide Sequence Number=SeqID_154467
atggagttgctcaaggtctcgggtcaggaggttagagctgagactgcacaggcgcgtggggcatatatacgtctgtcgtggttaaatgaagcttctcaaagtagtagacgacaacttgttgggtacattactttattacagtgttggatatataagcattttcctagtattcatggctgcatcattgacgatgcgtatgatgagacatccccatgtgtctgccggtggcttacgacgaaggcttatatcaagggattacgagcatcggcgtaccagacacgtttggatgctttgacgatcactgacgtgtgttggatgccctatggtgaccaccgaggaatggtgaccaccgaggagttagaggataaggaggtacgacagttcgggtacattcagaccattcctccaccgtctgttagtgcctccttgtcatatgaggatatcaacgataggtggatgcattacgaggaccatatagcagctgtgggtgagatttttgttgtgcttgggcaaatattagcatattacatagagtggttcttccgaatatctcatccgttcgtcacacccacacaggtaggtgatcagcccaaacatccacctgccccacagcatgaggaatacatcgagccaagtattccgaaggttccagtgcgagcagacgttggaccatcacaggcacttgcagtggatggttgtgaagcgatcgcaaaaaggttggagcgtgtgctcaacctaaggatggtcactgaaggcatagagttacatgagatcgtggaagattgcctcaggattgctaggggggtggaaaaagaattaagtctagtagggattaccaatgttgtagcaatactatag

SEQ ID NO: 62783 - DNA, 279 bp, Glycine max
  Peptide Sequence Number=SeqID_154468
atggatttatgtcatccgaagcaagaccaagccataggtttcttagttccgctccaaattcaggatacaagtgatcaattgtcttccattgtggagaatcagcgggatatcagagtaacccatcattttttctgccaactgcatgccatgctagtagctggtgtctcgctaagcgaggcttgtgcgcttagcgagagtcatgcgctaagcggggcactcagcctgcttagcaagttgggagaatctggaggagaatctgagaaatatttgcacgcttag

SEQ ID NO: 62784 - DNA, 1230 bp, Glycine max
  Peptide Sequence Number=SeqID_154469
atgctgcacaacgtgccaagtaatgaaaacttaaggtttctaggacagactagagaaaatgtacagatcatggttaggactagaggcttagaccgtgccttaggtagggttgtcgatagaggtctgggtagaggggatcgtgatgattctgatgactctcctgtggtacctggggctgagcctgcggtatttgccgatgagccaatggtagatgctcacatacaggacactagtgcagacattggtgcagacaccggtgcaaaggctgctacagatgagcctgagggatttcctggtggaccgatcaatccattcgtgcttaccgagtatgctgagcatgttgcaaccaacgaacgtcctgagttgaagttgtcctcccacgggaggaagatgcaaaaattaggcaggcctgcccctgccattgaagggctagtggcactgggagacgagcagtttccatcttcctgtgggggaggttaccatcatgctggacgacgtggcatctcttcttcatttgcccatcattggcgagttccataccttccaacctctgcacgtggacgaggtggtgctgatgttagtcgacttactactagtctcaccagaggtagccaggaccgagacaggacattgtcatggaccgctagacattggacagctgcagctcgtgcgtatcttcttcatcttctgggttgcactctttttgctaacaagagtgcaacctatgttcatgttgtgttcttggatgctctgcgtgaccttagtcagtctgggaggtatacatggggagctactgccttggtgcctatctacgatcacctgaatgatgcttgcatcagcaccggccaacatgttgctgaatacgatgaaaagcatatccacagagacgtacaggaagtgcctggatcgattgaggattcccgatgtctgctggatgccatatggggagcactgacagagagggtcatgcgccagtttggatatgtccagagtatttctaccccgcctgtcgattcatgggtgtcatttgatgagataaacgacaggtggatgcactactcaaaccatcttgcgctagcagatcctctgcgagatgcacctgctacgcagcccagacatatccctcatattcctcaagtgccaaagccacatatccctcaggtcctggagctagcagtagcatcaacacctgccacgtctgatgtggacgccaggcacattgacacatga

SEQ ID NO: 62785 - DNA, 103 bp, Glycine max
  Peptide Sequence Number=SeqID_154470
atggatcgcggtttgttgaccttgggtcttctgttcatcggtttcttcggtgcaccttttgtgttaacctttgctggagaggacactcggactttcgatcagg

SEQ ID NO: 62786 - DNA, 189 bp, Glycine max
  Peptide Sequence Number=SeqID_154471
atggccatccaactacatgtatttcaagtacctctgaaaatctccaagatccctagcaagcctcaagatctatatatcataaaggtcgacaaaagcgggtcttttgctcctacgtaccctccatcgaagaggaaatcagacctacgtagttctttcttaagagtgaatcaagtgattctttttacttga

SEQ ID NO: 62787 - DNA, 894 bp, Glycine max
  Peptide Sequence Number=SeqID_154472
atgaaggatatgtctatcctttatgaagatgcagatgctccagttcctgtacccactgatgaggttttcttagtggggcagacacttcacaccttccttgcttggccgacacatctggtcaagtctttatcacagcaggtagctgtgtctccggcaaaaccacctccaaagcccgatccggaggtcgatgatctgctttatctgatgacattgaccatcccagagcttttcttgaggccttatcaggttagatgggatgctaccgtgttcggggtctttaatccagatttccccctctacataaagcacgaagacctctcagaaatcgcacacggtggtcaatgtctcagcatatcagtacatctcactaaaacatgtatgcgagtggggaattctgatatctatggattcctcgagccacagtccattcagaggtctgggcaatcgcagtttgagtgtgaaagttacataaagagttggatgcagagttcacaacgcgatgtctatcttggagcctacctaaatggcgaacactggcagatggtggtcatcctgcccaaggaacacctagttgtctggttttgttcattgcataacaggccagacaactaccttaaggggattattaatagtgctttaaaaggtcttgatgatgctccacagcctaaatcaaaggattctattaggtggattgtcgtcaagtgtaatagacaaaaaggaagtactgagtgcggctactatgtgatgcaccggatgtccaccatcattttaggaacttttaggaataattgggaagcttattttaacgatcctagaccattggaggtagagagattaaaggcattgcggatccaatgggcacagttttatctccgagttagagatcagacctag

SEQ ID NO: 62788 - DNA, 270 bp, Glycine max
  Peptide Sequence Number=SeqID_154473
atgactactccacccagctctcctcctcctcttcctcctactgatgcagcatcacaatcgccgtctaccttgaagctgaatttgatatccctgaaacatctgatgttaggacaaaaaagaaaatacttcagactgtgggggagcgatggagataccaacaaggacagtgttaatgacactgtatgcgaacaatatagcattagcaaggagaaatgggcccaattttgtcagagccgcagagacctttcgtgggaggtatctactttatga

SEQ ID NO: 62789 - DNA, 105 bp, Glycine max
  Peptide Sequence Number=SeqID_154474
atggctgccaagttagggcaacagacggtggagctatccactctcatcacacgcgctactaatgatagattgaatacaatggttcttgcggaaagtttgcactaa

SEQ ID NO: 62790 - DNA, 309 bp, Glycine max
  Peptide Sequence Number=SeqID_154475
atggtggacaacagtgtgcagtggcaaatgatgttaggctgggctctggataacatatctgagcacaatgaaggtgttggagataggcaggatttgggcactcgtgcacttgccatttcattagagtgcttgagagaatcagtgtgtctagcctttaaaaataattgtagtgagcacgagttccccaaactcacctatggtactcaatacaacatggtaaagagaacaaagagtcacaaaatgtaccttcgatggagaagaacagagcacgaagaagaatcttcgatggagaagaatagtcacgattag

SEQ ID NO: 62791 - DNA, 312 bp, Glycine max
  Peptide Sequence Number=SeqID_154476
atgatgacaacaaaagatgatgacaaaagtgatgaacaaaaagctcaagtgaatcaaagaacatccatctcaagaatcaagattcaagattcaagttcaagaatcaagaagaattcaagactcaagaagaaagcctacaaacaaagattcaagatctcaagaatcaagatcaagattcaagatctcaagaatcaagatcaagattcaagaatcaagaatcaagactcaagatctcaagaatcaagatcaagattcaagactcaagatctcaagaatcaagatcaagactcaagactcaagattcaagaatga

SEQ ID NO: 62792 - DNA, 720 bp, Glycine max
  Peptide Sequence Number=SeqID_154477
atgtttgggcctttttcccttataaatgtagttggtggcattgaagagtttgatgatgctggacaaagccggaaaaatatggttgaagtagcaactgtgatgaaaataattaaaaattgttttaaaggacatttccttaggagtagcaattgggtcatccacacagatatctatgtttgtgtaattgatggcttgatgcagcattcatggtccataatctgcgacaattgcagggtacaagcaagcaagcaggggaaggaactttgtatgagaaagaggtttgaaagggtcagcgccccccagacaggcgcttccacggagcacgctacacgtggcacagcgcggcgcacgaggcagcagcagggtagcgcccctgacgagggcgcgtctggtagcgccctgccgctgggcgcgactggtggcgctcagcgcgtgggcacgactggtcatgcccctaacgcgggcgcgacccaggcgccttccccccacacccccaagcctcttcccacaccccccccccccggtctcttcttgtcacaccccccagcctcttcccaaacccctcagtctcttcttctcacaccccccagcctcttcccacaccccccaccccaaaatttcccacatggccggtcccaatttctagctgccctatcaggatttcttcttctaggattcgccctttcatccacttggtcagcctcgacagagaaatcatga

SEQ ID NO: 62793 - DNA, 393 bp, Glycine max
  Peptide Sequence Number=SeqID_154478
atgatgggggaacatcttctaatttcaaaggaagaggtggcagatctggttatgaatatagaggaggcagaaattatggtaacaatgataacagaaactatggaaataatgataacaggaatttttgaaatggtaatcacaggaattatggaaaagctggaaattatggaaatacttaaggctcttggtcaagatgtcagttgtttgcttattggaaggcacaaatggcaagcaaattattccagcatccaatttctcgtttataaagtggtgatcaatctcaatgtgcttcgttctatcatgttgaaaaggattgtgagctatgcttattgtagccttgctgtcacaatacaactccaatgggagttctattgccatcttgagttcttctaa

SEQ ID NO: 62794 - DNA, 492 bp, Glycine max
  Peptide Sequence Number=SeqID_154479
atgttattccggccaggccatatagaaaggagatacatagaagtgccgcatggtgcatcttgggctgaagtaacgatgaaaacatcagctgtgcccactgcgaagacctttgaaatgggagacttctgtaaattttccttctctgctgccaaaagcttttcctttagggtagtaagcagtcagacattggaactagtcatttctcagttttggcctagcggtacagggagtcatgagactgcgagtgtggattttgaggttgttttgcacgggataaaagtcaatgaagaagaagttatacttgatggtagtgacgcccctgtcaggattgatgctgaaactctactggtatttgaggaacttgcaccagtggcacttctaaacaagattagggttccatatcgaccaataaattctaagattattgcactttcaacagatcgtgacaaacttccttctggaaagcagatactggcactgactttgaagtga

SEQ ID NO: 62795 - DNA, 177 bp, Glycine max
  Peptide Sequence Number=SeqID_154480
atgtccaccattagcatcatttccactcagagatgttcaaattttattggcaacaggggtggtgcagggggggtagcaagtaagtcaatggggacagacaggggagagacagaggagaggatagaagctttgattgcttcaaacaagaaggtgtcatccttccttgtttctgtctag

SEQ ID NO: 62796 - DNA, 933 bp, Glycine max
  Peptide Sequence Number=SeqID_154481
atgacattctgcaaacagtacttctcaatgtatttggtttcttcactcagggtttatgggtttgtttctgtgatttcaatgctaactgtgactgcctactctttcacgattgagaggaagtatggcgtcttcagcaaattagatgcttgtacatttgttgttaatgtctataatgatgggaatgtcttaagtattgtaacagactgttctggacatggcacccacgttgctggtatagctactgctttccatccaaagcccttattgaatggaattgcacctggtgcacaaataatatcttgtaaaattggggattctcgcctaggttcaatggaaacaggaactggtttgattcgggcactgatagcagctcataagagtgaccttatcaacatgagttatggtgaagcaacattactgccagactatggaagctttgttgatcttgtgaatggggtggtgaacaagcatcgtctgatatttgtgagcagtgctggtaatagtgggccaggactgagcactgttggtgcacctggtggtacatcttcaagtatcataggtattggtgcatatgtgtctcctgctatggctgctggtgcacttgtgttgttgaacctccatccgaggggcttgaatacacttggaccaacagctgatggagaccttggtgtgtgtgtgagcgctcctggtggtgctgttgctcctgtccccacatggactcttcaacggcgtatgctcgggattgggacatcaatggcatcaccatcagcctctggtggaactacattgctcataagtgcaatgaaggctgagggaatccctgtgagtccatactgtgtgaggaaggcacttgaaaatattgcgattcccataggtgatttacctgaggataaattatccaccggacaagggcttatgcaagttgacaagtaa

SEQ ID NO: 62797 - DNA, 240 bp, Glycine max
  Peptide Sequence Number=SeqID_154482
atgtggagtgggattgcgaaggctcagtcgctgaagaaggtcgtcgatggtggtggccaaggtgtcaacggcagcgacgaggttgagttgactgagggtaagtttggccaaagaggtctcgaggcggtccacgccaatgggaaaagattcggcatccgccattcgaggtgtatgctgaaatggaaggaacagaggtggttgctgatggagggtagtgtggagaggatggcgtgggaatag

SEQ ID NO: 62798 - DNA, 600 bp, Glycine max
  Peptide Sequence Number=SeqID_154483
atgcatagccaaactccaaactccaaacaaaagccaccgcttccaccttcgacttgcatctcatcaaaacgataccgtattgctcacaagccgatgccttgctcttccttcacttccactaccaccaccggcaatagcagcaacatgaagaagaaagatggttcttctctccgtgaattcaagctgaacgaatcaaccttcttagcttcgctcatgcctaagaaagagattggcgtggatcgcttccttgatgctcatcccaaatacgacggtcgtggcgctctcatcgctatcttcgattctggtgtagacccagcagctgatggattacaggttacctcagatgggaaaccaaaagttctcgatgtcattgattgcacagggagtggtgatattgatacctcaaaggtggtgaaggccgattctgatggtcgtatttgtggggcatcagggtgcctgcagaaaaagggaaataacagtaaaaggaagaagagaaaaggtttccagagagctatagccctccctagtgagagaaatttctctgcactcccatattcattagtgatctccacaatgtggttacaatccccacccttataa

SEQ ID NO: 62799 - DNA, 1527 bp, Glycine max
  Peptide Sequence Number=SeqID_154484
atgcctaagaaagagattggcgtcaatcgcttcttcgacgctcatcccgaatacgacggtcgcggcgctctcattgctatcttcgattctggtgtagacccagctgctgatggattacagattacctcagatgggaaaccaaaagttcttgatgtcattgattgcacagggagtggtgatattgatacctcaaaggtggtgaaggccgattctgatggtcgtatttgtggggcatcaggggcatcattggttatcaatacttcatggaaaaatccttctggtgaatggcgtgtgggttataaattagtttatgagctattcacggaagatgtgatttctcgtttgaaggtgaaagaaagaaagaaaaagtgggatgagaaaaaccaggaggaaattgctaaggctgtaaaacaacttgctgactttgatcaggtagaagacgtaaaacttaaaatgtcccgggaagatctccagaatagacttgatattctgagaaggcaatctgagagctatgatgataaagggcctgtcatagatgctgttgtctggcatgatggagaggtttggagggtagcccttgacacacagagtctggaggatgatccaaattgtgggaagcttgctagttttatgcctttaactaattataggattgagagaaagtatggcgtcttcagcaaattagatgcttgtacatttgttgttaatgtctatagtgatgggaatgtcttaagtattgtaacagactgttcggcacatgccacccatgttgccggtatagctactgctttccacccaaagcccttgttgaatggagttgcacctggtgcacaaataatatcttgtaaaattggggattctcgcttaggttcaatggaaacaggaactggtttgattcgggcactgatagcagctgtggagcataagtgtgaccttatcaatatgagttatggtgaagcaacattactgccagactatggacgctttgttgatcttgtgaatgaggtggtgaacaagtatcgtctgatatttattagcagtgctggtaatagcgggccaggattgagcactgttggtgcacctggtggtacatcttcaagtatcataggtgttggcgcatatgtgtctcctgctatggctgccggtgctcattgtgttgttgaacctccatctgatgggcttgaatacacttggtctagccgaggaccaacagctgatggagaccttggtgtttgtgtgagtgctcccggtggtgctgttgctcctgtccccacatggactcttcaacggcgtatgctcatgaatgggacatcaatggcatcaccatcagcctgtggaggaactgcgttgctcataagtgcaatgaaggccgagggaatccctgtgagtccatacagtgtgaggaaggcacttgaaaatactgcaattcccataggtgatttacctgaggataaattatccactggacaagggcttatgcaagttgacaaaagtgccaaaatgttccatgtgtttggtatcaaataa

SEQ ID NO: 62800 - DNA, 66 bp, Glycine max
  Peptide Sequence Number=SeqID_154485
atggctgcaccatttttctcaacgccctttcagccttatgtttatcaggatggcttcattgtatga

SEQ ID NO: 62801 - DNA, 402 bp, Glycine max
  Peptide Sequence Number=SeqID_154486
atgcaacctttagctgcacgtgtgaacataaagggtagctgcgctgcacttgaggcacaaggatttcctaaacagccttatgatgttgatgtggatctaatggggttgttcttagttgaagatgaaagtactttgctagtggccttgggaaaagtgtacaacaattcatccaccatacacaatgttcgttatgcagatgacgttgttagggtgaaggttgtccaatatcaccactcggacgtgaggtcccttatcctacatcagaggttcgatagctcaatcagttcgttggcacattcatcgcatggcccagacatcttgttagaaaagtggtgttggtacccaataagcctccaccgaattctgttgaacagcttgactaggccaatgttgtggccatag

SEQ ID NO: 62802 - DNA, 2973 bp, Glycine max
  Peptide Sequence Number=SeqID_154487
atgtcagagtccaaggatgaaaatcctgaccttcctcccaagtcaaagccacaggaggaacatggttttgccatggattttgacattagcctggaaagtctatggccctcggatcatatatctttggtctctaaccccatgtctccttttctcttttccactatctctgaccaaccttgttctcctgtctgggctttttctgatgccgaagatgagaggctaatcaggattgcagcttcagcaggtaatacaaatacaacaactgaaaatctagttgaaaattatgacaacaaaaaaactgtgccaccccttgtagccatcccaacttcagaaaatccagatgcttattgtctaatcaaggaaagaatgacacaagcgcttcgccacttcaaagagttgactgaacaaaatgttctagctcaggtttgggcacctatgaggaatggaaatcggtatgcacttacaacttcaggccaaccatttgttcttgatccacatagtaatggactccatcagtatagaacagtttccctgatgtatatgttctctgtggatggggagaatgatgagatcatgggacttcccggccgagtttttcagcaaaaaattccagaatggactcccaatgttcagttttattctagtaaagagtatcagcgcctaaatcacgcgcaacattacaatgtccgcggaaccttggccctgcctgtgtttgagcttgcaggacagtcatgtgtggctgtagtggagttgataatgacttcacagaagattaactatgctcctgaggttgataaaatctgcaaagcccttgaggcggttaagttgaggagttcagaaattttggagcatcaatacattcagatatgtaacgaagaccgccagtatgcattagccgagattttggagatactgacagttgtgtgtgaaactcatagtttgcctctggcacaaacatgggttccatgtaagcatcggagtgtcttagcacatggcggtggtcataagaaaagttgctcaagttttgatggatgttgcatggggcaagtttgcatgtctataactgaggtagcattctatgtaatagatgctcatacatggggttttcatgaggcctgtgttgagcatcacttacaacaaggtcaaggagttgctgggagggcatttttgtcccacaacatgtgcttctgtggaaacatcgcccaattctgcaaaactgaatatcccttagtacattatgcactcatgtttggtttaaccagctgttttgcagtatgcttacaaagctctcataccggaaatgatgattatgtgctagagttttttctgcctcctgggatcacagactttaatgaacaaaaaagattgttgggatccatattggcaacaatgaagccacattttcagagtcttaagattgcttctggcattgaacttgaggaaaatgcttcaattgaaatcatagaagcaagaaatgaaagagttaatttgaggtttgagtccattccaattactcaatcttctaagtcaccacctagacatgcctcgccaaatgtgggggaggggctgccactggagccatcagaacagaaaataatggcatactttgatggtataaatgatggagggagtcttggtgataatgcaggtggacacattgatcagaacacttccttaaagatcaaaaccaaaaagaaaccctcagagagaaaacgtggaaaagctgagaaatcaattagtcttgatgttttgcaacattacttcacaggaagccttaaggatgctgcaaagagccttggtgtttgccctactacaatgaagcgcatctgtaggcagcatgggatatcacgctggccatctcgaaagataaaaaaggttaaccgttccctgtccaagctcaagtgtgttattgaatcagtccatggtgctgaacgagcatttggtttgaattctctaagtaccgtttcacttcccattgctgccggttccttttctgagccatccacttcaaacaagttcaaccgccaaacatcattgaccattaggccatcggaacctaagatcaatgaaaaggattttgatgcgtctggagcatcagaaacaaaaaggcaggctgcaatggaagatcaattccttggacttgaagcaagggcacaaagtcctgagaaagtgattaatgatagaggagtggccactcaggagattggcactaaaggcacaaacaagtttagaactggaagtggctcaagtgaaagcagtggaaatcctactcctcatggttcatgccatggtagtcccccaaatgaaatctcacctcctaaagatatatttgtaacaggccacagtgagaaatgtcttgtgttaagaggatcactggggtcaacaacactgcactcaactagtacaccgaactgcacaactgcataccctatgcctcacattgtagaaacgacagaacctcaagaactatttggaggacagctacttgagcgtgctggtagttctaaagacttgagaaatctatgcccttcagcagatgctgttttggaggatcaggttccagaagcttacaagatgaatcctcaatgttctgacttgcctcaaatgcaacacatggataaccttaataacactctgacaccttttgcagttaggaaagaggtgaagagtgtgactattaaggcaacatataaagaagatatcataaggtttaaggtctctatggactgtggtattgtggaactgaaagaggaaattgccaaaagattgaaactagaggcgggaacatttgatatcaagtatctggatgatgatcatgaatgggttttgatagcctgtgatgcagacctgcaggagtgcatggacatctcaagatcatcaggcagcaacgtaatcaggcttgtggtgcatgatatactgcccattctcggaagctcttgtgagagctcaggagattggaaaggttgtatatag

SEQ ID NO: 62803 - DNA, 348 bp, Glycine max
  Peptide Sequence Number=SeqID_154488
atgaagttcttgagatcaagaatcatagtggcagaaatgatacagatggatctatttttgggttgtaaagagaaggcaagccctacgtttgacacaaagggagagccaaggactgaactgatggcaacaaagaaggcttggggtttggagaccgccaccaaaaccaccaaattcatattcttccatagagtgcgatgggatgatgggtcatcatcaaagatagagctctggctgttgtgggctgtcgtggcccccactattcacccgctagaccaagttttttttgcaaggaagacaatgggtatcaagggaatagttgtcatatcacaacccatgatctgcaatcag

SEQ ID NO: 62804 - DNA, 408 bp, Glycine max
  Peptide Sequence Number=SeqID_154489
atgaatgcaattacgcagggaaaattagcagatggcaaagaaattgttgtcaagagactttcaagcagttctggacaaggaataactgagtttatgacagaagttaaagtaattgcgaagcttcaacatcgaaatcttgtaaagcttcttggctgttgcattagaggacaagaaaaaatactagtatatgaatacatggttaatggcagcctttactcctttgtttttgacaatataaggaaaggtttcacagaatcaacagtgaacaccgaacaattgagagacgaggttcaagacaaagcagaagatgacataataggacaaaataaattaagagtagtactgtgttgtgaaaggaatagggcaaaaaaagaagaaaaatgcttggtggtgagaacaaacaagtga

SEQ ID NO: 62805 - DNA, 849 bp, Glycine max
  Peptide Sequence Number=SeqID_154490
atggcttctccacttgcctcccctcctccacctcctgctccttccgacgcatcggctttgccgtctaccgtgaagcggacacgcaaagcctcacggtacatcctttgtggtacaagtagagggtacatctacttgggtttgactgaaaacaagagagggtacatctcttgtggatcagttctagtggagggtacatccactaggttcaaagagaacaagggagggtacatcccttgtggatctttgcttgtaaaaggatttttacaaggccactcgatcccacaacgtctacgagcattgtctactagatccactatctctagagggacagtggtccatgttgatcctgctaccgataaggccgatggtccccaaaggaagaaattaagaatatatttggggattgtggcgcgtgataagatggacatcacctgcgagaactggaaagaggtccctactgctcagaaggacttgctttgggaggatattcaggacgaaaaggaagttactttagactatgggcgagagatagaggcaacctcacgaggaaatgagcccttgcagccgatcaagacgcagaagctcctggctgaggagaccaagaagctggaggaagctgcacaatcaggaagtgttgatggcgtcatcgacccttcatccctggtcagacgccacgtgaagtggaagatggcccgcacgaagaaaacaggggagatgacaactgaggccgcaaaggaaatcgttgagaagattattcctttgaggagcaggcgacacagggatccttcgtcccccatggacgttaggatgttctcaccgctgcaattggatgtccagagcaccctggac

SEQ ID NO: 62806 - DNA, 780 bp, Glycine max
  Peptide Sequence Number=SeqID_154491
atgtcaggtggtgttgggccaacaggctgtgacattagcctcccaaaagaacaagaacttagtttcaaagaacaacaagaccaacaacaatcattactcaagaatctcaacaagcccaccacaccaccacaacaacacaaagtgggtactattctctctttcaaccagctcaattccctggctgtggtaattgtcctatctgccagtggcttggtaagccctgaagactttgcctttgtgttcttctcccttatttacctgcacttcatagccaaggtggctttcccttctcttcatccatcaagggacccccaagaagtcttcaacccccaaaacaagctcatccaactttataccctcatcggtgccaccattgggcttttcatcccaatagcctacattttcgagggtgtttttgagggtgacaaggaagggatcaaggcagcagcaccgcatgtttttctcttggccagccaagttttcatggaaggagtggcatcatcatcatcacaaaggttctcggctccggttcgagcttttgttccagcattctacaatgcaagaaggattttcaccattgtggattggcttaggagtgaggtctataagatagatggcgagcacagtgggtctgcttggaggattcatgttgggagagcacttgcaatggccaatatggcctactggtctttcaatctatttggattcctgttgccagtgtttcttccaaaagttttgaagctgtattactcgtctgagtacaatgacaaagaccgatga

SEQ ID NO: 62807 - DNA, 951 bp, Glycine max
  Peptide Sequence Number=SeqID_154492
atgcttgtagtatcatgcatacacgagctcttaaatcttaattacatatttttgttggtggttgacattctaataacaggaacaacccatggtattggtactgagactgcaagagttcttgctttgcgtggtgtacatgtgattatggctgcgagagatgtgattgctgcaaaagctgtcaaagaagcaatacttaaagagattcccacagccaaagttgatgccatggaattagaccttagctcaatgacttccgtcagaaagtttgcattagagtatatttcatctggtcttccattgaacatcttgataaacaatgcgggaataagtgcattccctttcacgctgtccaaagacaacatcgaactacaatttgccacaaatcacttaggtcattttcttttaacaaatcttttgttggatactttgaagaaaactgcaagtgaaagcaagaaagaaggaagaattattattgtctcctctgacggtcaccaatatacatatcctgaaggaattctttttgataaaattaatgatgaatcaagttaccagaagtggcatgcatatgggcaatcaaagcttgccaacattttacatgccaacgaacttacaagacttcttaaagaagatgggatagataatattactgcaaattctcttcatccaggagctattatggacaccaatatttataaaccagagattaatggccctgtgccaactgatctaattaataggctagggagttttctgctaaaaaatatccagcagggagcagcaacaacatgctatgtagcgttgcacccacaagtgaggggaataagcggcgagtatttttcagataataatctggctaaagcgagttcactggcaaaggacactaatttggctaagaaactttgggatttcagcatgaaaacaattgattacaatacccatgagcaaatctga

SEQ ID NO: 62808 - DNA, 405 bp, Glycine max
  Peptide Sequence Number=SeqID_154493
atggcgagctatccctcaagagctcagatgaaagcaaaatcttccaagaggaagcaaggcaaatgctctcacgctgctactcttaacaagttgaacacatgtaagatgcaaacctataagggaatgcttcttgacccaataaggaacttgaggaattgcttaggagttggtggactgactgcagaggacaaaatgttagtttaccttatcccttacattgtcactctgaggtcaagtaatcatgctcagattgtgctcgctataaatctagggatggatccaaaagaggcaatgtcaaaagtgaacacactatctgatgcaatcctacccccccaagggcattggatagaagactccaagaagattgggccaaagatgcaagagaaggccctaaggttttcatga

SEQ ID NO: 62809 - DNA, 530 bp, Glycine max
  Peptide Sequence Number=SeqID_154494
aagccattgcatcactcacccaatactacgaccagcctttgagatgcttcacgttcggagacttccaattggtaccaaccattgaagaatttgaggaaattctaggatgtcctctcgggagaagaaaaccatacctttcctccgggtgtctcccctctttgagcagaattgcgactgtggtcaaggattcagcaagaggtttggaccgcataaaacagactcaaaacggcatagcgggcctaccacggaagtacttagaagacaaggcgaggggtatggccaatcaaggagattgggtcccgtttatggatgtgttagctttgctaatttttggggtcgtcctctttccaaacgtagatggtttggtggacctagcagcaatcgacgctttccttgcataccaccatagcaaggaaagtccggtggtagctgtcttggcagatttatttgacacatttaaccgaagcaagacacaaggcatccatgtccgctccagagccatcgctcgtgtactgaaaagagaagaatag

SEQ ID NO: 62810 - DNA, 126 bp, Glycine max
  Peptide Sequence Number=SeqID_154495
cgtgatgtcgtgacatccggtacgacatctgtcattggtatcagaatttcaacaaggaatacccacaggaggcctctaacaacgacaagagaacgttgcgaaggttggcagccggcttcttcttga

SEQ ID NO: 62811 - DNA, 384 bp, Glycine max
  Peptide Sequence Number=SeqID_154496
atgggattattgagattacgccaacatgaagaaaatgacaagaaaaagaaaggaattgctcttaaagcctcatcttcaatccaagaagaaagtgataaggaaaatgatctagatgaagatgatgatctaagcctttttaaggaacacagaaacttcatcctctacctaaaatgctttgagtgcaatcaacctggatatctgagggttgattgtcccatcttcaagaaaaagatggagaagtctgaaaagaaaaatcttagtgaaaagaaattgaagaaagcatacatcacatgggatgaaaacgatatggaatcttctgaagattcaaaaaatgaagagataaacctctgccttatggctaaaagttatgaaagtgatgaagag

SEQ ID NO: 62812 - DNA, 432 bp, Glycine max
  Peptide Sequence Number=SeqID_154497
atggcagcgcaattaatccatgaccgagtagagatggagtgcctagagggagtttgggagaccctcgaaggcaatgtgaggtgccgattccggggcacgattcgattcacggctacttcgttggtacatccagaggaaccagcacgcacgcttcagtgcactgtggagtggatattacctacacctactccatatcgactagtggagccagtccaagtgataaaggtgacgtcatctgaggaaaaccctgaggaggactcagaggagctacctcctgagcctgctgtggatgctattgactttctagagggtgatgaggacccactccctgaggtggattctcccgaggacgtcatgtcggcatctgaggcagactctacggagaagagcggtcctcgagggatagcgactagcggaggttcttcatcatag

SEQ ID NO: 62813 - DNA, 177 bp, Glycine max
  Peptide Sequence Number=SeqID_154498
atggacgaagatcaatggatgtatgacaatataatgtctgaagaagttgatatggattatcaaaatgaagaagaatgtggtgtgaatgaaccacatgttgatcgttcagatgcgttcaatacttctcagataataatgttcatgattgtgtttgccagccgagacgatgttttgtag

SEQ ID NO: 62814 - DNA, 243 bp, Glycine max
  Peptide Sequence Number=SeqID_154499
atgactatgcagaacatgcagtttcaacaagagaccagagcttccattcagagcttgactaatcagatgggacaattagctacacaattgaatcaacaacagtcccataattctgacaagctaccttctcaagctgtccaaaatcccaaaaataagcagcacattccccctcttccattccctccaagagcagtttccaacaaaaaaatggaagaggcagaaaaagatcttggaaacgtttag

SEQ ID NO: 62815 - DNA, 561 bp, Glycine max
  Peptide Sequence Number=SeqID_154500
atggaaacaattctccagaatccacaattgaattctgccaaattctgtgtttttactgaccttattcctcaaccacaaccatcgtctccacaatcctcatttccacaactacaactaccacctccacaacaattatcgtacaacaacatagacctcaataatccactatcttcgtacaacaaccttgaagcacaagacccctttgacatttatacttcatacacacaactattatccaaaaatgattctttatttgatgcccaaaaaacctcgtttgaccaacaaaatcatccttcatccctattacgccaccttcacaataaccacaaacgcaaacatcaaaccaaaatgaacatcacatcgctaacgaagatctcattatacgatttcatgacgaaaacatggatgattttagtgaggatgaggatcaacagttctttgatcatatcaatcaccaaagcaatgaccaaagtgatgaccaaagcaatgatgagggtgtcgacagaccaacaacacctctgtcacatccgttgcaatatcaccaacctaggtgtccagtag

SEQ ID NO: 62816 - DNA, 429 bp, Glycine max
  Peptide Sequence Number=SeqID_154501
atgaagaacgaacgaagaacgcagaaagatcttcacagatttgctcacggaaacgtctcagaagcgttacggaagcactttgactcgatttttcttcacgaaaacatgtttttttttacccaaaatagccgaaatgcaaagcctaggggtcatgaacattttggaacagcccctcctcccctatttatagggaaaaagggagtgaaatatgcttacccaaggttttcagaaattttacggaagcattacggaagccatggatgccctggacaccatttttcaacaaaacgtggaggagctttgatgcaatactaccccgcaagggcattggatagaagactcctagtagattgggccagagatccaagggaaggccctagggttctcatgagccttagggtagattttgagcccatgggctatgtatga

SEQ ID NO: 62817 - DNA, 381 bp, Glycine max
  Peptide Sequence Number=SeqID_154502
atggaccacgttgtagccaaggtgctcatcgataatggttccagtttaaacgtgatgcccaagagcactttggagaaattaccattcaatgcttcccacctaaagccaagttccatggtagttcgtgccttcgacgacacccgccgagagctgcatgttggggcacctgtggatccactcggtgggagttgttccctctacactccaccaaaagttgaaattcgtagtggaagggcatctgatcatcgtatcaagcgaggaagacatcttcgtaagctgcccatcctctatgccttatgtggaggccgcagaggagtcgttagaaaccgctttccagtctttcgaggtggtaagcatttcctccgtggattccttctctag

SEQ ID NO: 62818 - DNA, 252 bp, Glycine max
  Peptide Sequence Number=SeqID_154503
atgctctcctacaacctaagacaaggtagatggggattacagtttataggctcagggttaaagtcaatcaatcaaactttcagctcaacatgggtgcaagggataatttattcatgcccaagaaaaataaatgaaagtcttgccaacaatcatcctgagcagcagtgggctcatcctgagctggtgcaggctcgccatgaggtgaagaaggagtatcctgggctggctgcggtgtctcttgtgttgttatag

SEQ ID NO: 62819 - DNA, 234 bp, Glycine max
  Peptide Sequence Number=SeqID_154504
atgacaacagaatggagaaggaagagagagaggagatgccacttcaaggagaagaagatgagtctagaagaagctcaccaccataggaggccatggataagagcttggaggaagaaggagatgaatgaagggagaggaagagaagaacacaaaattttttgctctaaaagagctctgaaatctgaacccactaatctaagatcaagtccaagattctccactaagtgtgcttag

SEQ ID NO: 62820 - DNA, 561 bp, Glycine max
  Peptide Sequence Number=SeqID_154505
atgcgggttcagatgctggtggacttattgatggtctctccagagtctgctagggccgagacagcccagtgttgcggaccgtacgtacgcctgcaacgggtacgtgatatatacgagcgccgatgccagacaggtcattggacagctgcggctcgcgcatatcttcttcaccttctgggttgcactctgtttgctaacaagagtgcaaccaatgtccatgttgtctacttggaggcccttcgtgacctcagtatgacggagatgtacgcttggggagtggctgctttggtgcatatgtacgaccagctgaacgatgcatctatgagccacagccaacaactcgacggttacatcacattgctgcagtgctggatttacgagcactttccgtcggtcgcggactccactgctgataaggagtatgacgaggattctccgcgtgcgtgtaggtggattgcgaccaagaagaccgtgaagagcattcgtacgctgacgtacagggagcgcctagaccgaatccggattccggatgtctgttggatcccttatggggagcactga

SEQ ID NO: 62821 - DNA, 132 bp, Glycine max
  Peptide Sequence Number=SeqID_154506
atgcgggggtccggggaatttgtccccttcttagatacgacgtctagggtagggatcaagacagaacccatatgcaatgcctatgcaaaagacacaatgcgggaatgtacacagtatgacaatatttactga

SEQ ID NO: 62822 - DNA, 3244 bp, Glycine max
  Peptide Sequence Number=SeqID_154507
atgtcggcactgctggtgatgacgcaccgctggcttaaccgccgctggcagcatatggagcggctggaggcgcgcgcggaacgtattctggctggcgagcgcgcgccgcgcagcgataccatcgccgaatggccgccgaaagccagccgcgctatcgatctgctgctgggggatttacaggaagccggtgagcagcgtctgcgtatcgacaccttaatccgcacctttgccgcgcaggattcgcgcaccggcctgaataatcgcctgtttttcgataaccagctggccacgttgctggaagaccaggaagacgttggcacgcacggtgtggtgatgatggtgcggctgccggacctcgacacgctacatgaaaccctcgggccgacgctggtcgatgaatacctgttcgacctggtgaacatgctctccaccttcgtgctgcgctatccgggtgcgctgctggcgcgctatttccgcagcgactttgccgtactgctgccgcaccgcactttgaaagaggccaacagcattgccgaccagctgatcaacgcggtggattcgctgccgccgatgcgcatggtggaccgcgatgatctgatccacattggcatcagcgcctggcgcagcggcgagtcggtgtcgcaggtgatggagaatgtcgaactggccacgcgccgggcggcgctgcagggcggcaacaactggtcggtgggcgagggcaatacgctggagatggggcgcggcagcgtgcgctggcgcaccctgctggaaaacaccgtgaaccgcggcggcccgcgtctgtaccagaaaccggcggtgctgctggacggcaaagtgcatcaccgtgaaatgctggcgcgcgtgttcgacggcgataaagaggtggtgtcggcagagttcatgccgctggtgctgcagcttggcatggccgacagctgggatcgccagctggtcatgcgtattgcggcgctatcggaggtctggccggatgaaacgctggcgctgccggcggatgtttgtcaacacatcaatcgtttagtgccggttttccgcatgctgaccgcgtttggctgtcggattgcggtagatcaggccggattaacggtggtgagtagcgcttacatcaagcagttcccgattgagctgatcaagctcgatccgggcctgattcgcaacattgagcgccgtacagaaaatcagctgttcgtgcaaagtttgctggaagtgtgtaaatccacgcccaccaaagtctttgccgccggtgtacgcacgcgcgcggagtggcaaacgctggccgggctgggcgtcgcgggcggccagggcgacttttttgctccttcgctgccgagcggcagcttagcgccgtttaacgccggtgtcggacggcagcaccgccgcgaaaaattattcagcctggtttttcaccgaagcagaacgtttttgcgccttgtagcggcttcgcgtggacaaggcatcgtgctgaacgagccttctgtggttgccattcgtcaggatcgcgccggctccccaaagagcgtagcggctgttggtcatgatgcaaagcagatgcttggccgtacgccgggtaacatcgcagctatccgtccgatgaaagatggcgttatcgccgacttcttcgtgactgaaaaaatgctccagcacttcatcaagcaagttgagcgtcgtgccatccgcgaatcggcgcagggcgccggtgcccgtgaagtgttcctgattgaagaacccatggctgcggcaatcggcgcgggtctgccggtgtcagaagcgaccggctcgatggtggtggatatcggtggcggtacgaccgaagtcgcggttatctccctgaacggcgtggtttactcttcttctgtgcgtattggtggcgatcgcttcgatgaagctatcattaactacgtgcgccgtaattacggctcgctgattggtgaagccaccgctgagcgtatcaagcatgagatcggttcggcttatccgggtgacgaagtgcgcgagatcgaagtgcgcggccgtaacctggctgagggcgtgccgcgtggctttacgctgaactcgaatgaaatcctggaagcgctgcaggagccactgaccggtatcgtcagtgccgtgatggtcgcgctggagcagtgcccgccggagctggcgtctgacatctccgagcgcggtatggtgctgaccggtggcggcgcgctgctgcgtaacctggatcgtctgctgatggaagagaccggtattccggtggtagtcgcagaagatccgctgacctgcgtagcgcgcggcggcgggaatagcgacgatacccaaaatcagcacaacggcaggacgatggccatcgcatgccgcacggcagcctcagcagcaggcaccgggcagcagcggcacaacgtcgtcactgcggtttgcaggatgcgggaatttatgaagccgatttttagcaggggaccttccctgcagttgcgcctgtttctggccgtgattgtggctatcgcgattattgtcgccgatagccggatcagcacgttctcccagatccgcaactacctggacacgtcggtcagtccattttacttcctggccaacgggccacgacagcttcttgacggcgtttccgaaacgctggcctcgcgccagcagctggagctggaaaacaaagcgctgcgccgtgagctcttcctgaaaaacagtgacctgctgatgctggggcaatacaagcaggaaaacgcgcgtctgcgcgagctgctcggctcgccgctgcgtcaggatgagcacaaaatggtgacccaggtgatctccaccggcaccgatccttacaccgatcaggtgatcatcgataaaggcagcgtcaacggcgtgtatgaaggccagccggtgatcagcgataaaggcgtggtcggccaggtggtggcggtagggcagatgaccagccgcgtgctgctgatctgcgatgcctcgcacgccctgccgattcaggtgctgcgtaacgatattcgcgtcatcgccgccggtaacggctgcagcgaagatctgcagctggagcatctgccgggcaatacggatattcgcgtcggtgatgtgctggtgacgtcgggcctgggcggacgcttcccggaagggtatccggtcggcgtggtgtcgtcagtgaaagtggatacgcagcgtgcctataccgtgattcagcgcgtccgaccgccggtctgcagcgtctgcgctactgctgctgctgtgg

SEQ ID NO: 62823 - DNA, 2178 bp, Glycine max
  Peptide Sequence Number=SeqID_154508
atgacggctgaactgctggtaaatgtgacaccttctgaaacccgtgttgcctatattgacggcggcattctgcaggaaatccatattgagcgcgaagcgcggcgcggtattgtcggcaatatctacaaagggcgcgtcagccgggtactgccgggcatgcaggcggcatttgtcgatatcgggatggacaaagcggcctttctgcacgcctcggacatcatgccgcacaccgaatgcgtggcgggtgatgagaagaagaactttatcgtgcgcgatatcgccgagctggtgcgtcagggacaggatttaatggtgcaggtggtgaaagatccgctcggcaccaaaggcgcccgcctcaccaccgatattacgctgccgtcgcgctacctggtctttatgccgggggcttcacacgtgggcgtctcacagcgcattgaaagcgaagccgaacgtgagcggctgaaagcggtggttgccgcttactgtgacgatctcggcggcttttttattcgtaccgccgcagaaggcattggcgcagaagagctggcgcaggacgcggcatttttaaagcgcctgtggaccaaagtcagcgagcgtaagaagcgcaaccagacgcgctgcctgctttacggcgagctggcgctggcgcagcgcgtgctgcgcgatttcgccggagcagcgctggatcgcatccgcgtcgattcgcgcctgacctgcgatctgctggtggaatttaccagcgaatatattccggagatggccagcaagctggagctgtacaacggcaagcagccgattttcgatctctatgatgtggagaacgagattcagcgctcgctcgagcgcaaggtggaactgaaatctggcggttacctgattatcgaccagaccgaagccatgaccacggtggacattaacaccggtgcgtttgtcggccaccgcaacctcgacgaaactatttttaatactaatatcgaagccacgcaggcgattgcgcgccagctgcggctgcgtaatctcggcggcattatcatcatcgactttatcgacatgaataatgacgatcatcgccggcgcgtgctgcactcgctggagagcgcgctgagcaaagatcgcgttaaaaccagcatcaacggcttctccgcgctggggctggtcgagatgacgcgcaaacgcacgcgcgaaagcattgagcatgtgctgtgtgccgattgcccggtgtgccagggacgcggttcgctgaagacggtggagaccgtgtgctatgaaatcatgcgtgaaatcgtccgcgtccatcacgcttacgactccgacagcttcctggttcgtgaggttgaacgccgtaacccaacggaaagcaaggagaggtgtgtgaggcggttgccggggattttgttactgctgctcgccgcaatcatcgtcattgtggcgctgctggtcagcgggctgcgccttgtgatgccgcatctcaacagctatcgcggcgaggtgctgcacaccctttcgcgcgtcagcggcgtcaccatcgatgccagtgaaattcagggaaaatgggagaattttggcccgaccctgcaggtgcgcgatctgcgtatcgacatggataaagatggcgagctgcagattggccgcgttacgctggcgctcaatgtgtggcagtcgctgctgcactggcgctggcagtttcgcgatctcaccttctggcagctgcggctggcaaccaaccgtccgttgctcaccagcgacgagcaaaaaaacagcttcaaaccggcccaaatcaacgatctgttcttacgccagtttgatcatttcgatctgcgcgacagcagcatccgttttctcacgccttccggccagcatgccgaactggcgattccccgccttacctggctgaacgaggacaaccgccatcgtgccgaaggcgaagtgagcctgtccagcttcaccggccagcacggcgtggtgcaggtacggctcgatcttaacgataccaacggcttactcaacgacggccgcatctggatgcaggccgatgatgtggacgtgcgcccgtggattggccgctggctgcgtgataataccagcctgcaaagcgcgcgtggatggcctgaccgcgcatctggcgcgctaccagaatggctggagcctgacggtgccgcaaacccggctgatgactga

SEQ ID NO: 62824 - DNA, 207 bp, Glycine max
  Peptide Sequence Number=SeqID_154509
atggcaattttaatttccaatacttcaacaacatttcatagagatgaaagactctggaatacgtttatgatcccaacatggttggctcatgttaagaaggtgatatggaccttccagcttcctgtgacaaaagacaagaccaacatacaacgcatgcgtgatgacatgatgcagatgcacaaaagcacaacagagggatgtacatag

SEQ ID NO: 62825 - DNA, 339 bp, Glycine max
  Peptide Sequence Number=SeqID_154510
atgtaccctctcttgttctcagtcaaacccaaggagaagggagacacaaaagaattcaggcggttagcccttcgttcttttggaaaagggagaagagagacacaaaaagaattcaggcggttagtccttggcgaattctttttggcaaagggagaagagaatgaaaagatgaatagcacaagttttcaaagtttggaaaaccagaaaacttcagaaagcttttggtacaaagaacaagaagaagttcaaagagattcaaggcttgtaaaggattgtaatgaaatgattggaaaagtattcaagattcttgaaatgcaaaacaaagccttgcttttataa

SEQ ID NO: 62826 - DNA, 142 bp, Glycine max
  Peptide Sequence Number=SeqID_154511
ggtatcccacatatcctttgcacttttacagtttgataccctaaagtattcatccattcctagggcaaatgctaaaggcccaagtggagaaggacaaagcccccgagtggagaaggatgaaggcccaagtggagaaggatga

SEQ ID NO: 62827 - DNA, 144 bp, Glycine max
  Peptide Sequence Number=SeqID_154512
atggagaataagatgaagaacaaagaattaaattcaatggcagcggaatggagatggaagaaagatgattggagacgccacttcaaggagaagatgagtcaagaagaagctcaccaccataggaagccatggataagagcttga

SEQ ID NO: 62828 - DNA, 264 bp, Glycine max
  Peptide Sequence Number=SeqID_154513
atggcagtggaatggagaaggaagaaagatttagagaggccacttcaaggagaacatgagtcaagaacaagctcaccaccatatgaagccatggataagagcttgaaggtaggagaagatgagtggagggagagggaaagaatgatgcaatcctaccccccaagggcattggatagaagactccaagaagattgggccaaagatgcaagagaaggccctagggttctcatgagccttagggtagatttcgggcccatgggctaa

SEQ ID NO: 62829 - DNA, 366 bp, Glycine max
  Peptide Sequence Number=SeqID_154514
cgtgactcaaatgtgagtatgacagatcttgtgagcgcggaagatgacatatcaaaaaagaatgtttgtacggataaccactcgggtatttccgccggacagcgtgactcaaatgtgagtatgacagatcttgtgagcgcggaagatgacttaaatcttcagacagcaaaaaagaatgtttatacggataaccactcgggtatttccgcccgtcagcatgactcaaatgtcagtatgacagatcttgtgagcgcggaagatgacacagcaaaaaagaatgtttatacggataatcactcgggtatatccgcctgtcagcttgactcaaatgtcagtatgacaaatcttgtgagcacggaagatgac

SEQ ID NO: 62830 - DNA, 375 bp, Glycine max
  Peptide Sequence Number=SeqID_154515
atgactacaccacccagctctcctcctcctcctcttcctactgatgcagcatcacattccccttctaccttgaagcggacaagaaaagccacatgcctaagatcattggtccatgtggatcctgcaatggggaaagttgatagtccctacaaaaagaagttaagaacatatttggggatcgttgctcgcgataaggtagatgtggcatacgagaattggaaacaagtccttactgcccagaaggatttgatatgggaggatattcagccgacaaggacggtgtcgatgacactgtatgcaaaaagtacgacattagcaaggaaaaacggacccaattttgtcaaagccacagagacccttcgtgggaggatgtga

SEQ ID NO: 62831 - DNA, 936 bp, Glycine max
  Peptide Sequence Number=SeqID_154516
atgtggtatgatgagaggattaacaaagataaacagacaaaaaatccaaagttttcattatgttgtggtgatggtaaaatacaactgccaatactacatgatgctccgcaacccttgcgacaactactctttgacagtagagactcacaagcaaagaaattccagcaaaacatacgtttatacaacctaatgtttgcattcacatctcccggtatcaaagtagacacatcctataatactggaagaggtcctcctacattgtgcatacatggtcaatcgcatcaccttattggaagcctcctacctatgccggataactcaccaaagtttgcacaactatatatttatgacacagagaacgaagtcaacaatgggctttcacaataccctataaaaaataatgttgatgaagacattataactggtatcaagaatatgctagatacccacaatccatatgcacaaaaattcagaatggcaagcgataaactagactcttctgcagtgtgtgacctgaaactaaaactcattagtgcccggaaaactgatggcagattatataatttgccaaatgcttttgaagtggctgctttaattgttggtgacgagcatacaacaaataacagagatatcatcattgagaagcaaacaggcatgctgcaaagaataaatgaacttcatcctgcatatttacctttgcaatatcctcttttgtacccacatggtgaagatggctacagaccaaacattcttcataagcatcatccgcatagccatgctacaaagaggaacaaagttgtcatgcgtgagtatttttgttacaggatgcaatcaagggataatgaagcacgagcaatacttcattcaagaagattgtttcaccaatgggttgttgatgggtattgtatgattgagtctcaattgtcaattaattag

SEQ ID NO: 62832 - DNA, 96 bp, Glycine max
  Peptide Sequence Number=SeqID_154517
atggctcatgagaaccctaggatcttctcttgcatctctggcccaatgttcttggagtcttctatccaatgcccttgggggataagattgcatcac

SEQ ID NO: 62833 - DNA, 642 bp, Glycine max
  Peptide Sequence Number=SeqID_154518
atggtaccgactattgaagagtttgaggagatactaggatgccctcttggggggagaagactgtatcttttctccgggtttcttccctccttgagcaagattgcagctgtggtcgggggttcggcaagagagttggatcgcatgaagcaaactcgcaacggcgtagtgggcctaccacggaaatacttggaaggcaaggcaagggatatggcgagccaagagaagtggggcccgtttgtggatatactagctttgttgatttttggggttgtcctctttccgaacgtggacggtttggtggacttagccaccattgacgctttcctcgcatatcaccatagcaaggagagtccagtggtggctatcttggcagatttgtttgatacctttgaccggagatgtgagaaaaacagtgcacgaattgtctgttgtttacccgctctctgtgtgtgggtagtttcacacctattccaacaagacacaagacacccgtgtccgcttcaaagctatcgctcatgcgccgaaaaaggaagagtcgattgggaccaacatttggctggaataggaggcaacgcaatcaattggtttcctcgttggagaaaggcaaggaaggagtctcttctcgtgtggggactaccctaa

SEQ ID NO: 62834 - DNA, 222 bp, Glycine max
  Peptide Sequence Number=SeqID_154519
atggagaggaggcccacgaggacgaagagatggccgatttgcttgacttcttgggagggagtggagctacatgactgggagatcccccagattcatggtggacgctgtgaaaattttcccggacgcccaaaatggactcggatgaatgcacaaatggataaaagaacatgttttggaaacgttgggttgactaaaataggggaaatgaatcctgagccctag

SEQ ID NO: 62835 - DNA, 219 bp, Glycine max
  Peptide Sequence Number=SeqID_154520
atgtccgccagggtccagcctatagccttcttatgcttcttgagaactgccaacaacttctcctcttgctcatcagcaagggaggcagatataatcactggaaaactcttgctatcatccaagcttcaattctggtgtggtcggctagacagtggtagaaggagatggtttctcagcctttacctcataaagaaagtcagaggtatgtgtacttcctga

SEQ ID NO: 62836 - DNA, 851 bp, Glycine max
  Peptide Sequence Number=SeqID_154521
acccttcttgggaggatgtgcgcaagaaggcacaggccatccagaagcagaatactgccccccacattttgtcttgtgggggttatgactatttggagcagaagctcctggttgagaagacgaagaaaaagctggaggaagctacacagtcaggaagcattgatggcgtcatcgaccctccatggccggtcagacgccacgtgaagtggaagatggcccgcacgaagaaaacaggggagatgacgattgaggccgcaaaggaaatcgctgagaatatcgattcctttgaggagcaggccacacagggatcctttgtcccccatggaagtcaggatgttctcaccgctgctattggatgtccagagcaccctggacatgtccgtgctgttggagccggtgtcaccatcaagcaatactttggatcagctccacggacgtcccgcagctcttcctccatgcctcccgaagaattgcagcagttgactcaacagatcagggaccagctagaggagtccatcacagaaaaaggacttgcaccgcctcccgagcctcaggttggtccctccggtcctcgagtaagcacaaaggggagttgtgttgatccctcaggaaacgattctgagacaggtgactctgataggtgcggcttgtacatagaagcagatcctgcccgcctggttgccatggggagagtttatgagggatccactgttgttcataacactcctttgttgcctggccaagtaaaggcacttcacaccttccatgcttggccgacacatctggtcaagtctttatcacagcaggtagctgtgtctccgaaaaaaccacctccaaagcccgatctaaag

SEQ ID NO: 62837 - DNA, 291 bp, Glycine max
  Peptide Sequence Number=SeqID_154522
tcaaacccaagtagatgtaccctctacttgtaccacaaaggatgtaccctccaatgtgttaagacaaagatctcaggcggttaaacctttgatactttgtgaatggggatacaaaagaattctcaggcgggagaagggagacacaaaagaattcaagcggttagtcctttgttcttttggaaaagggagaagagagacacaaaaagaattcaagcggtttagaaaaccagaaaactttggaaagctttttggcacaatgaagaagaagaagttcaaagagattcagggctt

SEQ ID NO: 62838 - DNA, 609 bp, Glycine max
  Peptide Sequence Number=SeqID_154523
atgggacctctccaaatgcaagccttccgcaagacttatggaaagatcttagatttgaccattgcagaggtatccatagaagccattgcatcactcacccaatactacgaccagcctttgagatgcttcacgttcagagacttccaattggtaccgaccattgaagaatttgaggagattctgggatgtcctctcggggggagaaaaccatatcttttttccgggtttctcccctccttgagcagaattgcaactgtggtcaagggttcagcaagaggtttggaccgcgtaaaacaaactcgaaacggcatagtgggcctaccacggaagtacctagaagacaaggcgagggatatggcaaatcatgaagagtgggtcccgtttatggatgtgttagcattgctaatctttggggtcgtcctctttccaaatgtggatggtttggtggacctagccgcaatcgacgctttccttgcataccaccatagcaaggagagcccggtggtagctgtcttggcagatttatttgatacatttgaccgaagcaagacacgaggcatccatgtccgctctgaagccatcgctcgtgtgctgaaaagagaagaatag

SEQ ID NO: 62839 - DNA, 285 bp, Glycine max
  Peptide Sequence Number=SeqID_154524
atgaatctggggatctcccagtcacgtatctccactccctcccaagaagtcaagcaaatcggccatctcctcgtcctcgtgggcctcttctccaccgccgggagcttctgggggtgcctctcctgcttgggcctcgggccaatctccgggccatgcgacctctgccctgaactggtctggagtagggcatgtaaaagaagcgaagccctggctctgcatgctgaggcttatctgcctgtggagcatcaccctgagcctgtctctgggtacagtacttctcgataa

SEQ ID NO: 62840 - DNA, 378 bp, Glycine max
  Peptide Sequence Number=SeqID_154525
atgactatgcaaagcatgcagtttcaacaagagaccagagcctccattcagagcttaactaatcagatgggacaattggctacacagttaaatcaacaacactcccagaattctgacagattaccttctcaatctgtccagaatcccaaaaatgtgagtgccattacattgaggtcgggaaagcagtgtcaaggacctcaaccagcaacatcttcctcatccgcaaatgaacctacccaacctcactctactccagaaaaagatgatgacaaaaatttaaagaagttgtgcactaataagcggaagcttaaaggaagtgaaagtatgagcagaaatgtcttcgcattgattggtaaatctgttccccaaatcccttaa

SEQ ID NO: 62841 - DNA, 222 bp, Glycine max
  Peptide Sequence Number=SeqID_154526
atgaagaaacaacaatggaggacaagcgcaagacaaaggagaagaggtgagaggaggcgtcatccactagggaataagccatggaagaaggagcttcgccaccaagagagtgccttagataagaagcttggaaaaggtgcttcaatgaaggaaaagaaagagagagagaaagagagaggggggagcatgaaattgaaggaagaaaagaggaagagaagttga

SEQ ID NO: 62842 - DNA, 282 bp, Glycine max
  Peptide Sequence Number=SeqID_154527
atggcttctaggaaacgcaagagtattggttcaagacctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaagggtgtttccctttgctcctacgtattcctcaatttgggatgagaaaatcagacctacgtag

SEQ ID NO: 62843 - DNA, 189 bp, Glycine max
  Peptide Sequence Number=SeqID_154528
atggggttgaatcaatttagatttttcaacatggttcatgacatcttggtcaagatgaaattggaagtaacaaggacatcaacagtcctaaatgtgtttagcagtagtgataggaaaatgcaaggatcatgcatgagcgaacatgaaaacaaaaagtatgttgaacgcatatgcatgaggatgcaatga

SEQ ID NO: 62844 - DNA, 384 bp, Glycine max
  Peptide Sequence Number=SeqID_154529
atggataatgaagagggcgtgcaggaacagatgaaggccgatctatcggccttaaaagatcaaatggcttccatctcggaggtcatgttaaaactccagaaaaccatagaggacaaagccacggcaaccgcctccaatacggttagggaagcagagccggtgctgcaacccgctttaaatccgggccgagacagaaacacggtcgtgtttggtcgaagggcatctccggatgtattgccggaagatgggggcgtattccgcggacgaaaagttgttggtccatttctttcaagacagcttggccggagcagcagtgacatggtataccaatctggaagcttcccagatccgatcatggaaggacttggcaactgctttcattag

SEQ ID NO: 62845 - DNA, 569 bp, Glycine max
  Peptide Sequence Number=SeqID_154530
gcccacttgggccctccggaatattcctccagaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatctcgcaaaggtttcaaccgttcttcgacgttcttcattcgttcttcatcgttcttcgatcttcaacggggtaggttgcgacactcggctttgacgcacccttgccctaccagtgagtccaatcctggcatgaattccaatgcgaggagaaaccatccagtaaagaagctttcggagtttgccccaattccagtgtcatacggagacttattgttgtccttaatcaccaaccaattggaagtgtgtgtggccctcaagcacaaagtgcaaagcttgattaacacgggatggctaactttccaagaagatggcccgaatgtgaagatgaacccactcgccaatcatggaggatcagccatgaatgcgatagaggcgggcgaactgtaa

SEQ ID NO: 62846 - DNA, 534 bp, Glycine max
  Peptide Sequence Number=SeqID_154531
atggtgggatttctttggcctcattctggagatttttctagagcagacctaaagtatttctctagttttgctttgtcatggatcttttcatggcaatatcgttacagtaagactgagaaaactaatcaatatccatctctacagaggcatgcatttgtaaaatgttgggcacaatttgatacatccaaagctgatccagaacaagtaaagctttggttccaatcgcatccagaatttctcaaggcagctgacccagaaacttctgtattcctaaaccagaagtctcatcttgctgcatttttagcaggttcaaaatccaaagaaagcctgactaaaaatcttaaagaagttctacaaatgttgcaacaagaagaaaaaggctcttcctcaaaaaaggaggaaacaagttcaactgaagaagaagaagaagaccttttctaccaaaatgaggatgattgttttgtttcggtcaaagaaatcggtactgtagcaactagtactttgactgactttaaaaggagacctcgagcataa

SEQ ID NO: 62847 - DNA, 159 bp, Glycine max
  Peptide Sequence Number=SeqID_154532
atgaaagcaaaaggcaaccgagagtggcttgagggagcaagaaccgcaagccttcgtgggttgctcgcccaggcgagctcagctcacccaggcgagctaacctgccattttttttttgaggggaacattgaccatgtcttctcctcccttacgggttag

SEQ ID NO: 62848 - DNA, 526 bp, Glycine max
  Peptide Sequence Number=SeqID_154533
cgcgcagttgggcaccgtaacccagcttccggttcatcccgcatcgccagttctgcgtaccaaaaatggcccacttggagctctcgattccatggcgcggctcaacagagcagccgcaccctatcctgagggaaacttcagagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 62849 - DNA, 378 bp, Glycine max
  Peptide Sequence Number=SeqID_154534
atggagtttagtgatataactattcattttaatattcttgatgctataaagcacccatctgaagatctttctgtatttcatgttgaaataattgatcatgttgttgatgaatacatgactgatcttcattctatagagtcaaataaaactaaccatgttccaggaagtacacatacctctgactttctttatgaggtacaggctgagaaaccatctctttctaccactatccagccagccacaccagaattgaagcttatgccatcaaatttaaaatattcttatttggatgatagcaaaagttttccagtaattatatctgcctcccttgttgatgagcaagaggaggagctgttatctgttctcaagaagcattag

SEQ ID NO: 62850 - DNA, 288 bp, Glycine max
  Peptide Sequence Number=SeqID_154535
atgggctacatgggagtacgtgagctcaattggaggtgggcaacaggggatggtgggtttatgcgcgccattgtggatgtggaaaacttgttgtgcaccatcgcccgaccgccacctagcaccacatgtgatggataccccataatcctacaagcttgcgatgaggaagtgttgaaggagtggtacctggagatatgtcgcgggggtcaggagaccttggggacgtcaggtgggggtgctattgccccaaaaccaagcttgaccaatcccgacccaacccgggcatag

SEQ ID NO: 62851 - DNA, 557 bp, Glycine max
  Peptide Sequence Number=SeqID_154536
tgccgactgtggaagagtttgaagaaatcctgggatgcctactgggaggaaggaagccatatcttttctttgggttctatccctccatgacaagagttgccaaggtagtgaaaatctcagcacaagagttggaccgtgtaaagcaaaacagaaatggagtagtcggagtaccaaggaagtttgtcctctttccgaatatggaagggttagtggacctagcagcgattgacgctttcctcgcctttcatcatggcaaggaaagctcggtcgtcgccattttggccatgtatgacacgttcgaccggggatgcccgtctatccgctacaaggtcaccgctcggcatgggatgcggcgtgaagaaaggacagagagcttaggggaagcaactgtgagagacgatgaggttaaagcttcggaagaaagtgatgaggtacaagccctaaaggcagagcttgaaaagagcccggcaatagtgagctcaagctccaaagaggtgaaaggaatcatcacgggtcaaaagcatgatcttgaaggacgagctaaaggcttgccttag

SEQ ID NO: 62852 - DNA, 207 bp, Glycine max
  Peptide Sequence Number=SeqID_154537
atgcctcaacaacccatgttattctgtgaggtgtttgatgtctgggtgtcataccctaatttcgttcgaggaccattgtttggtggcatgcaacctttgcttgaccgcttcaagggtgttccaacagaaggcggtgccttctggtggaagcaacccagctcgcctgggcgagctgggcggcaaccacctcccttttttcccctataa

SEQ ID NO: 62853 - DNA, 201 bp, Glycine max
  Peptide Sequence Number=SeqID_154538
atggatgagtttgatgcacaagtggcctggacaggagcccatccttctccttttggaggggatgaggcctcaatagcccaggagcctgaatcagaggagccaacagcagcagcaaagggggaggataagctcaccccttttgagcctttatattttgatgcaggtatacacatggctcaaggaggaggagacttccactga

SEQ ID NO: 62854 - DNA, 426 bp, Glycine max
  Peptide Sequence Number=SeqID_154539
atgatagttaaccaacaagtgaaggtacctttctccattgggacatataaggatgaagttaattgtgatatcaaaagagcattccttcttaaacaatccttctaccttctcctatcaagggaaacatccctaagcactgccatacctcttgagcttgaggttattcctcaagtaaaagagttgctggatgagggtttggttcgtaagagcttaactccttgtgctttgttgatgcccaaaataggtattatgaggcaccgaatccctatgatatgtggtatgatgaatgtgttgagtggtgcaaccctcttttgtaaaatcatccatgcatccaacatcttcatgattcacatacataggaattcattagatagtgataaaggggttcccacgaaccctaagagaataaaggtcattcttgagtga

SEQ ID NO: 62855 - DNA, 756 bp, Glycine max
  Peptide Sequence Number=SeqID_154540
atgagtatagatgcagcaattttaatgtgccttagagacattaggcataaaaaatttgaagactccttaataggaaccgtagaaacaagcctaggacaaggtccgatatactttaattgttatccaaacaaaacagtgagtctgatggacagaaacattcttgactctctgttcttgaacatccactttcatggccttgacatgaaagaaggatcaatcccagcagctttaatctataggatccaatacaaagtcatgaatacttgtgcatctagagtcctattaaaacctcttaaaggagagacaaccttgtttgtcactgatatgacaaaggccaatgtttctctcccaagaaccataaaatgggatgaggtaactcttccagaaaaatgggtcatggataagaccacatcgtttgtccctcaacccgctccaaccatagaacaaattaaacaagacaactccggcaaggtagagataaccttcaataggagaaattctttatcatctaggctagaagcctctaggtatgaatatgagtcagcaagaagatctttttcggtgagaactcattcaattccagtagggttaactagatctgagtcacataaccagttccctactgtaaatcttcaaggtctagataccacatctagtatacctagaacaacatacaaccaagaacaggaggacgaccaaaagtcaatccaatccccaacttattcctctatgcatgaaccttatgatgttatttga

SEQ ID NO: 62856 - DNA, 255 bp, Glycine max
  Peptide Sequence Number=SeqID_154541
atggatttccaacccccccctacaaatatctgttggggcgcccatgggatccacttcagtgggggttgttcccctctacactccccccaaaagttgaaaattcgtagtggaaggggcatctggtcatcgtataaaaaagaagaagacatcttggtgagctgcccgtcctctatgccttatgtggaggccgcagagggagtcattagaaaaccgcttttccagtcttttgaggtggcaaagacaacggcggcatga

SEQ ID NO: 62857 - DNA, 312 bp, Glycine max
  Peptide Sequence Number=SeqID_154542
atgtttactaatgtactaacccatattaatctccgctacagcggacactggcaggtggtggtcatcctgcccaagaaacacctagttgtctggttttgttcattgcataacaggccagacaactaccttaaggggattattaatagtgcattaaaaggtcttgatgatgctccacaacctaaatcaaaggctcctgctaggtggattgtcgccaagtgtaatagacaaaaaggaagtactgagtgcggctactatgtgatgcactggatgtccaccatcattttaggaacttttaggaataattgggaagcg

SEQ ID NO: 62858 - DNA, 555 bp, Glycine max
  Peptide Sequence Number=SeqID_154543
gttacaggttgtaccatctgtggtgaggctcatgaaacaggccaatgtattcccattgaagaaaacactcaagaatttcattatatgggaaatcaacaacgacaagggtatactcaaggaggattttcaggcttccagcagggtccctataatcaacaaggacagtggaggacacaccctgacaaccagtttaacaaagaccagagtgggcctgcaaacaggccaatccaacaaggacctaacatattccagagaaatactaatctggaggagaccttgactcagtttatgaaggtaacaatgtcaaatcataaaagcactgagtcagcactgaagaaccttgaggtccaagtgggacagctggccaagcagatagctgacaagtcatccaacagttttgtggaaaatacagaacagaatcccaaggaggaatgcaaagctgtgatgacaaggagtaaaaggtttgtggaggctgaggatgaggatagtgttgtgcataagaacaaaactgctgacaaaaaaagggtactgatggcaagaaaaatgaggaaagag

SEQ ID NO: 62859 - DNA, 318 bp, Glycine max
  Peptide Sequence Number=SeqID_154544
atgattaaggagaagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagtttttggatgagggtttggttcgcaagagactaaatccttgtgctttgttggtgcccaaaataggggttcccatgaaccctaagagaataaaggtcattcctaaatggcccgctccaccaagt

SEQ ID NO: 62860 - DNA, 289 bp, Glycine max
  Peptide Sequence Number=SeqID_154545
ggaattggaaggaggattggtgccatcccttgaagaatttgagcatgatgtaagctccattggagcttgtaggcctaggctccccctcatcaatggattcctttgcttcttggaagatgaatgtcagcggaatgaagaaaggaagagagagaggagacgctacttcaaggagaagatgagtctagaagaagctcaccatcataggaggccatggataagagcttggaggaagaaggagatgaatgaagggagaggaagagaagagcacgaaattttgtgctctaaatga

SEQ ID NO: 62861 - DNA, 285 bp, Glycine max
  Peptide Sequence Number=SeqID_154546
atggtgtttcttcgggcatctcaatttcataattacattttccatgcacggcttaaaaattgccattccttgaattatagggttgaaccaagctcatgcttttataaaaaggttcatcaagtcaagttgaaatatggaagtaaccgtcttgcaaaattggggcaaaagatgaatcgagtcacatcactgcttcgtctactgccaaacatatttaggattgttgatgtccttgttacttccagtttcaccttgacaaagatgtcatggaccatgttgaaaatctaa

SEQ ID NO: 62862 - DNA, 111 bp, Glycine max
  Peptide Sequence Number=SeqID_154547
atgagtggtacctggagatatgtcgcgggggtcaggagaccttggggacgtcagggtgataaagcactggtaatcgattaccagttgggtataatcgattacacagggtga

SEQ ID NO: 62863 - DNA, 394 bp, Glycine max
  Peptide Sequence Number=SeqID_154548
atgaaggccgatatggaggccttgaaagatcaaatgacctccatgatggaggccattctaagcatgaagcaaatgatagaaagcaatgcgggtgcaattatcgccaccagcgctgcccctgtggcagatcctacctatacatctgccataaaccaagcgaatcaacccatcccggacatggtgggacaaggaggagaggtgttgggcagcaccggcggtccgcacacggggcataataggaatacttacccctatggcttaccccccaattataagctgcccaccatgcacatacccaacgagaacaataaccatgtcgttcctgttacctttgagggtcaacaaccccagcctgtaaggggcgcccatgaagaacctcgggagcatgctcaag

SEQ ID NO: 62864 - DNA, 1444 bp, Glycine max
  Peptide Sequence Number=SeqID_154549
gctggccaacaaagtaaagttgttgctgttgctgctgctgctgctgctgcggctgaggctgctctgcaagagcaaagtggagcaaggacaactattgctgcagcaacaacaaaaacttcgaaaaaaacatgcaaaaaagagcgagaggaaaacggttacatgcctgtccactgcacaagcacgcacatacaccaacagcaacaacagcagaagaacaacaatgctaccttcatttgtgtcctgattatgacaactcaaggaaaatgttgtggcaggctttggggcgaatggcaggcaccgaaatctcagtggagtcgctttcatgtagccatcagtaaaagctctctcatacacacatgcacacatgctcacacagcggaggcgcaactgcaggacatgtacgtgtacgtgcatagcaagaaaagttccgtggctgtggttgtggctgcacattccccgcacatttcaaacgcgacgccacgcaacggtgatgtgggacacatcccgtaccgggcaatgcaacaaccccaacgttatataccgtctgtatctgatctatatggcacggacgagatagaactgctgctggacgagatacgtgaactggagctggagccggtctgctgtcagctggacgatgagcaagactttgaaatagctggcagcagggccggtgagctctcgctgtccctagaatcgcccctcggcacgtgcacctcctgggactcgcacgccaactataaacagcgcaacggccatacaccgctgccatggggcgtcgccctacactgtgatccgcaacacttgaaatcgcctacagggattgtgcgcatactactggtgcatgacaagccgagtcgatatagccatgtccgtctgtctgtccgtttgtctgtccgtctgtctgtctgtatgaacgcaaggatctccgaaagtgggcctctttctactgccactcattggacgcctaaggctgatggtcttctgtgcgctcttctcactactcatcacatgtctcatgctgtttctggatatatcgcatatagcgctcatgtttccattcaattggacgaaagtgaatacgtggatgtacctgagtattggtttgatattgattttgagctccacgctgcttgttcacatggtgctctacgccacagaataataggctacgtgtgcgccttggaggctctactactttcgggaatcgcctcctggccctggactcagtatcgtcaggtgccggacgatgtcagcgaactgtttatcgaggatcgggaaatgacgcctatgagtccgctgaacagcacagacctacagccgggcaacaaccactcgccgtatcagcacagcagccacaacaatggaaatgcgccaaccacggcggctgatgtgtacaaccaacagcaacaatcgtcctataatcaaaagccttatatacctg

SEQ ID NO: 62865 - DNA, 1021 bp, Glycine max
  Peptide Sequence Number=SeqID_154550
gtcgactctagaggatcccctggccggtgacaaatcgttggccgatgtcgtagctcatgagattgcccacagctggacgggcaacctggtgaccaacaagaactttgagcatttctggcttaacgaaggcttcaccgtttttgtcgaagcaaaggttgtgggtcgcatgcagggacaaaaagagctggactttaaaatgttgagcaacctcaccgatctgcaagaatgtttgcgcacccaactcgccggcacgccagagctcagcaagttggttgttgatttgtccaactgtggaccagacgatgcattctcctcggtgccttacatgaagggttcgaccttcttacgttatttggaagacttgttcggtggccccagcgtctttgagccattcctgcgtgattatctgaagaagttcgcttacaaatcaattgttaccgatgatttcaagggggcgctatatgactacttcaaggacactgataaaaaagataagctgggggaagttgactgggagctttggcttaaaagtgaaggcatgccgcctatcatacccaaatttgatgaaaccctatctaatgttaccaaggagttggcgagaatttggagtaaaagtactgttgccgaactaattgacaacaataatataaaacagaaaatttcgatacatcaactaatcgactttttgggcaaactgatcgagcatcaagatatagtggatttgaatgagcgcaagatcgagttgctcgaggacacgtacaatctgaagcagtcgaagaatgccgaagtgcgtttccgcctcaatcgcttgattatacgcgcccgccttatcaaacgtctagatgagatcattgagtttgccaactcgaatttccgaatgaaattctgtcgtccaatttatcgcgatttggctgcctggcctgaggccaaacccattgccgtgcgtaattttgtgagtgtgcgcgaccaaatgatggccgtctgctcgcacacaatcgagaaggatttgggacttaagtag

SEQ ID NO: 62866 - DNA, 351 bp, Glycine max
  Peptide Sequence Number=SeqID_154551
atgaataggggcaatccaggtgatttacaaccctttgatcctaaaatagatagaacctttcatagattagctaggcatagtgtgcatcctggtcattctgtgcattttgagcatcttgatcattttgagcattttgttgctggtgattctaaatattctgattttgagcattcagctattaattttcatactgagaacatgactcaacctccacctcgtgagaagactcttagggagatggctgcacctgatttcacttatgaaagcttgtgcattcaatatcctgatgagggtgttccatatgttctcaagactagactaatacatttgctgcccaagtttcatggtctt

SEQ ID NO: 62867 - DNA, 294 bp, Glycine max
  Peptide Sequence Number=SeqID_154552
atgactgcgccacagacggatccttctcgagatgcatatgcgacgcagcccaatcataaccctcatgaggcagcaccggcatcaacacgtgcggatcctgatgtggacgagcccagacatgcagtggaggcttgccatgcgatcgcggaggcgttggagcagcatctaaatgcgccagacacatccacacatgaagaggtcatccaaacatgcctcaggattactaggggtgtcacaaaagactgcaatgtgtatgtgaggtctcgacgtaggcggcgcacggatcaacaatag

SEQ ID NO: 62868 - DNA, 597 bp, Glycine max
  Peptide Sequence Number=SeqID_154553
atgtttgtttctctcgggggagtcacacgacatggaaacctgtcccgcggtggaagaattgcttcagcggctcatggattggggggtagcttgaagtgtccaaaggagggaaggaagaaccacaaatttgcatgcagtcggaagaaaagaaggttcccccaacccccaaaggccctagtaatatgttttactaggaaagggactggctccacgcccatatacccccagacagcgcccaagccaacgccgtttgcatatcaaagcaataaggccgttccgtggaagtatacccctcccgcatttggagaaagagttgcaactgaagttgactccctatcagccaaggtgaccaacatcaccgacctcagtggcgtaacccgcagtggtcgggtgttcgcttcccctcactcggcggagttgccctccaaggggaaagcgcctatggtccaagagcccacagacgtagccaccccctcaaaagaagtggatcctccggtggtaaaaggggctgaaaagaaagagggtcttcaaggaaagacggtgactttggaagaggctcatgagttccttcgcctcatccaacaaagcgagtttaag

SEQ ID NO: 62869 - DNA, 286 bp, Glycine max
  Peptide Sequence Number=SeqID_154554
atggagcttatggacaagctccaaaggcttggacaagggagtatgagtgttgaagaatatagacaacaaatggaactaatccttataagaactggacttagggaggaagaaagaacaagcatagctaggtttcttagtgggcttaatatggaagtgagggacaaggagactacttcttccccttcctctagtggaagtgaagatgaagtaaggggtgaagagtctagggaggaagtctacccccatgaagaaggtgacctcttaatggttagaaggctccttagag

SEQ ID NO: 62870 - DNA, 564 bp, Glycine max
  Peptide Sequence Number=SeqID_154555
atgatgagagaacaaataagggaagaagaaagaaggaaaaatattaaaagagttaagaaaaagaaaaaacatgtctcctatagtagttatggctcttgcaagagcctaagtgaagaactccgtgactattatgaaggaagacataagtcacatcttagaccttactctcataggagagaaaaggaaagaaaacctcaagaggctaacattaacctcccatactttcatgggaaggacaataaagaccaaggtcaaggcatcttaagggtgacaccttctaagcccaaagatgataaggggaagacaatagaaaagcaaccccctaaagctagtatgcaagagaagagtaactctataaagtgttttaaatgtcttggaagaggacacattacttctcaattttccaccatgaaaaccatgattatgaggggtcaagacatttatagtagccaagatgaggctactacttcaacttcctctagtgaaagtgaagaagcaaaatgggaagaatctagtgaagaaatcttcccccatgaagaagaacaacctttaatggttaaggag

SEQ ID NO: 62871 - DNA, 139 bp, Glycine max
  Peptide Sequence Number=SeqID_154556
ctttggtgctagaatgttcaatttggagtccacaagaggaggatcttcatatggtgctggagtttttgctggagatggtacaagacaagcaagtgaaatggagctggagcttgcagagtatcatggcaagtgtacatga

SEQ ID NO: 62872 - DNA, 108 bp, Glycine max
  Peptide Sequence Number=SeqID_154557
atgggatggaggcaaatggaggatagggtcgtgaccgaccaatcgtcaccccttcccggcgttgggctagcggagaacgtcgctgcaaggcagcccagtatcctttga

SEQ ID NO: 62873 - DNA, 198 bp, Glycine max
  Peptide Sequence Number=SeqID_154558
cctgcagagctagggtttttacttcttttcccgtgccctactccggatcagttcagggcagaggtcgcatggcccggagattggccggaggcaccagcagaggcaccagcagaggctcccgacgaggcagatgaggcccacgaggacgaggagatgaccgatttacttgatttcttaggagggagcagggccacatga

SEQ ID NO: 62874 - DNA, 390 bp, Glycine max
  Peptide Sequence Number=SeqID_154559
atggagtttggtgatataactgttcattttaatattcttgatgctatgaaacatccatctgaagatctttctgtattttgcgctgaaataattgaccatattgttgatgaatacatgattgatcttcattctaatctgcatgcctgtcactcttcatgcattgaatctgaatttgtacttgatcatatggctaaatttgatgctgagagtgaatttgaaattgatattgattacatgtctggtgatgttttacctctagagtcagataaaactaaccatgttttaggaagtacacatacctctgactttctttatgaggatggggctaaaccagtaagacagccacaaagaagactcaacctggttattcttgatggtgggatcctctag

SEQ ID NO: 62875 - DNA, 141 bp, Glycine max
  Peptide Sequence Number=SeqID_154560
atggctcatggctgtcaagcgcttaccttcaataaggaatacggtgttgccccagtagaagttcgtatcgaagttcggtatccatgcagggcaaaaggcaacatctcatgccaatctttgtatgatactgtcatcttctga

SEQ ID NO: 62876 - DNA, 515 bp, Glycine max
  Peptide Sequence Number=SeqID_154561
atggaggccatgttaggaatgaggcaactcatggagaaaaatgtggccaccgctgccgctgttagttcggctgccgaagcagacccaactctcttggcaactgcgcaccatcctccctcaaacatagtaggacggggaagggacacactgtggcacgatggcaaccctcacctgggatacaaccgagcggcttacccttatggattgccgcccaactgctcaccacccatcctgcaagacgatgcgggccatcttgcttctcccgtccttgaaagggaaccgcctcaacagcccgatgaggtccacaaagaccctcaagactatgctcgaagggatgtcgagttctatcccccaatccccgaagggccggcacccagcacattgcctcagcccaacatcacgacacaaccaatagttttgtccatagaaggaccgcccccggcagctgaagaaaggaggaagctcgatctcctcgaggaaagattaagagtcgtggaaggatttggggactatcc

SEQ ID NO: 62877 - DNA, 151 bp, Glycine max
  Peptide Sequence Number=SeqID_154562
tctgcctctggtcatgggcccttcaagtgcttcatggtccttgcctttagttgtgtcctcatcacaatactctactggaggatccccatgaatccttcgttccctaacaagggaagtccaccaatagagggcatacccttgaaagctaagg

SEQ ID NO: 62878 - DNA, 216 bp, Glycine max
  Peptide Sequence Number=SeqID_154563
atgtcagtgaaaaatcacgtcgggcgcctaagagtacatgacaagataaaccacacactatcagagtcacactgttttgcgagaatgctccaaccatgtgggatcggcacaggcttaaaggagtactcaaaccgggtgacccccaaggcctacaccccgaagagtctgtcagggtctttccctcctgattcaagtccaacccagaaaacattttag

SEQ ID NO: 62879 - DNA, 432 bp, Glycine max
  Peptide Sequence Number=SeqID_154564
atggcggcgcagctaatccatgatcgagtggagatggagtgcctagagggagcttgggagaccctcgaaggcaacacgaggtgccgatttcggggcacgatccgattcacgactacttcattggtgtatccagatgaacccgcgcgtacacttcagcgcactgtggagtggatactaccctcgcctacaccatatcgtctagtggagccagtccaagtgatcgaggtaacttcgtccgaggaagaccctgaggaggatcttgaggagctacctcctgagcctgctgtggatgctcttgactttcttgagggtgatgaggatccccttcctgaggtggattctcctgaggaagtcacgtcggcatctgaggcagactctacggaggatagtggcccgggagagatggcaatcaacgaaggctcctcatcctag

SEQ ID NO: 62880 - DNA, 1005 bp, Glycine max
  Peptide Sequence Number=SeqID_154565
atgggatcaaatcaagcaccctcttttaagaaaagattctatcatgtcaaaatcaaaagcctaaaggtagctgtctttgttgaagtcattgcatccctcactcagtattacgatcaaccgctaaagtgcttcacacttggggactttcagttagtacggatcatggaagaatttgaagagatgttgggatgcctgctaggaggaaggaagccatgtctcttttctaggttatacccctccatggcgagaatagccaaggtggtcaaagtctcagtgcaagaattggaccgagtaaaacaaaatagaaatggggtggtcggaataccaaggaagaacttggagcagaaagaaaaggctttggtggatcaagcttctcaaggaagcttctcaaggaagcttctcaaggaggtgagcttagttattagaggggaattttctcaaggaagcttctcagagaagcttctcaaggaagtttctcaagaaagcttctcaagaaagcttcttaaggaagcacattcttggtggcgtagctccttcttccatggcttattccctagtggatggtgccttccctctcctcttctcctttgtcttccgctgcatctccatggtgaaaaatcgccattgaaggacctcattgaagctcaaaatccagcctccatagaagttccacaagcaagcttccatcatgaagggttcacaaacatcccattgatggcttcagtgaccccaatgcaagagtgcttcaaagagtctgaaaagcacagaatgtggtgcaaagaaaggataaggagctcaaaggaagcagcaatgggatcatcaacaattatcataagtgagaagttcaagacgaagaccatcaaggtctggaaagagtgtgatgagctaaggcatgtcaacgtggccacagccaaagcattggaacgggaaacgaagaggggccgaaaggaagaatgggagaatgatagattcattacacagagaagctatgatttggatggatag

SEQ ID NO: 62881 - DNA, 351 bp, Glycine max
  Peptide Sequence Number=SeqID_154566
atgagtagaggagcaagagatgatcctaaatatggcacagtggaaattcgaatggatagaagctataatctatttgacccattcatcagtgcacataatcaacaacaagggacaagcatggttggtgatgtgccttacatagaatctgatcatgtacaagatgatgtgccttaccaagttgaggaaatgtcacacgtcaacgaagtcgttgaagttgaaagtatttctggattgcaagatttaagaggtggtgttcaagaagtagaccctacgaatttgttgataaatgaagaagaatcaaattatttgaatagggaaacaatattgaacatgacaatgaatgagaattag

SEQ ID NO: 62882 - DNA, 237 bp, Glycine max
  Peptide Sequence Number=SeqID_154567
atggcctctggtttccatgtgctaaagctgtgtaactcgagtttgggcactgaggaacccgcacgcacgcttcagcggactgtggagtggatactacctacacctactccatatcgactagtggagccagttcaagtgatagaggtgtcatcctctgaagaagaccctgaagaggacccagaggagttacctcctgagcctgctgtggatgctcttgacttacctgaggatgattag

SEQ ID NO: 62883 - DNA, 588 bp, Glycine max
  Peptide Sequence Number=SeqID_154568
atggctccgagaaagcttcctgcaaagagatccaggaaggacaaagcggctgaagggaccagcgccgctcctgattatgacagccatcgcttccggagtgctgagcaccagcagcgtttcgaggccatcaaaggatgcttgccggcagtggacatcgctggttacccccatggtcaagttcgacccagacatagtcctggaattttatgccaatgcttggcctacacaggagggcgtgcgggatatacgatcttgggtgaggggtcagtggattcctttcgatgcggatgccctcagccaattcctgggataccctttagtgctggaggagggccaggagtgagagccatcgcccggttgctgtgcataccgggacaggattttgcccggaccactaccgggagacgagtacggatcatgcgtaccaacatgactactctaacccagatgtggatgacgttgctgctcatcaacatccagcccagcgaccataattccgacctccccctgccgaagtgtcagctggtgtatgccttcctgacacggatgagcgttcatgtggctcagttgatcgctgatgccatttat

SEQ ID NO: 62884 - DNA, 351 bp, Glycine max
  Peptide Sequence Number=SeqID_154569
atgataacaaaagatgatgacaaaggtgatgacaaaaagctcaaaggtcaatcaaaggatgagttcaagatgttcaagaaggaatcaagaacaattcaagactcaagaggaaaagttgaagaacacttcaagattcaagaagaaggaagaattcaagaatcaagcttcaggaatcaagatcaagattcaaaattcaagactcaagaatcaagagaagacttaatcaagataagtatgaaaaggatttttcaaaaactgagtagcacttggatttttcacaaaacatgttttccaaagagtttttactctctggtaatcgattaccagattgttgtaatcgattaccaatag

SEQ ID NO: 62885 - DNA, 148 bp, Glycine max
  Peptide Sequence Number=SeqID_154570
atggaaggagatctcatcaaagaaaccagccaattccttgatataggcttggtagggtatcagtcaattgctgcctggacggccagggcgcacgcttcatactcagccatattgttggtgcaatcgaaccccagcctggttgtgaaag

SEQ ID NO: 62886 - DNA, 547 bp, Glycine max
  Peptide Sequence Number=SeqID_154571
tggagaaaacaccgagactttttcaagtctcacaagttatccagaactacgtaggtctgagttcctcattggaggatacgtaggagcaagagcctcgcttttgtcgaccacaccgccttttgttgccataactcaagagctggtagcccgcggagataccttacggttatctgcacccctttgctatttagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaaaggcggggctgtgtccgatgacaagcagagaccaagtttggtcattctgcacccaagatacgcggagataccttacggttattcgcaccctcttttgctatctgtaagacagaacgcttga

SEQ ID NO: 62887 - DNA, 324 bp, Glycine max
  Peptide Sequence Number=SeqID_154572
atgaatactggaaagcaaggatggtggccttcctcaaatcactggatagcagaacctggaaagctgtcatcaaaggctggtgtcgcaacctacccttcggcgggagggcgacgcgagactcgcgggatgtgtgttccacgaaaggaatacgcgcggagtcgccaccaacgtttattcgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 62888 - DNA, 369 bp, Glycine max
  Peptide Sequence Number=SeqID_154573
atggccccaaggaagcttgcctcaaagagatccaggaaggataaagcggctgaaggaaccagttccgctcctgaatatgacagtcatcgttttaggagcgctgagcaccaacaacgcttcgaggccatcaagggatggtcatttctccgggagcgacgaggagatagttcaccggcggtgggcatcgctggttacccccatggccaagttcgacccagacatagtcctcgagttttatgccaatgcttggcctacagaggagggtatacgagatatgcaatcctgggtgaggggtcagtggatcccattcgatacggatgctctcagccagttcctgggatatcctttagtgctggaggagggccatga

SEQ ID NO: 62889 - DNA, 252 bp, Glycine max
  Peptide Sequence Number=SeqID_154574
atgtaccaagggcggaccttgggttttggtaccgttgcaacctacccttcggtgggagggcaacgcgaggctcacgggtgcatcttccaagggaggaaggcgcgtggagtcgccaccaatgtttattcgaggaaaacgtcggaaaaaccggaaaaggtgtggtctacgaactttaagcgtgaaagggtgtttccctcgctcctacgtatcctcaattacgatgaggaaatcagacctacgcagttcttttag

SEQ ID NO: 62890 - DNA, 174 bp, Glycine max
  Peptide Sequence Number=SeqID_154575
atgaccctttcatcatggcagaacaagctagacaagtattttacgtgcaagacccttgtgatgaaaggtgagacagaggtcaccaaagctagacttcatccaactgatgtttgtcgccagtttcatcatccaccacccttttcttctgtgccttctcacgtttgttgttgttaa

SEQ ID NO: 62891 - DNA, 270 bp, Glycine max
  Peptide Sequence Number=SeqID_154576
atggcctctggtaatcaattaccaaggatgtgtaatcgattaccagaatgggatcaggaacgtgagagggcttctggtaatcgattaccaatgttgtgtaatcgattaccaggcttaaaaatggagacaatcgcgatggcagtgcaattaatccatgaccgagtggagatggagtgcctagagggagtttgggagacccctcgaaggcaatgcgaggtgccgattccggggcacgatttcgattcacggccacttcgttggtacatctag

SEQ ID NO: 62892 - DNA, 135 bp, Glycine max
  Peptide Sequence Number=SeqID_154577
atgagtttgtcaggcttaaaggagcactcaaacccggtgacccccaaggcctacactccgaagagtccgtcagggcctcttcctcctgattcaggtccaacctgtaatatcattttagcacacagacactgctag

SEQ ID NO: 62893 - DNA, 252 bp, Glycine max
  Peptide Sequence Number=SeqID_154578
atgatgacaacaaaagatgatgacaaaagtgatgaacaaaaagctcaagtgaatcaaagaacatctcaagagaatcaagaacaagtcaagagttcaagactcaagaagaaagcctacaaacaagaatcaagattcaagattcaagatctcaagaatcaagatcaagattcaagactcaagattcaagaaataagaaaggactcaatcaagataagtataaaaaagtttttcaaaactttgaatagcacatga

SEQ ID NO: 62894 - DNA, 552 bp, Glycine max
  Peptide Sequence Number=SeqID_154579
atggatttgacgaggaggctattgcccagctgttatgcataccgggtcaggatttttgcccggaaccgctgccgggaggcggggcggatcatgcgcaccagcatgaccttgactcagatgtggatgacgttgctgctcagcaacgtcctgcctagcgatcataactccgacctccctttgccgaagtgtcagctagtgtatgccatcctgacacagatgagcgtccatgtggctcagttgatcactgacaccattgatttatttgcaggtatgccacctaccaggcaccctctagacccagataagtctaatagggccctggggtttccagcgttgatcacgggtctctgccagtcattcggggttcccatcacacctagtaaggtgattcgatcgccgatcacccgggccttcattgagaagtattgcacgcctagacaggtgcagggtgatgcaccgcaggccgcagacgcaccgccaccacctcatcaggctgatccagctgggtcatttggcatggagcagtatttacagcacttggttcgacagtag

SEQ ID NO: 62895 - DNA, 159 bp, Glycine max
  Peptide Sequence Number=SeqID_154580
atgaaacggagggcagatggttttatagggaacagggacgtgccaggggccccaccactagtggaagtgcctgccaggctaccactagtggtcgcgcctggcagacaagtcacgtgtcgcgttctggtggaacgcgctcctcaggtaggcgctttgtag

SEQ ID NO: 62896 - DNA, 390 bp, Glycine max
  Peptide Sequence Number=SeqID_154581
gttggtgttaaggaggttaaagatgcagaggcttccgttcctgtacctactgacgaggttaccttagtggggcagacacttaacacctttcttgcttggccgacacatctcgtgaagcgtttatcagaacaggcacctgtgtctccagcaaaacctccagaaagcccgaatcatgaggtcgatgatcccctgtatctaatgacattgaccatcccacagctgtttttgaagcctctccaggttatgtgggatgctaccgtgttcggggtgtttaatcaaaacttcccgttgtacataaagcacgaagatctctctgaaattgcacacgatggacttgatgatactccacaacctaaatccaaggttgctgctagatggattgttgttaag

SEQ ID NO: 62897 - DNA, 264 bp, Glycine max
  Peptide Sequence Number=SeqID_154582
atgctgacatctccggaaagggtgcagatgaccacattggtctctacttgtcaatcggacttgggatctccaaatgacgaggtgcggataacaataaggtgtctccgcatgctaccggactcttgggtcatgatagcaaaaggtggggtggtcgacaaaagcgaggctcttgcttctacgtatcctccatttgtgatgaagaactcagacctacgtagttctttcaaaagcgagactaaaatagtctctgtgttctctcactaa

SEQ ID NO: 62898 - DNA, 126 bp, Glycine max
  Peptide Sequence Number=SeqID_154583
atggcacgcagcgtgtttgctccgtgccccttatttaagggacctataagggagagaactaaccaggcttttagcaataatccccaagaggtatcatccccttcgaagaacatattgcagcagtag

SEQ ID NO: 62899 - DNA, 366 bp, Glycine max
  Peptide Sequence Number=SeqID_154584
atgcatagatctcccactgaaaatttagttcctctagacttagaaattgaagctacattgagaaggaacagggccgagaggagaaggaaacttctgcaagacagaacaattgcattcattcttgaggaagaaactcatttttctgatttattatcacctgattcaccatcatcaagggaatccgctactcaatttcctgaaaccactatcatggtagacgagcaacaccagaggatcacccttgaggattattcaagcagctcagtaccacaattctttactagcattgcatgtcctgaagtgcaagctcacaacatcaactacccgcattctttaattcatttaatacaggggaatttattctaa

SEQ ID NO: 62900 - DNA, 399 bp, Glycine max
  Peptide Sequence Number=SeqID_154585
atgagagctcctacattcatgtccatgcgagagactaggccaaagatcagcctagctctatccactgtcaggtcagaggtgtgcgatgcgggggccaggttggagtatgagagaaaactccacacctgggctaaagtcatcaagttcttcctcaggatcctcccaggatggccctcagtgttcaagatgaaccctcggcctggtatgcatagggcagcctcaatctccctaggatctgaaggcagcctgcagtatctggagtatgtgggcaaagtctcaccctctgccaacaccacaggtggctctaggaatgtgttgaagctgtcagcgtcgatcttcactagatggcctctgaccctaggttgctttgggggaaaggaccctcagagctggtattag

SEQ ID NO: 62901 - DNA, 525 bp, Glycine max
  Peptide Sequence Number=SeqID_154586
atggataactggggtactttggttgattgtctgtccaaacaccagttccatgagtcacatcagaagtttcaagttgcttgttcgccttggccgatgttcattgactatgttaacgacacatggattatcccccacaaggaaaaatttattacagcatggacgaataagggttcgaagaatcagctcattgaaataaggctctcaaagatctacaaaatgcgtgatccgtcttactggggtatgttgatgcttttcattctgttcaacaagcagatcaactctccagtcaaacgaagtgcatcatgttctgaaccgcctaaccaacaagtatactgctggcaacatcctattggagtcagtccatcttttctggaggagactttgcttttcaataaccaagggttatgtgagacggaagtcaccatcaaggaagatatagagatcatatctaaaaggtttgatgaacttgatatggatggaataacgagagtaaactttgggaaggattgcttcacgataacataa

SEQ ID NO: 62902 - DNA, 177 bp, Glycine max
  Peptide Sequence Number=SeqID_154587
atgtggtaccatggagaccagtcagggtcacagtgttttgcaagaatgctccaaccatatgggatcaacatagacttaaaggagcactcaaaccgtgtaacccccaaggcctacactctgaagagtccgtcagggcctctccctcctgattcaagtccaacccggaaaatattttag

SEQ ID NO: 62903 - DNA, 129 bp, Glycine max
  Peptide Sequence Number=SeqID_154588
atggcttcctacgggtcggcattcgcttactcgaaacccctcaggcggcgctttccgtttgtccagagctgggcaagggactacgatttatcagttgtgaccctagcctctactcgcgtccgtccctaa

SEQ ID NO: 62904 - DNA, 291 bp, Glycine max
  Peptide Sequence Number=SeqID_154589
atgatgaaagactatgaaaacggagaagagcaaaagcgatacattgataacaatttctccaaacacatggcatacatcaaagtttattcaacaaacaaaggccacttgatcaataagcccaacaattatgtagaaaaacctgaaaattatcttgtcataggaacaaaatgggtttttagaaataaattagataaacatggcatagtaagaaacaaaacagtgttgctttatccactgctgaagcggaatatatctctgccggcagttgttgtgcacagattttatggatga

SEQ ID NO: 62905 - DNA, 621 bp, Glycine max
  Peptide Sequence Number=SeqID_154590
atggtggtacgagcttttgacggaagtcggcggggaagtgatggggtaaatcgacatccccattcagataggcccccacacttgcaatgtggtttttcaagtgatggacataaatcccgcctacagctgcctcttggggagaccttggattcatgcgctgggagtggtcccttcgaggcttcaccagaaattgaagttcgcggttggtggacttttggtgatagtgtcaggcgaagaggatatgttaaagcagcggaagaatcattggaaacaactttccaatccttcgaggtggtgagttgtgcctctgtggaaacgagcccgttgctaccttctctctctaatgcggccataatggtggcacgggtgatgctcaagcacggttatgagcccggcatgggtctgggcaaggacgacctcgggaatgccgacgtggttgatattaggggaaacccgtacaaatatgggttgggatatgaacccggaatgccgggaaggaggaatgcgccgtcaagactccgggaggatagggcatggcccggccatgtaaaccagtgtttcaccagtgccagaataatgttcgaggaagaggtggcatcaataggagaggagttcccttaa

SEQ ID NO: 62906 - DNA, 618 bp, Glycine max
  Peptide Sequence Number=SeqID_154591
atgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactggggcacgatggcagccctcacctgggatacaaccgaacggcttacccttatggactgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccgggcacgttgcctcaacccaacctcgcagcatcgccaatagttttgtctatggaagggccgcccccgacaactgaagaaaggaggaagctcgatctcctggaggaaagattgagggctgtggaaggatttggggactatccgtttgcagacatgacggatctttgctta

SEQ ID NO: 62907 - DNA, 132 bp, Glycine max
  Peptide Sequence Number=SeqID_154592
atggtggttctgaaacatctaattgtgagtgcatgttttcggaaggaaggggagttcaaagaagaagaagaagaagatggtgacaaggtcaacgaggtggtgatgaccattgtagttgtacagaacatttaa

SEQ ID NO: 62908 - DNA, 411 bp, Glycine max
  Peptide Sequence Number=SeqID_154593
atgggagaagagagaccacaaaaagaattcaggcgtagtcctaccctctcttgttctcagtcaacaacccaagtagatgtaccctctacttgtatccacaaaggatgtaccctccaatgtgttaagacaaagatctcaggtgagaagggagacacaaaagaattcaagcggttagtccttcgttcttttggaaaagggagaagagagacacaaaaagaattcaggcggttagtccttggcaagttctttttggcaaagggagaagagatgaaaagaatgaatagcacaagttttcaaggtttagaaaaccagaaaactttggaaagcttttggcacaaagaagaagaagaagctcaaagagattcaaggcttgtaaaggattgcataagattgattggaaaagtgtattga

SEQ ID NO: 62909 - DNA, 270 bp, Glycine max
  Peptide Sequence Number=SeqID_154594
atggagaaacgccataacttcgacaatgggaagggatctcaagaaggttccccaacacttaaatgctataagtgtaatcgacccggtcacataaaggcacaatgccccacaaatgaatcatggccagagaagaaaagtcatgaagaaagaagatccaagaaggcgtatattgcttgggatgacaatgactcatccgatggttcggagaaggagatcaaccttctatccaaggactatgagagtgatgataacatctctaaagaagattaa

SEQ ID NO: 62910 - DNA, 615 bp, Glycine max
  Peptide Sequence Number=SeqID_154595
atgagtcttcattcttcatctagtattaatggtgagggttctacacctaaggaccccttgtataagatattagatgagttgagatcccttaagttgtggaaagaaaaacaagagaggaaagaaaaaggaaaaaaaagagtggaagaaataagtcaagatgaaaaaaagaaaataagggaagaagaaagaaggaaaatactaaaagagttaagaaaagaaaaacatgcctcctatagtagtcataactcttgcaagagcctaagtgaagaacttcgtgactattatgaaggaaggcataggttacatcttagacctcactcccataggagagaaaaggaaagaaagcctcaagaagctaacattaacctcccatacttccatgggaaagacaatgtagaggctaacttagattgggaaataagggtagagcaacaactcaaaaggaagtctacttcaaaatcttatggctctccctcttatccaaagaaaggccaagggcaaggcatcttaggggtgacaccttctgatatgaatggaagtggaatggagaaggaagagagagaggagatgccacttcaaggagaagatgagtctagaagaagctcaccaccataa

SEQ ID NO: 62911 - DNA, 470 bp, Glycine max
  Peptide Sequence Number=SeqID_154596
gcaattcacaccttccttgcttggacgacacatctggtcaagtctttatcacagcagttgtgtctccaacaaaaccacctccaaagttggatccagaggtcgatgatccactttatctgatgacattgaccatcccagagcttttcttgaggccttaccaggttacatgggatgccaccgtgttcggggtctttaatccagacttcccgctctacataaagcacgaagacctctccgaaatcgcacatggtggtcaatgtctcagcatatcaatgttacagttgtggattctgcatctgactgaaacaagtatgcgagtggggaattctgatatctatggattcctcgagccacagttcattcagaggccagacaactaccttaaggggattattaatagtgctatcaagggtcttgatgatgctccacagcctaaatcaaaggcttctgctaggtggattgtcgtcaag

SEQ ID NO: 62912 - DNA, 979 bp, Glycine max
  Peptide Sequence Number=SeqID_154597
atgggattaataatcccacaagattatgctgaagaagttgccaatccttcgatcgaaggcaagagagcacttcgactaacacccaagtccttaaatcaaagctcacaaaagctgttcctaaagtatatgaggatttttctgagctttgacaagtttcttccccaacatgctccattcattagtcgagaggttggcccagcctggttcactgactatttccctgctgtcgatccggacaatgaagaagaagtgaacgaaatatggtccttttacttgaatccacagatcctgtcttgtcgtacaggtgttcaatcgaactatttaggcctggttggataccagcctaatttggtttcaagacaatttggcctctcgcaaatccgccctaaaagcttgttcgaagatcctcgagacgtcataagaggggccaatctttcggaaaagactttcaagaagtttttgaagatttctcttaatgaaaactataacctgcatccttttgagttcaaccattcccacttctgcaccatggggtttgttacctggtgggagaaatattattcgacccgttcaattggagacactactatcatgatctccagacttgagagtggttttacacaaccaacggtcgagaatatccgctcaaaccttcaagctcgaggcaaaacaatcataacaaagaaaagcaccgaaacgtctcgagctgatgtgagacccaagaaacccactggggtgaagatccaagaagggaaacaagaagaaaaggaagaagaggaaagacctcttataagaaaaagaaagttacctgcgacttcgaccaagtctactgaacaaacagaggcaggcaattcccaggctcaaatgcctaagaagaaaaagaaagtgaagcaggtcgagcctgaaccttctgtggctgttgagggtggtgagccaatcaagaagaaaaagaaaaagaccaagccttcaaaagaacaag

SEQ ID NO: 62913 - DNA, 467 bp, Glycine max
  Peptide Sequence Number=SeqID_154598
gactctgccaatcgttcggagtccccgtggcacctaccaaggtgattcagccgcccatcacccgggcttttattgagaagtactgcacccagagacaggctcaggggaatgctccaccggccgcgggcgcgccaccaccacctcatcaggctggcccggctgggtcatttgacatggagcagtatttacggcatttggttcgccagcaggcagccaaccatcgggcacatgtgcagacccatgattgtctataccagatgagcctcagcatgcagagccagggcttcgcttctttttcatgccctactccagaccagttcagggcagaggtcgcatggcccggggattggcccgaggcccaagcaggagaggcgcccccggaagttcccggggatggagaggaggcccacgaggacgaggagatggccgatttgcttaacttcttgggagggagtggagctacatga

SEQ ID NO: 62914 - DNA, 300 bp, Glycine max
  Peptide Sequence Number=SeqID_154599
atggccatgtgtgttcaggaagaagaaaggcttgtaatggatatgggtgagagtgcattactaacaactgcttgtgggaagaacaaagcaactaagtctcaagctaatcagaaagggaatggtaaaataagacctcaagttgatattaagaaggtggcaaagtgtttcttttgtaagaagaagggacacatgaagaagaattgccccagattccagaaatggcttgagaagaaagtgttaatattaacacctggtggattgattctggatctacaatccatattgcaaattctttacaag

SEQ ID NO: 62915 - DNA, 213 bp, Glycine max
  Peptide Sequence Number=SeqID_154600
atgggggtgcaaatagcacccaggcccacttgggccctccagaatattcctccagaaggctgttgcttctgtaggaagcaacctggctcgcctgggcgagctgggcggcaaccacctcccctattttgctataataggggaggaagtgaagaagaaaaggaaaaatctaagcccgaggcgcttccgaaacgtttccgtaacgttttcccgtga

SEQ ID NO: 62916 - DNA, 162 bp, Glycine max
  Peptide Sequence Number=SeqID_154601
atgactctaagacaacatggattaaaaccaaaccaaaagacaatggaggatatacatggagaacaagatgaagaacaaggaattaaagagaattcaccgaacaaaaagatagaggaagcaaaagaacatcacctagatgaagatgctcttgataccacatga

SEQ ID NO: 62917 - DNA, 201 bp, Glycine max
  Peptide Sequence Number=SeqID_154602
gaagcgattaagatcctcctagaagaagccaaatcaaatgatgaacttccaagagaatggaaagcttcaagagatcatccccttgacaacattattggtgatatctcaaaaggggtaacaactagacattctcttaaagatttatgcgataatatggcttttgtgtctataattgaacctaaaaatggagttctctcttga

SEQ ID NO: 62918 - DNA, 225 bp, Glycine max
  Peptide Sequence Number=SeqID_154603
atggggttgtccctgtgtggttcagacattgtaaaaggattttacaaagagaaaggaaaatcccaagtgggttgcttgagtactggatgtaggcacaaagatgatgacaaaggtgatgacaaaaagctcaaagatcaatcaaagaacaactcaagtaaatcaagaacaattcaagagttcaagataagaatcaagaagaattcaagactcaagaagaaaggttaa

SEQ ID NO: 62919 - DNA, 472 bp, Glycine max
  Peptide Sequence Number=SeqID_154604
atggctaagtttgacccagatatagtcctggagttttatgttaatgcttggccaacaaaagaggaagtgcgggacatgcggtcatgggtgaggggtcagtggattccctttgacgcagatgccctcagccagttcctgggtgacccgctagtgttagaggaaggccaggagtgcgagtttagtcaaaggaggaacagggccgatgggttcgacgaagaggccatttcccaactattatgcataccggatcaggatttcgctcggaccgctgcagggaggcgggtgtggatcatgcgcaccagcatgaccaccttgacccagatgtggatgacattgctgctaagcaatgtcttgcctagtgatcataactccgaccttcctctaccgaagtgtcagctggtgtatgccatcctgacatggatgagcgttcacgtggctcaactgattgctgacgccatctatttatttgcag

SEQ ID NO: 62920 - DNA, 330 bp, Glycine max
  Peptide Sequence Number=SeqID_154605
atggcagcggaatggagaaggaagagagagaggagatgccacttcaaggagaagatgagtctagaagaagctcaccaccattggaggccacggataagagcttggaggaagaaggagatgaatgaagggagaggaagagaagagcatgaaattttgtgttctaaaagagctctgaaatctgaagtgttgtcgcaacctacccttcggcgggagggcaacgcggccctcacgcgtgcgtcttccaaggaaggaaaatgcgcggagttgccaccaatgtttattcgaggaaaacgtcggaaaaaccggaaaggtgtggtctacgaactttaa

SEQ ID NO: 62921 - DNA, 258 bp, Glycine max
  Peptide Sequence Number=SeqID_154606
atgatgacaacaaaagatgatgacaaaggtgatgaacaaaaagctcaaagatcaaagaacaactcaagtgaatcaaagaacatctcaagtgaatcaagaacaagtcaagagttcaagaatcaagaagaattcaagactcaagaagaaatcctagaatcaagaataaagattcaagattcaagattcaagatctcaagaatcaagatcaagattcaagactcaagattcaagaatgaagaaaagactcaatcaagataa

SEQ ID NO: 62922 - DNA, 136 bp, Glycine max
  Peptide Sequence Number=SeqID_154607
ggtttcgttctctaccgaaactgcaagccaagttggaagattccgcttcagttgaagggttcctctcaatgtggggttgcaacggagaacaacagcggtttgtggtggctaatggtggctgtggatgatggagaaa

SEQ ID NO: 62923 - DNA, 351 bp, Glycine max
  Peptide Sequence Number=SeqID_154608
gatgtaccatctgtgggggagctcatgaatctggatgctgtattcctattgaagaacaccccactcgtgaagtccaattacatgggaaatcagcctagaaataattttaatgcaggaggattttctagattccaacatggccagcaatataatcaacagcagggacaatggaggaaccaccctggaaatcagttcaatagagatcaaggtggaccatccacaaggccacaacaacaagggcctagtctctatgatcgcacaacgaagctggaagagactctaagctcagtttatgcaggtttccctatgtccaatcagaagagcacaaagtccaccataaagaatcttgag

SEQ ID NO: 62924 - DNA, 156 bp, Glycine max
  Peptide Sequence Number=SeqID_154609
atggctggctcatggtaccaaatatatgcaaagaagaataggaaaatgcaaggatcacgcatgagcgaacatgaaaacaaaaggtatgcagtttgtagaacaaaagaacgatatgttcattatgatgccatgaagagatgcttatgcgatgcatga

SEQ ID NO: 62925 - DNA, 360 bp, Glycine max
  Peptide Sequence Number=SeqID_154610
atgcaagcacaagcacaacaacagaaaaacttagagataaatggattgaagaggatagaagaagagtccaatataatcttaaagcccaaaaacattatcacttctgccctaggaatagatgaatattttagagtgtcaaactattcaaatgcaaaggagatgtgggatactctccaacttacacatgaaggcaccactgatgtgaaaagatctagagtcaacacctttacacatgaatatgaattatttaggatgaacactaatgagaacatccaaaggaatggcagcccaaggaacatgaaatggaacttcaacgtctcaactaaaatgaagagactgacaagagaaaatgaagcatag

SEQ ID NO: 62926 - DNA, 633 bp, Glycine max
  Peptide Sequence Number=SeqID_154611
atggccagaggaggaaccggtccgatgggttcgatgaggaggccatcgcctagttgctatgtataccggggcaagattttgcccagactgctgccgggagacggcaacatcctgcccagcgaccataattccgacctccccctgccgatgtgtctgctggtgtacgccatcttgacgcggatgagcattcacgtggctcagctaatcgctgatgccatctacatatttgcaggtatggcgcctaccaggcaccctctggacccggataagtccaacagggccctaggatttcccgccttgatcacaggactctaccagtcgtttggagtccctgtcgcacctagtaaggtgatttggccgcccatcacccgagcttttattgagaagtactgcacgcagagacaggtccagggtgatgcaccacaggccgcggacgcgccgccacctcatcaggctggtccagctggatcgtttgatacgcaacagtatttgcggcatttggttcgccagcaggcggccaaccattgggtacatgtacagactcatgattgtctttatcagatgagtctcagcctgcagagccagggctttacttcttttccgtgccctactccggaccagttcagggcagag

SEQ ID NO: 62927 - DNA, 180 bp, Glycine max
  Peptide Sequence Number=SeqID_154612
atggaaacgttacagaaaccttacggaagtgcctcgactcggattttcttcacggaaccaatttttttcactaatttcaagaaaatgggggagatgcttgccacccagctcgcccaggcgagcaaggtgacttcctccaaaagcaaccgtcttctgcaggaatcttctggagggccctag

SEQ ID NO: 62928 - DNA, 186 bp, Glycine max
  Peptide Sequence Number=SeqID_154613
atgttgattgatgttggaaatgcattggcatgtgcatgttgtgtatgttcgtggggggcgaagtgcactgaccttccaggatctttggcacttgttttgggccacattcatacgttggatgttgtgtattatatgtcatggggggtggagtgcactgaccttgtcggatggcccagacgtgggtga

SEQ ID NO: 62929 - DNA, 384 bp, Glycine max
  Peptide Sequence Number=SeqID_154614
atggcaagaatagaaaaagtggtcaagatctcagaacaagagctagaccgattaaagcaaaataggaatgaagtggcagagataccaaggaagtgcttggaggagaaggcgaaagctttggccaaccaaggagaatgggcaacattcatcaacgtattagctctgctagtgtttgggacagtactattcccgaatgtagacgggttggtggatctagtggcgatcgacgcctttcttgcttatcaccacagcaaggaaagcccgatcattgctgttttggcagatacatgtgatatattcgacttgagatatcagtctgtctcctacaaggtcatctcatgtgctccgaagagggtaaagaaaattgggaagaactcttggtag

SEQ ID NO: 62930 - DNA, 237 bp, Glycine max
  Peptide Sequence Number=SeqID_154615
atgtatcctctcttgttctcagttacaacaacccaagtagatgtaccccctacttataccataaaggatgtaccctccaatgtgttaagacaaagttctcaggcgggagaagggagacacaaaagaattcaggctgttagtcctttgttcttttggaaaaaggagaagaaagacacaaaaagaattcaggcggttagtccttgtcgaattctttttggcaaagggagaagagaataa

SEQ ID NO: 62931 - DNA, 291 bp, Glycine max
  Peptide Sequence Number=SeqID_154616
atgcccttgcggggtaggattgcatcatttggtcaagtctttatcacagtagttgtgtctccagcaaaaccacctccaaagtctgatacagaggtcattgatccgctttatctgatgacattgaccatcccaaagcttttcttgaggccttatcaggttagatgggatgccaccgtgtccagggtctttaatccagattcccccctctacataaagcacgaagacctctccgaaatcgcacacgatggtcaatgtctaagcatatcagtgttacaattgtggattttgtaa

SEQ ID NO: 62932 - DNA, 708 bp, Glycine max
  Peptide Sequence Number=SeqID_154617
atgaccaccctgacccagatatggatgacgttgctgctcagcaacatcctgcccagcgatcataattccgacctccctttgccgaagtgtcagctggtgtacgccatcctgacacggatgagtattcacgtggctcagttgatcgctgatgccatttatctatttgcaggtatggcgccgaccaggcaccctttggacccagataagtccaacagggccctgggatttcccgcgctgatcacaggactctgccagtcgtttggagtccccgttgcacctaccaaggtgattcggccgcccatcacccgggcttttattgagaagtactgcacccagagacaggctcagggggatgctccgcaggccgcagacgtgccgccaccttatcaggctggcccagttggatcgtttgatacggagcagtatttgcggcatttggttcgccagcaggcggccaaccaccgggcacatgtacagacccatgattgtttttaccagctaagcctcagcatgcagagccagggcttcgcttctttttcatgccctactctagaccagttcagggcagaggtcgcatggcccggggattggcccgaggcccaagcaggagaggcacccccagaggctcccgacgatggagaggaggcccacgaggacgaggagatggccgatttgcttgacttcttgggagggagtggagctacatga

SEQ ID NO: 62933 - DNA, 515 bp, Glycine max
  Peptide Sequence Number=SeqID_154618
cggatatgaccggaaggctgcttgccggttcattggctcttgaaagccacatccttcactatcctattatgcatattttacttccaagatcttcaaaccttgcacaggtttctgaagaagatcttattgtcatgtgggcttttcataccggccgaaaaattgattgggcacacttagtccgatatcgcatgcataaggcattgcgattaaatgctcctttaccatatccacatctagtcactcttttccttcaacactttaacatccctcttgattctaaaccttatgttccaatcaagagatccttcttgatcggtgcttttgtgggtgctaaacccaatgatgatgaaggacacttaccagtaggagaggattattctctccttcagagtattttggacaggtttgatggacttcaaacctatgttggtgaaaggatcaccaaggttgaaggaaatgtcactttcatccgcacatgctttgatctaccaccaccaccaccaccatcatcttag

SEQ ID NO: 62934 - DNA, 393 bp, Glycine max
  Peptide Sequence Number=SeqID_154619
atgccattgatgctcgctttgaaagaatggatgcccgcatcactcagcttgaagaggattcattattctctaaactttgtagaagcaaagcttcatggtgaatcaaaggtgattcaaaggtgttttgatgataacaatgtaacaaaagatgatgacaaaggtgatgacaaaaagctcaaagatcaatcaaagaacaactcaagtgaatcaagaacaattcaagagttcaagatagaatcaagaagaattcaagactcaagaagaaagttaagagtcaagaatcaagattcaaggttcaagatcccaagaatcaagatcaagattcaagaatcaagagaaggcttaatcaagataagtatgaaaagtttttctcaaaaattgagtagcacatga

SEQ ID NO: 62935 - DNA, 593 bp, Glycine max
  Peptide Sequence Number=SeqID_154620
atgattatgaggggccaatacatttatagtagccaagataaggttactacttcaccttcctctagtgaaagtgaagaagcaaaaggggaagaatctagtgaagaaatctacccccaagaagaaggacaaccattaatggttaaagagaagtgtaaggaggcacttgctagcattgccacacctcttgggcttgagtttattcctcaagtaaggaagctgttggataagggtttggttcgcaagagcttaaatccttgtgctttgttaatacccaaaataggtattattaggcaccaagtccctaaaataagtggtatgatgaatgtgttgagtgttgcaaccctcttttgtaaaatcagtcatgcacccaaagtcttcatgattgatgtacatagggactcattaggtaggaataatcaacataaaaatacagaaaaaggtacgctttattgcattcctttccttaaatttttaaatagtgatcaaggggttcccacggaccctaagaaaataaaggtcattcctgattggccccctccaccaagtataagggaaatctggggcttccatgacttaacaaacttttacaaaag

SEQ ID NO: 62936 - DNA, 159 bp, Glycine max
  Peptide Sequence Number=SeqID_154621
atgaggatttcctcttttacaggccaaggttcaaaaaggtctgaggttgtgtttcaacggggtcttttatcgtgggaacccaatcttgatatctggggtgaaacaaatcagggtgacaagctaggtgggcactcaagcatcctgtttatggcatcgtga

SEQ ID NO: 62937 - DNA, 354 bp, Glycine max
  Peptide Sequence Number=SeqID_154622
atgggaagaatcaaaagaattttcaggctgtgtcgttttgaattctttgacaagggagaagggagacacaaaagaattcaggcggttagtcctttgttcttttggaaaagggagaagcaaaaagaattcagacggttagtccttggcgaattctttttggcaaaggaaaaagagaatgaaaagatgaataacacaagttttcaaggtttagaaaaccagaaaacttcagaaagcttttggtacaaagaagaagaagaagttaaaagagattcaaggattgtaaaggattgtaagagattgattggaaaagtattcaggattatagaaatgcaaaacaaagccttgcttttatag

SEQ ID NO: 62938 - DNA, 420 bp, Glycine max
  Peptide Sequence Number=SeqID_154623
atgcatagatctcctacaggcactttagttcctttggacttagaaatagaagctacactaagaaggaacaaggttgagaggagaaggaaactgttgcaagatagaatagttgcgtccattcttgaggaggagactcatttttctgattcattatcacctgattcaccatcatcaagggaatccgctaatcaatattctgaagctgttaccatggcagatgagcatgatcagaggactacccttgaggactattcaagtggctctagatttgcaatactgttaagattgctggtgtaccagatgaagctatcagactcagccttttctcattttcactggcaggagaggccaagaggtggctccactcattcaaaggcaacagtcttaaaacctgggaagaagtggtggaaaaattcctaa

SEQ ID NO: 62939 - DNA, 312 bp, Glycine max
  Peptide Sequence Number=SeqID_154624
atgaccggaaggcttctcgccggttcattggcattcgaatgccgcatcatgcactacttgattgttcgcatcctactccctagatcatccaaccttgcacagcattttaatgtccctcttgactctgagtcctttgtcaaagtcaagagatccttctctatcggtgcgaatgatgctccagtacaggccgctgaagaccactctctatcaccacatcctcagagagatgactcttcatctcttatgcacaacattcttgacaagttggatggactccacactttcgtcggagatcgctttgacttgtgttag

SEQ ID NO: 62940 - DNA, 246 bp, Glycine max
  Peptide Sequence Number=SeqID_154625
atgccagcgtcagctaatgcaccatttccaggaatggatccatctccacctcagcacgcaatagactcttccattcctgtcttagagatacatgagggccagaccataccagttttgcctttggacacttctcctccagctactccaatgagatttgtgtttcctttcatgaagttcagcaaatgtgcatgtcgaacaaagaaagaacaagaatgtgaacttgcatttagaattgttagtcagtag

SEQ ID NO: 62941 - DNA, 207 bp, Glycine max
  Peptide Sequence Number=SeqID_154626
atggcggtgagcttcttcttgactcatcttctccttgaagtggcatctttaatcatctttcttccttctccattccactgccatgatcttcaagaatcaaaggactccattgatgaagaagatccaaggcctacaagctccacatgcaactacatcatgtggtatcaagagcatcatcatctaggttctattatttttcagtcataa

SEQ ID NO: 62942 - DNA, 261 bp, Glycine max
  Peptide Sequence Number=SeqID_154627
atggttggaccccttgagggctacacgtccttgcctttagagggttgtacgtcctcgccttcggagggctacacgtcctcgccttcagagggctacatgtcctcgactttagagggctacacgtcctcgccttcagagactatttctcagtccttggactttttgcacacgaatcaactgcttctttcagaggtagtcttcgacttcagactacacggtcctgaaaacttaagagccacactggtacctcgccctcactga

SEQ ID NO: 62943 - DNA, 503 bp, Glycine max
  Peptide Sequence Number=SeqID_154628
gttgtaccatttgtggtgaggctcatgaaacaggccaatgtactttattgaagaaaacactcaagaaattcattatacgggaaatcaacatcgacaaaggtatattcaaggaggattttcaatcttccaacagggtccatataatcaacaaggacagtggaggacacaccctagaaattagttcaacaaagaccagagtaacaatgtcaaatcataaaagcactgagtcagcactgaagaaccttgaggtccaggttgaggatgaggataatgttgtgcatgagaagaaaactgttgacaagaaaagtactaatggcaagaaaaatgaagtgagaggcccattcatgttgaccgcaagctgcatagttgatatggggaagaggaagctggagctaggttttgaagatcagaaaattgattttgatttatttgttgaagacaagcttgctccagaacacaatgtttgcttacaggtaatggaaggaggtcaagaggttctgaaa

SEQ ID NO: 62944 - DNA, 390 bp, Glycine max
  Peptide Sequence Number=SeqID_154629
atggtcatttgcgccctttccggagatgatcgcacttttccgaggcggggcgagactttaagctcacaagttattgccagatacgctgagttccggaggataccttatggttattgcacccttttgtcatccagaggcggcggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttgggggatcctctag

SEQ ID NO: 62945 - DNA, 301 bp, Glycine max
  Peptide Sequence Number=SeqID_154630
aagatctactacaggtgatttgatcctcattgatttggagattaacgccacttgtagaaggcgtaatcaagagagaattagaaatttttttcaggatttagaagcagcagcaattccagaggaagaacctcaatcttctgaggcatcttctagttttcctattgcaagacattctcatttagatcctatcgaagaccacatcatggctgaagaaccaagaagagtcaccctggaagattattcaagttctaatgtgccacaatttttcactagcattgcacaaccagaagttcaagcctaa

SEQ ID NO: 62946 - DNA, 48 bp, Glycine max
  Peptide Sequence Number=SeqID_154631
atggttgaaactagcaaaataaacactaaaagaggtgtgaaagataag

SEQ ID NO: 62947 - DNA, 294 bp, Glycine max
  Peptide Sequence Number=SeqID_154632
atggtggcccgggtgatgctagggcacgactacaagcctgaaatgggtttgggcaagaacaacggcggcaggaccagcctggtaagcaccagaggaaaccgcggtgtcgcaacctacccttcggcggaagggcgacgcgtgactcgcgggatgcgtgttccacgaaaggaatacgcgcggagtcgccaccaacgtttatttgaggaaaacgtcggaaaaaccggaaaagatgcgatctacgaacttttaagtgaaaggctcgggagttgtatttacgcacggggaaggtattag

SEQ ID NO: 62948 - DNA, 219 bp, Glycine max
  Peptide Sequence Number=SeqID_154633
atggaaaagggatatgctgctgctagtgaagttgggcaggttcatttgcgaatgaggaagatgctactggttgaggttgcggaggagcctcaactgtttgttgtttctggggctgttgcggttgctgcttttgttgttgctgctggatgggtggaggaacatatggtctgcttgggccagcaacattctgaaaataaggctgttgttgttgctgctgct

SEQ ID NO: 62949 - DNA, 255 bp, Glycine max
  Peptide Sequence Number=SeqID_154634
atggttgatgaagaccagcaaagggttacccttgaggattattctagtagctcagtgccgcaattctttacaagagaagccaagaaatggctctattcattcaaaggtaacagtctgaagacgtgggaggaagttggttataaatttatgaagaaatacttccccgagtcaaagactgcagaagggaaagctgctatttcatcatttcaccagttccctgatgaatccttgagtgaagcattggagaggttttag

SEQ ID NO: 62950 - DNA, 198 bp, Glycine max
  Peptide Sequence Number=SeqID_154635
atggataagagcttgaatgtaggagaaaatgagtggagggagagggagagaggggggcacaaaatttatgcctcaaatgagctattgttcagcccactaatccaagatcaagtccaagattctccactaagtgtgcttaggtgtcatgaggcatgtaaagcacgaaggacatgcacaaagtgtgacaatggggtgtag

SEQ ID NO: 62951 - DNA, 366 bp, Glycine max
  Peptide Sequence Number=SeqID_154636
atgcaagaagaaaatgaagaagaagattcagatgatgaagaagagttttcattctttaggaagaaatttcagaaatttatcaaaaaaagaagaattgacaggcatcagaacttcaacaatggaagaaaatctcaagaagattctcaagtccttagatgttacaaatgcaaccaaattggtcacatcaaagtcaattgtccttcaaatgaagaatggcctgagaaaagtgataagaaaaggtatgatgaaagaaggaacaagaaagcctacattgcatgggatgacaatgattcatccgatggttcaaaaaagattaatcttctaaccaaggattatgaaagtgatgagaacatttctcaagaatga

SEQ ID NO: 62952 - DNA, 726 bp, Glycine max
  Peptide Sequence Number=SeqID_154637
atggtgaacgagtgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagacccccacaaagggtgttggtcgattaagacagcaggacggtggtcatggaagtcgaaatccgctaaggattgtgtaacaactcacctgccgaatcaactagccccgaaaatggatggtgctaaagcgcgcgacctatacccggccggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttctgtttaacagcctgcccaccctggaaactgctcagccggaggaccgagtgcctcccacgcccggtcgtactcataaccgcatcaggtctccaaggtgaacagcctctggtcgatggaacattgtctgcaatggaagtcgagcaacatggatcc

SEQ ID NO: 62953 - DNA, 482 bp, Glycine max
  Peptide Sequence Number=SeqID_154638
ttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggcgcaagaattgtttgttgtgcacttgctctctatgtgtggctggtttcacacctttttctccaagaaggtaggcccgtctatccgctacaaggaaggaagaatcaggattctatcttcatgcgaaggatgtccaaatgttcccttgatggaacaaggggttgtattaattataatcccatcctcgccataagacagcttggctaccccatgagaggagtgccgtcagacgaaagcatcacgcctttcatcgcacggggtttcagtgaccccaatgcgagggataaagagcttaggggaagcagtaatgggatcatcggtgcggctatcataagtggctga

SEQ ID NO: 62954 - DNA, 312 bp, Glycine max
  Peptide Sequence Number=SeqID_154639
atgggtctgggcaaggacggcctcgggaatgccgacgtggccgatattagggaaattcgtacaaatatggattggagtatgaacccgggatgccgggaagaaggaatgcaccgtcaagactttgggcggatagggcatggccaggccatatatgaaggtcgattctttgaggatcctaacaaagagggtttgacaatcgattttgaccgagatgtaagccaaacgatgaacgaagaagaggaagaggacatcctttcaccagagttggagaggttgatcgctcaggaagaacgcgaaatgaagcctcactaa

SEQ ID NO: 62955 - DNA, 659 bp, Glycine max
  Peptide Sequence Number=SeqID_154640
atggccccgaggaagcttgcctcaaagaggtccaggaaggacaaggcggccgaaggaactagttctgctcctgagtatgacagtcaccgctttaggagcgctgtacaccagcagcgcttcgaggccatcaagggatggtcatttctccgggagcaacgcgtccagctcagggatgacgagtatactgatttccaggaggagataggtcgccggcagtgggcatcactggttacccccatggccaatggattctcgtttgatgcagatgctatcggccagctcctgggatatccgtttagctggaagagggccaagagtgcgagtatggctagaggaggaaccgggaggcgagtgcgaattatgcgcaccaacatgaccaccatgactcagatatggatgacgttgctgctcagcaacatcctgcccaccgatcataattccgacctccccctgccgaagtgtcagctggtgtatgccatcctgacgcggatgagcatccatgtggctcagttaatcgttgatgcaatctatatttttgcaggtatggcgcctagcaggcaccctttggatccagataagtccaacggggccctgggatttcccgcactgatcacaggactctgccagtcgtttcggagtcccccgtggcacctaccaag

SEQ ID NO: 62956 - DNA, 327 bp, Glycine max
  Peptide Sequence Number=SeqID_154641
atgtcgataagaatcctccccacttggtttcccttggaagagtttatgaggggtcgacgatcgtccacaatgtcccttgggaatgatcaagtcaagggactaccgaaacctgtagatatgccgaatcctgatgtcgaacccttatacatgatggcattgaccatcccgcagcttttcctcaagcttttgcagatgttgtgggatgctaccatgtttgaggtgtataatgatcacttcgccttgcacataaagcatgaagatctttctaaaatagcacacagtgttcaatgtctcggcatctctgttatacaactgtggattttttaa

SEQ ID NO: 62957 - DNA, 278 bp, Glycine max
  Peptide Sequence Number=SeqID_154642
ggatcgcgtccgcaagacacccagtggactcgaggaagtccaacaaggtcttggagttgccagctctgattacgagcctctgtcaattctacggagtgtctgtcgcccccagcaaggtcatcaaaccccctactaatcgagctttcatcaagaagtactgcaccccaaggcaggcgcagggcgaaacaccacagcagcctggggatggccggcagcgggcaacagacgcaccgccaccacctctagagttcacctcagctcatccacaaaaaggttag

SEQ ID NO: 62958 - DNA, 141 bp, Glycine max
  Peptide Sequence Number=SeqID_154643
atgccacttcgaggagaagatgagtcaagaagaagctcaccaccacaggaagccatggataagagcttgaagcccactaatccaagatcaagtccaagattctccactgtagaagcaaagactttgcctttgatgttttga

SEQ ID NO: 62959 - DNA, 594 bp, Glycine max
  Peptide Sequence Number=SeqID_154644
atggatttagcagcgatcggcgcttttcttgcttatcatcacaacaaggaaagcccggtcattgctgtcttggccgatgcatatgacacattcgacttgaggtgcaaaaagagtagcgtaaggattgtctgttgcacgcccgctctttatgtgtggttggtctcccacgtgcttcatcatgaaggtagacctgtccgtcctctacaaggtcatcgcatgtgcaccaaaaagggaaaaacaaattgggaggaactcttaacaggtatggcaggagcgtctgttagttggttcccccaatggaaagaaggagggactagagcgttgtgctcatgtgaaggattcccaaacatccccttgatgggaacaaagggttgcattaattataatcccattttggccataagacaactaggctaccctatgagaggtgcgccccggaggagactatcgcgcctttcgtcgcacggggtttcaatgaaggcaatgcaaaaatacttcagagaatctgcaaggcgtggaatacagtggaaagaaaggataaggagcttagaggaagcagcaatggtgtcatcagtggctatcataaatggctga

SEQ ID NO: 62960 - DNA, 221 bp, Glycine max
  Peptide Sequence Number=SeqID_154645
atggagaattgcactaagcaatcactacgcatggctccaaactcgtgggtggaggggttagagaatggagaattgcacaaagcaatcacgacgtatggctccaaactcgtgggtggaggatgcatgaacgaaaacgcaattcaaggggctccgaaacagggtagagaatggagaattgcactaagcaatcactacgcatggctccaaactcgtgggtggag

SEQ ID NO: 62961 - DNA, 504 bp, Glycine max
  Peptide Sequence Number=SeqID_154646
atgggtgaccaaaaggagacacaggaacagatgaaagccgacatgtcagctttgaaagagcaaatgccttccatgatggaggccatgttaggaatgagacaactcatggataataacgtggccaccgctgccgctgttagtttgaatgctgaagcagacccaactctcccaactaccgcgcaccatcctctcccaaacgcagtaggacaagaaaggagcacactggggcacatcagcaaccctcatttgggatacaaccgggtggcttacccttttggattaccacctaattacacgccaccagtcatgcgtgatgacgcgggtcatgtcccttcccccatccttgaaggggagcctcctcaacagcccgacgaggttcacgaggatcatcgagagtatgaccaaggggatgtcaatttctaccctccggtccccgtcgaggggccggcgcctgtaacatcctggaaatttctacccggaatttttggaaacgatgtattttga

SEQ ID NO: 62962 - DNA, 330 bp, Glycine max
  Peptide Sequence Number=SeqID_154647
atgaagacccctgacgaagcaatcgacttaattgaaagcatgactgctagtgacactgccattttgagagatcgagctcacattcctaccacgaagagtttattggagctaacctcacaggacgctctgttggcacaaaacaagttgctatccaagcaactagagacattaacagaaacacttagatgtacaatttgtggtggagctcatgaatatggatattgtatccctaatgaagataaagttgcacataaagtcaatgatatggggaatcagcccagaggcaatttcaatacaagtggatttctaggatttcagaacaaccagtag

SEQ ID NO: 62963 - DNA, 333 bp, Glycine max
  Peptide Sequence Number=SeqID_154648
atggcggattcctttattggagagatatcgcagcagcaactacaccctcaaaaggaggacatgtggatatggaaacacgactcaagtggacattactcaacaaaatcagggtatgacctaataaggagaggagtagtgggggcagatcagacttcagattttgtggagctatggaaactcaaaattccagctaagtctgcgctctacctcaaaacccaagggatcacttcttgcaacatggaattgggaaaaatcagggaaagaaggctacaagatggaaatgctgggggattgctctcacaagaacaatatggcagcatagaaacagaatag

SEQ ID NO: 62964 - DNA, 378 bp, Glycine max
  Peptide Sequence Number=SeqID_154649
atggcgcctactaggcaccctttggacccagagaagtccaacagggccctggggtttccggctctgatcatgggcctctgccagtcctacggggttcatgtcacccccagcaaggtaatccgaccgccgatcacccgagccttcattgagaagtactgcacgcctaggcaggcgcagggtgacacacatcaggacgcggatgcaccgccaccacctcggcaggccgattcgactggaccactgggcgtggagtggtatctacaacatttggtttgccagcagacggccaaccaccatggacaggggcagggttttgccgcttttgtatgccctaccccggagcagtttggggctgaggtcgcatggcctgaagactag

SEQ ID NO: 62965 - DNA, 249 bp, Glycine max
  Peptide Sequence Number=SeqID_154650
atggactcgggaaggttccaagttagtgtacaaggtaacaattgccccagtaagactttcttggaagaaatgtatcagcatttcctcatcttttacgtatgcccccatcttccgacaatacatcttaggatggttcttggggcaagtaatgatgcaatcctaccccccccccccccccaagggcattggatagaagactccaagaagattgggccaaagatgcaagagaaggccctagggttctcatga

SEQ ID NO: 62966 - DNA, 1009 bp, Glycine max
  Peptide Sequence Number=SeqID_154651
atggattgggaccagctcttggccgggataggaggtagaacaatcagttggttcccccaatggaaggaaggaaaagaaggagtccttttctcatgtgggagatacccaaacattccgctggtaggaacgaggggttgtattaattacaatcccacgctcgctataagacaactagggtaccccatgaggggagcaccgacggaagaaagcatgtctcctttcctcgtgagggatctcggcgcacaaaattccaagactatccaaagaatccataaggcatgggaaaccccgttaaggaaagatcaagagcttagaggcgttcgtaatggcatcattgattggctcgccaagttaaaagtcgtcagcgaagagaattttgaagcaccggaagaggacgaggaagtccaagctctcaaaagcaagttaggaaaggcaaaacttgccaaggagaagttcaagttggccgctacacacgttcggaaggagtgtgccgggttacgggaagagaatgcaattaccgcaagagcccttgaacaagaaaccaagagggctcgcaaggaagagtatggccggaacaaatttcgcggagctctatggggtagcaatagtgaactcaagttgcgaagggaagaaagggaccaatcgcgagcacatggcatggttctgaaagaggagttgatgacttgttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccgagaggcaaccatgtgggtgggtcggtttgctcttaccttgaacgggagtcaagaacttccccgattgttagccaaggccaaggcgatggcagacacctactccgcccccgaagagatccatgggcttctcggctatt

SEQ ID NO: 62967 - DNA, 81 bp, Glycine max
  Peptide Sequence Number=SeqID_154652
atggaagctctcgagaaatttaaattgtcatacattacacttggatgtccgattcaggcacatcaaggctccatattgtag

SEQ ID NO: 62968 - DNA, 237 bp, Glycine max
  Peptide Sequence Number=SeqID_154653
atggcaccagtgactatgggattatgtactgtcattgttcagattcaatgctggttgggtattgtgatgctgattgggctggaagtgcagatgacagaaaaagcacttctggtggatgcttctatctgggcaacaatcttatttcatggttcagcaagaagcagaactattttcaggaaaatgatagatctcatccagcatcaagctgttgcagcccagaaacgcacactgctataa

SEQ ID NO: 62969 - DNA, 603 bp, Glycine max
  Peptide Sequence Number=SeqID_154654
atggatggcgctaaagcgcgcgacctatacccggccgtcggggcaaggaccaagccccgatgtgtaggagggcgcggcggtcgctgcaaaacccagggcgcgagcccgggcggagcggtcgtcggtgcagatcttggtggtagtagcaaatattcaaatgagaactttgaaggccgaagaggggaaagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 62970 - DNA, 591 bp, Glycine max
  Peptide Sequence Number=SeqID_154655
atggggacaaatcaaaacgacaaaaggttttatcaagtcaaggttaaaagtctagatgtcaccagcctcaaggaattgggacgattgatgggacctctccaaaggcaagccttccgcaaagtgtacgggaagattctagatttgatcgcagcagaggtatttacagaagttgtcgtatccctcgcccaatactatgaccagccgttgaggtgcttcacgtttagggacttccaaatggtaccgactattgaagagtttgaggaaatactaggatgccctcttgggggaagaaaaccgtatcttttctccgggtttcttccatccttgggcaagattgcagctgtggtcggggattcgaaaaaagagttggatcccatgaagcaaactcgcaacggcgtagtaggcctgccacgaaaatacttggaaggtaaggtaagggatatcgcgagccaagagaagtggggcccgtttgcagatatactagctttgttgatttttggggttgtcctctttccgaacgtggacagtttggtggacttagccgcgattgatgctttcctcgcatatcaccatagcaaggagagtccagtg

SEQ ID NO: 62971 - DNA, 837 bp, Glycine max
  Peptide Sequence Number=SeqID_154656
atggccaagttcgatccagacatagtcctcgaattttatgccaatgcttggcctacagaggagggcgtgcgagatatgaggtcctgggtgaggggtcagtggatcccgtttgatgcagatgctatcggccagctcctgggatatcctttagtgctggaagagggtcaggagtgcgagtatggccagaggaggaaccggtccaatgggttcgatgaggaggccatcgcccatttgctatgtataccggggcaggattttgcccggactgctgccaggagacgagtgcggatcatgcgcaccaacatgaccaccatgactcagatctggatgacgttgctgctcagcaacattcaacccagcgaccataattccgacctccccctgccgaagtgtcagctggtgtacgccattcctgacgcggatgaggtccatgtggctcagttgatcgctgatgccatttatttatttgcagataagtctaacaaggccctgggatttccggcgttgattacgggtctctgccagtcattcagggttcccgtcacacctagcaaggccacagacgcaccgccaccacctcatcaggctgatccagctgggtcatttggcatggagcggtatttacagcacttggttcgccagcaggcggccaaccacagggggcaggtgcagactcacgagtgtctctaccagctcagcctcagtctgcagagccagggtttcgctccttttccgtgccctactctagatcagtttagggctgaggtcgcatggcccggagattggcccgaggaccagacagaggaggcatctgcagaggctcctggcgatccatag

SEQ ID NO: 62972 - DNA, 186 bp, Glycine max
  Peptide Sequence Number=SeqID_154657
atggcttctaggaaacgcaagagtattgggagattttcctccttagatgcttggaaccgatacatagataatgtcctggggagaaacatcttgcctgagaggaaggtggagctctatcacactgagctagatgattttaagactgaattggagaggcgtaatttccataaatgcctcaccaattag

SEQ ID NO: 62973 - DNA, 489 bp, Glycine max
  Peptide Sequence Number=SeqID_154658
atggggatgaggggttgcatcaactataaccctgtgttggccataagacagttaggatatcctatgagaggaagaaaagataaagaacttagaggaagaagcaatgatgtcataggtggctatcacaaatggttgaaatctagaatgcaagggatagcttggctcaaaaagctaaaaggtctgaatggggaagaggcagaagtgcccgaggagagtgaagaggtgcaatccttgaaggttgagcatgaaaaggcaaaagtagccgaggagaagctgaaggtggcagtcgctagagttaggaaagaatgtgataagttgaaggatatcaacatgactgcggatgaagcgctagagcaagaaacaaggaaatccaaaaaggaggagtggagcagaaacaagtttcgaggggcttcgttaggcagcagtaatgagctcaaacttagaaaagtcgagagagacaaatcaaggacgaagaacttgatgttatag

SEQ ID NO: 62974 - DNA, 186 bp, Glycine max
  misc_feature (179)..(179): n is a, c, g, or t
  Peptide Sequence Number=SeqID_154659
atggagttcttggagctcaagcagggaaacatgactgtggctgaatatgcagccaagttcaaggagttgcgacacactcaaagagattgttcacgactcaagaaagagcaaaatggtggaggcccgaatggtcacactgggcatccaaaggccacgggaagagtctttacccttaatgngtattga

SEQ ID NO: 62975 - DNA, 246 bp, Glycine max
  Peptide Sequence Number=SeqID_154660
atgcttaaactcaaaaacaaagggggagaatggaaatttatttgtcatcatcaaaaagggggagattgtagaagcaagcttcatgatgaatcaagattgattcaaagagttttgatgataacaaagatgatgacaaaaagctcaaaagtcaagaacacttatgataacaaagatgatgatctcaagaatcaaagaatgagttcaagattgaatcatgtacactttaaggatcaagacgaaagttga

SEQ ID NO: 62976 - DNA, 540 bp, Glycine max
  Peptide Sequence Number=SeqID_154661
atggatttcttctcaaatgagagttttgaatgctttcaagcatttgaaaactccaatcttattccattcatgtctctgaaattacctgtttattatgatctagtcaaagccttttattctaatttagaaatccatgaaggcaccctaatgtttgaagtttatgggattaagatggtcattgaccagtcccttttctatgatttaacccaattgccaagcaaaggtgtaccatttgaaggtgcactgattgacgattggaagtttgatttctctgtacatgatgcccgccggttggtgaagaaaggtggtcgacatgttggtgtagaaggacatgatggagaagattcatctctcctttcaaagattttggacaggtttgatggtcttcaaacctttgttggtgagaggtttgacaatttggaattacaagtggatatgcgcttcaatgaaatggagtcaagaatcacaaaggttgaagaagatgtgtcttacattcattcaagctttgatcttccaccaccgccaccaccatcatcttag

SEQ ID NO: 62977 - DNA, 180 bp, Glycine max
  Peptide Sequence Number=SeqID_154662
atggtgattttacaccatggagatgcagcggaaggtagcttccttgagaagctttctaaagaaaacttccttgagaagctagagcttagctacacacacccatctaaaactaagctcacctccttgagaagcttccttgagaagctagagcttagctacacacacccctctaataactaa

SEQ ID NO: 62978 - DNA, 207 bp, Glycine max
  Peptide Sequence Number=SeqID_154663
atgcagacatgtgtgtcgcaacctacccgtttgcgggcgagcgaggcgagactcatgggtgcgtcttccaaaggaggaaaatgcgcggagtctccaccaatgtttattgaaaggaaaacgttagaaaaaccaaaggaaaccggtcgacaaaagcggggctcttgctcctacgtaccctccatcgaagaggaaatcagacctacgtag

SEQ ID NO: 62979 - DNA, 201 bp, Glycine max
  Peptide Sequence Number=SeqID_154664
atgaaaatcatccaagcaacccagacatgcagtggtaagtgttactatttggaggcttgccatgccatcgccgagacgttggagcatcatctcagcctaaatgaaatcacaccagacacatcgacacatgaggtcatccaaaaatgcctcaggattgccaggggtgtcacaaaagacggtaatgtgtatgtgaggtcttga

SEQ ID NO: 62980 - DNA, 189 bp, Glycine max
  Peptide Sequence Number=SeqID_154665
atggcaggttcatctgagagctctacatcatcaaaaggttgtggagaaattgaagagagtgcacagttttttatttttaaatcacaagttagacaagatcatatcgatgcaagtgaacagtgtgagctaggtttgtatgatggctatgataatgaggaattaagtttggtcactagctactactactag

SEQ ID NO: 62981 - DNA, 465 bp, Glycine max
  Peptide Sequence Number=SeqID_154666
atggattcaaatgcttgtctaccacacttgctagtgttagcaataacattggtattggttagtcatgcaatggaagattcagctcaagacaaacagagatgtgcagaatccctgacaggtgttgcaacgtgtctgccatatttgggtgctgacgcgaaagcacccacagcagattgttgcggtggtctcacacaagccatgaagaccaacaagaagtgtgtctgccttattctcaaagacagggatgttcctgaccttggcttaaagattaacatgacaattgctgttggtctcccttctctttgcaaaacacctgataatctctcacagtgctctgttttcaagatacaactaaacaaggttcttgatagcaacaacaacattacggaagaaccagaggtagcagctaatagcagaccagcaaggaaccacaacagacccactcacctcagagattacgtttag

SEQ ID NO: 62982 - DNA, 1860 bp, Glycine max
  Peptide Sequence Number=SeqID_154667
atggaggagccgaactccgattgctggctgccaccaggttggactgtggaagtgagggtgagaaagaatggtaagagagacaaggtgtcagagaatttcaaaggagggtttggactttggagaagtttttttaactctgggaagaatgaaactagacactgtgaaatggaaagaggccacagcaggtcaagtgagagtgagagtcatctttctgctttccctcctattatatattacttccccccctcaagtggactaaaattcaattccaaggtggaggttatagttgagaaagctattgcggaagggttaccaccaggatgggtgaaaaagaccagaatcacaacaaatggagattcagttagaagagatacgttctatattgaccctgtaaatggttatacattctgctcaataaaagatgttgattgctatcttgaatctggagagataggaagctacgaattcaagtcaaaagacaatgatggcactgatatggagttaaaagctgacaaatctccttcaacaagtgtaaccgtgaaaccaacattatcaattagcatgggtcaaagctcagacatggacatgatagctaatgaccaacagattccaagatctgcaagttctgaagaatatatgtctgtgcccatctctgaatgtgtcgtgggcgccaaactgaccagttcagttctatcactggctaaaagttcagataaaaaacaagggaaggttggtgtagctcaaagcgcttcggtttctggttgcactaacaaagatgccgaagaaaagcaacttcaagaaaattcagagacaaaacatggcactgaaaaagcccaggccaaagatccccagtgcaaaaacaagcacaagaaagagatcaatttgcctcgccgtgcttcaaagcgtcttgctggaattaaggttgatcctgttccggaacttaaaataagaaatagagcacgccgtgttgcagttaaacaatcagaggaggaggaaaccatcacaaatgtagataaatctgccaacagcttgcttgatggtctagcaaaacagaaattaaataacgaggatactgacaagactctagaagtgcaaagaagcgacaaggaaaaagaatgcttctctttttcgtctctggagaacaatgctactgtggaagagtgtgtgagagtcattgaaaatggagataaagttgatgctaagttagattacacccttgactttcccctcagagaactactaacagacccttgtattgcatttgccattcaaacactcactggagtaacattcgaagcctccaaagacttacaaactttttccgagttaaaaaacagccagcattccaaaacttctgcttctgccgccgccattggcgaaggcgatggtaagaaaagcaatgatgggttaggtggcaatgagttctcatctccagagaacctttctattccaccagaacatgctggtgatgccaaaactgatttaaaggccaagaatgagaatgcaggaccatcttctgaaaagacacttgacatgtcatcatggatggatccatgcattgaatttgctataaaaactctcactggcaccatcccatcagactctgctgatcaaaatcccaagaactgcctccaacagcaactcagctcatcaaatagccaacacagtgagatggccttgtcaagtgtcagtttagataacatatacaaaactgactactcttgcagccaatactttgacacacagaaaccaatgtttaataaacagtcttttgtggatccatcactgcagcacaccagaaatataggtattggaaattctgctggatccagactctctcactgtggtgaaagatactag

SEQ ID NO: 62983 - DNA, 234 bp, Glycine max
  Peptide Sequence Number=SeqID_154668
atggtgttttatggtgcggcggcgagggtttggtttcaaatccaaggtggattcggaagagtcggggaggaggcttccatggagttgaggaagtgcacgtgcttctcgtccgtccagaacgccgtcgcttcgctcgccggcacctgcgccatcgcggtgggtggaggaaccgatgctgcggtggcgctcgtagtttcttcggggattcctaggaggagagtgaggttgttttaa

SEQ ID NO: 62984 - DNA, 576 bp, Glycine max
  Peptide Sequence Number=SeqID_154669
atggggtacgaagttttttttattagtgggcagagcttcaggggacgtgtaaggtgggatgaggctaatattggagaaattgaggcaaacaaacctgtgaggcagaaaattactgagcctaagactccatatcatcctatgattgatgatgacagttctctatcccctgtacgaggaagttttgatgcatgtattgatgatcaaaatcacacgatgcatgctgaagcaatatggagtgctctgaatgatgtagcctccagtagcagaagaggcactggacaatctggtggttggacgtcatctgaggatgagccagaagcaatggagcaagatgatgatgattctgaaacagataggaacttgagttttaaagagcacagaaaggcccactatgatgaatttcttaaagtcaaagagctgcaacagaggggttctcttgaggatgaaagtgacgaagataataattctgaacccagtaaggtggagaaatgtgagtcgtcttcactgagtgatagtgtaaaagagatggacatcgagggaaagaagtcttcaactcctcaagctaatggttcttag

SEQ ID NO: 62985 - DNA, 243 bp, Glycine max
  Peptide Sequence Number=SeqID_154670
atgtcttctcaaaattatcttcagttttctacatctcctccgtttggctacaaaggtggtctagcaaaagatgcatgggtaagcaacacttttgcatggttagctcttataatgtttcctttcttggaatctattctgaaagcttcagtggtttctggattaaatgctactgtactacactatgaaacaaacaatgctctaaaatggattgagaaagaaggcctaagtgatacaagacactaa

SEQ ID NO: 62986 - DNA, 2295 bp, Glycine max
  Peptide Sequence Number=SeqID_154671
atggaaggccatagcgagatgggtctaatgggagaaagttttgatactagtaatttgctagggaggatgagggatgacgaatatgaaagccggtccggaagtgataattttgatggcggatctggtgatgatcaagatgctggggatgatcagccacataaaaagaagaagaaataccataggcacacccctcaacaaattcaggagcttgaagcgtttttcaaggagtgtcctcatcccgacgagaagcaaagaacagatcttagcaagaggcttggcttggagaacaagcaagtcaagttctggtttcagaatcgacgaacccaaatgaagaataagttgttaaaaattaacattatcgttatcagttgctatttgtttggcggaagccaaatgaagacacaactggaacgccatgagaacatgattcttaggcaggaaaatgacaagctccgagctgagaacagtgtaatgaaggatgctttggcaaatccgatatgtaacaactgtggtggcccagctattcctggtcaaatttcattggaggagcaccaaactagaatggaaaatgcccgactgaaggatgaattgaaccgaatatgtgcattggcaaacaagttcctgggccggcccctctcaccactggccagtcccatggctctgccaccctcaaattctggtctagaacttgctattggaagaaacggacttggtggttcaagcaattttggcatgcccttgccaatgggatttgatgtgggagatggagctttgggctcctctcctgcgatgtctactatgggtgctagatcaccaatgggaatgatgggaaacgaaatccagcttgagagatccatgcttttagaccttgcactgagtgctatgaatgaattaattaagatggctcagcctgatacctctctttggattaaaagctctgatggcaggaatgaagtactgaaccatgatgagtatgcaagactgttttctccttatattggatcaaaacctgctgctggttatgtgactgaagctacaagaggaactggagtagtatcagccagcagtttgggccttgttgaaatattgatggatgcggatcaatggtcggagatgttttcatctatgattgctagtgctgccactgtggaagtactatctagtggcacgggtggaaccagaagtggagcgttgcaagtgatgcttgctgaggttcaattgctttctccactagtccctgctcgtcaagtgagtttcctcaggttttgcaagaagcacgctgaaggtttatgggctgtggttgatgtttcagttgacattggtcgtaatgttaccaattcacatccattaatgagctgcaggaggcttccctcgggctgtgttattcaggacatgcccaatggtttttccaatattacttgggttgaacattcccaatatgatgagagtgtcatccaccaactttatcgcccattggttagttctggcattggttttggtgctcagagatggattgccaccctcctaaggcagtgtgactgcttggcaatcctcaggtctcctcaaggcccatctgaggaccccacagcccaagcgggtaggacaaacatgatgaagctcgcacaacgcatgaccgagtgcttctgctcagggatctgtgcttcatctgcttgcaagtgggacatactgcacattggtaatctggctgatgacatgagaatcatggcccggaaaatcgatgacccaactgaggctcctggcattgtgctgagtgcttcaacttctgtttggatgccggtgtcacggaaaagggtgtttgattttctgcgtgatgaaaatttgagaggtgagtgggacctgctgtccaaagatggaccaatgaaggagatgctccatattgctaaaggacaagaccgtggaaattgtgtttccatccttcattctgctaatagcgagtgcaatgtgctatatctgcaagagtcatggagtgatgcctctggctcgatggtagtgtattccccgatcaacatgcaagccttgcagatggtgatgagctgtggagattcatcatttgtccctctccgtccatcaggctttgctattctgccagatggcacttcaaacaacggtgatggcagtgacggtggtggcagctgcttgcttacagttgggttacaaatgttgccaaatggcaaccaccaatcagccaagttcacaatggagtcagttgatgctgtcaataacctgatctcatttaccattcagaaggtcaaagatgcacttggagttgcatga

SEQ ID NO: 62987 - DNA, 1314 bp, Glycine max
  Peptide Sequence Number=SeqID_154672
atgggttttctccggcgactcttcggcggcaagaagcaccacaacccaccaccctcctccgacgcctccaaacccagcaaagacaagaaaacatggagcttcgtcaaacacagtacgaggtacaaacccaacacattaccaacaacacttaacaacaacagcaactttgacccttccacttcctcctctcctttccccgaatctttggacgccaacaaacatgccatcgccgtcgccgccgccaccgccgctgtcgccgaagccgctctcgccgccgcacacgctgctgccgaggttgtcaggctgaccagcagcaccggctgtgcctccagcctgcccgccgcggcgccgcagtcccggcgcgtggcaaatgaaaccaccgccgccgcagtgaaaatccagtcggcgtttcgaggttacttggcaaggagggcattgagagcacttaaagcattggtgaagttgcaagcattggtgaggggtcacattgtgaggaagcaaacttcagatatgctaaggcgcatgcaaaccttggtgagactgcagtcccgggcacgtgcaactcgtgggaacttgtcagataatatgcattctttcaagtcttcactttctcattaccctgtccctgaagattatcagcactcacttcgtgcctatagtacaaaatttgatggatctattctcaagagatgtagttccaatgcaaattttagggacattgacgtggagaaagctcggttcggttcccattggttagacagttggatggaagaaaattcttggagacaaactagagatgcatcattgaaaaatggacaccttgatgatgagaagagtgacaagattcttgaagtagatacttggaagccacacttgaactcacaccatagtagtggcagctcatttcagacatcatcacatcattatttgtcttctgattacaacaatgagaattttgtggcctatgagtctccatccaaacgttcttccaaagctctaaatccaagtctatcttctagggaggttcttccctttggctctttgaaatctcacaaaggaaaagaagaagcggctttgcaaaatgttgaggatagtcctcaagcattttctgcctcctctagacttggaagtgatgcaaggagaggtccattcacaccaactaagagtgagtgtgcatggagtttcttcagtggctacccgggtcatcccaattacatggcgaataccgaatcttctagagccaagggcctagttcagatagggattctgattttaggagcaaggcctatgcaacaaccacaagcagctgtttga

SEQ ID NO: 62988 - DNA, 1470 bp, Glycine max
  Peptide Sequence Number=SeqID_154673
atggattttgttgagtccgttttcgttagtggaaatggtaatgtgacaggtatttatttgaagaacttggtgttgagtcttaagaatccagggataaaggtgatcaatcatggtattggtgctgaggtcttggatgagatgatatgcggaatccataggtttcatgaactagatgctgagactgtgctcatggacaatttcttgtgtcactgctacccctccttccctgaacctgaattaactcttggcacttcagagcacattgatagcgacttcatgacaattcttctacaagaccagatgggtggtcttcaagttcttcatgagaatcaaagtgttgatgttcatccagtgcatagatctcttgtaaacattggggattttctacagttaacgtaccacaccgaaccaaaaatggatgtcgccgtctccggaaactctctcgccggaacttccacaccctataaccgtttgcaagaactaaaggccttcgacgaatccaaagctggagttaaaggcctggtcgactccggcatcaccaaactcccaaaaattttcgtccggccgccagaggacctcgccgccgccgacccagtatccggcaaccctgccggtgcccagttcacgatccccataattgacctcgacggccttaccggcgagcgctccggcgtggtggctggagtccggcgggcggcggagacggtggggttcttccaggtggtgaatcacggaattccggtgaaggtgctggaggagacgatggcggcggtgcatgagttccacgagctgccacaagagttgaaggctgagtactatagcagggagcagatgaagaaggtgaagtatgggagcaactttgatttgtatcagtcaaagtatgctaattggagggacactcttttctgtgtgatgggtcctgaccctcttgatcctcaagaactgcctccaatctgtatggatgtagcaatggaatactctaggcaagttaagttgttggggagagttttatttgggttactatcagaagcacttggactcgaccctgaccatcttgaaggcatggattgtgcaaagggccactcaattttgtttcactattatccatcatgtcctgagcctgaactcactatgggcactaccaggcactctgatcctgatttcctcacaattctgcttcaagatcacattggagggctccaagttttgagccataatggatgggttgatgttccccctgttccaggagctctagtagtaaacattggagatctgctacagttgtatgacctaattcacaaggtttactttggaggaggcacaagaaagatatatggcaatgaaaatgtactttggtttctttccaacgaatgcaaccaccattgtggttgcgttgcagttgcgtttacccccaaaaaccttgatattgtggctaaaattgtggtcatggactgtcttttaaaaccttga

SEQ ID NO: 62989 - DNA, 1089 bp, Glycine max
  Peptide Sequence Number=SeqID_154674
atgctgttagtgataagggtattgacagcagggcgccagcttgcaaagattttggagttgcaatcactgaatgatttgggcttttctaaaagatacgtgagatgtttgcagatttcggaggttgtcaatagcatgaaagacctaatagatatctgttcggagcacaaaattggtgcaattgagagtctgaaaaattatcctcgactagcaacagcctcaaagggccagatgcaaaagatgcaggaaatggaacagctggcaaatgttcaaggtctgccaactgatcgaaacacactcaacaagctaatgacactgaatcctggattgaacaaccatatgaacaacactaataatatggttggtcgtggtgctttgagtgggtcagcccaagctgctttagcactgaacaactaccaaaatcttctcatgaggcaaaattcaatgaactctagccctggctcacttcagcgcgaagggtcctctttcaataattcaaacccgagtccctcttctgctttgcaaggaactggtcctgctttaattccaggctcaatgcagaactcgcctgtaggtggtttcccaagtccccatctaaccccacagcagcagcaacaacaactccttcaacagcgcacattaagtgcaaatggtttacttcaacaaaatcattcacaggggtcccaaggaaatcaagctctacagcagcagcagatgatccagcaactgctgcaggaaatgtcaaataacaatgggggactgcaatcacagtctcttggtggacataatgcaaatgggaatatttcaaagaacacaatgggttttgggggccatactccatctttaagcggaggttctgccaatgttccaggaaacaatagacccatttcaaggaataatagcttcaaaacagcttcaaatagtgattcttctgcggccggtggcaacaatggattcaaccagagaacatctgatatgcaacaaaatctacatttgcaagacgtggctcaggatattggcaatgagttcttggataaccccttctttaacagcgatcttgatgacaacatgggtttcagctggaaggcatga

SEQ ID NO: 62990 - DNA, 870 bp, Glycine max
  Peptide Sequence Number=SeqID_154675
atgggggccggtgtttctacaactgcaatagaaaatgatgatgggggcactttttctttgtcaacaaagactacccttgatgatatccctgagaattgcatctcttcaatgatgatgagttttgatccacaagagatttgcacattggcaagagtgaataaggcctttcacagagcttcctctgctgactttgtgtgggaatcaaagttgcccccaagctataaattccttctaaataaagtacttggtgaacaaaatcttggttccatgaccaagaaagagatctatgccaaactgtgtagaccaaatttctttgatggtgccaacaaagaagtttggctggacagaagcagaggacaagtttgtatgttcatttcatcaaaatccttcaagattacaggaatagatgatagaagatattggaataatattccaactgaggaatccaggttcaagagtgttgcatatcttcaacaaatgtggtgggttgaagtaataggggagctagagtttgagtttccaaaagggaactatagtgtatttttcaagcttcaattgggcaagccctcaaagagattgggccggcgagtgtgcaaccttgatcaagtgcatggatgggacatcaagcccgttagatttcaactatctacatcggacggccagcgttcactctcccagtgctatttgcgtgggtccggagagtgggcccactaccatgttggtgactttgcaatcgataagcccaatgggccaaccaacatcaacttctccttggcccaaattgattgcactcacaccaaaggtggtctttgcatagatggggtagtgatttgcccgaaggagttcacagaaagattgaaacaattttag

SEQ ID NO: 62991 - DNA, 1389 bp, Glycine max
  Peptide Sequence Number=SeqID_154676
atgtctgaagtgagaaacaaagtggatttcatccagttgcttggacctgacatgtcaatcaagattctcacccatttggatgacccttgtgatcttattcgggtttcttctgtttccagttcttggcaccgatttgttattgaacatggcctctgcaagcaactttgcttgaaaatgtttcctgaaatatctggtgttgctcatataattgagcttgacaacattattgaaccactaagcaacactcttggcagttatgtaagttgggagtctcataagagaaatcatagagtctatgcatttttggcttctggtcttactcctatgaggaaaaattgcatctcaaaagccattagtgcatccagcactgataactaccctgaagaaagcattctacatacgttggagcctggggatagaactgaatatagagcatcatactggtcaagcaaaggggaaagcgatccttctgttcctgagactttagtttatgagctagcttcaaaattatgtcttgttacggagatttatgtccatccattccaagcatattttcagcatggcttccctatatattctgctaaggctgtccgattcagaatgggccattcgaaacacccaatggaattagagagtcctgtggacaacatggctgctaatcacgtcttgggcaataatcaattcatatggacatatacatcacctgaatttccaatgcttcaacttgaagttgagattcatctactggcttttttctgggaatcatccacttatgaaattctcattcttggtttactggcacacttcaggtatcattcagatggagaatttatgtcaagaacaggatcagtcagggcagctatagtggatgtacggggaagtagagctacaatgtgctccaccattcataagcccagtagccataggggatacacacaacaaagcagcgagctagggagctgtcatatcaggaatttggcagaagggaaaagggtagatgttttcagggggattgttaaagatggtaattctgggaggaaggacagtgtgaaggatatggctactatagtactatcagatcttggttccccaatttcaccattgtggacaagcatctctcatgttcaagttatgggacgactgctttttccggaatttgatgtcaaaattcatcattggtcaggaaagtgtaccttgaaatactgccctcaaacagattgttatatgtcttctccaacatcatcaccgagaagcaactcgagtaatccgtcacgcctgcggaccataacctcaagcataatgcagaggggtgtgagacgttgggagcaatttctcttgggtgcattgcttggtactggtcctgttgtagttgataatgaagatcaatga

SEQ ID NO: 62992 - DNA, 477 bp, Glycine max
  Peptide Sequence Number=SeqID_154677
atgaacatagtctgtttcaaaccctgcattccttcctcattactatgccccagaaccagcttcagaaaattcccactaacaattccacgtttcagtcttcaagattctcagcagcagcagcagcaacaacaacaacaacaactcaacctctccgttcttcgcttcacattggggattccagggttggatgagtcttacttgcccagatggattggttatggctttggttcacttctgctcttgaatcactttcttgggtctgactcagccactgttacaccggctcagcttagtacagaggttttgggtctgtctttggcttccttctcgattgtgctgccttaccttggtaaatttctcaagttagacttggagatatatacaacaacgccttatcccactaggtggggtcggctacatggatcaacttccgccataatgttctatcaagtaccatacttctatccaaatcattaa

SEQ ID NO: 62993 - DNA, 1689 bp, Glycine max
  Peptide Sequence Number=SeqID_154678
atgtgtcatccaactcttgacgtcacttgcaattgccaatgctgcagcacttcgcctcctgattgcccaatttcaatcactaaccctttgatctccaaaccccaaaacaccaccacaccaccaccaccacctcatcaacataacaacacaacaacaaaaacaaaaacaccaccaccatcaacaacagcaacaaaaacaacaacagcaccaaaaccccatcatgtccctgaagccatcaaagaagtgttttcaatatccaaaattgtcatcccaatgatcctcactggcctcctcctctactgccgctccatgatctccatgctcttccttggccatcttggtgagctagctttagctggtggctctctagctattggctttgcaaacatcactggctattcaattctctcaggcctagctgtgggaatggaaccaatttgtggccaagcctttggtgccaaaagattcaccctccttggcctctgcttacaaagaaccattctccttcttctattcacttccctccccatatcactcctttggctctacatgaagcaaattctcctcctttgtggccaggatgtggccatagccacacaagcccaatcatatcttgtttactccattcctgacctcatagcacaatccttcctacaccctttgagaatttacctcagaacccaatccattactctccctctcactctttgtgcaagtttttctattctccttcacatacccatcaactatttccttgtggctcacctcaagcttggaatcaaaggggttgctcttggtggggtgttgacaaacttcaaccttgtggcttccttgattctttacatagtcttctctggcactcacaagaaaacatggggtggtttctcctttgagtgcttcacacagtggaagtctcttctcaatttggccattccaagctgtgtttcggtgtgcttggagtggtggtggtatgagatcatgattttgttgtgtggtttgttggtgaaccccaaggctactgtggcttcaatggggattctcattcaaaccacttctttgctttacattttcccttcttcattgagcttcagtgtgtcaacaagagttggcaacaagcttggtgcacaaaagccctcaaaggcaaggctttctgccattgtggggttgtcttgcagcttcatgtcaggtgtcttggcattggtttttgctctcatggttaggaacacatgggctagcatgttcacaaaggacaaggatattataactttgacatctatggtgttacctataattggtctttgtgagcttgggaattgccctcaaacaacagggtgtggggtgctgagaggcacagcaaggcctaaagttggtgctaacatcaacttgggatgcttctatcttgtgggaatgcctgtgtccatttggctggcctttttcactggctatgactttcaagggctctggcttggccttcttgcagctcaagggtcttgcgcagtgaccatgttggtggttctttgtagaactgattgggaattcgaggctcaaagagccaagaaactcacaggaatgggaggagcagcttctggtgttgatcagagccgtgaggttgatccagagaagccactcaaacatgaaagcaatgaagattctttgctgctcgctgactcagatgaaaatgaacagtga

SEQ ID NO: 62994 - DNA, 1329 bp, Glycine max
  Peptide Sequence Number=SeqID_154679
atggctcatcgaaggcaaaagttggggcatctaacagttttgaattttgaccagtgcaaatttttaacacagatacctgatgtatctgatctcccaaatttgagggaactttcatttgaagagtgtgagagtttagttgcagttgatgactcaattggttttctgaataaacttaaaatattgaatgctaaaggttgcagcaagcttacgagttttccgcctctcaacttgacctctcttgaaacacttgaactttctgggtgttccagtcttgagtattttccagaaatattaggagagatgaaaaacataaagatactttatttgattgaccttcccataaaagaattgccattttcatttcaaaatcttattggactcagtgagataaacctgaataggtgtggaattgttcagttacgatctagcttagccatgatgcccgaactgtctgcattctacattgcagattgcaacaggtggcaatgggtagaatcggaagaaggtgaagaaaaagtggactcaatacaatattcaaaggcacgttccaagaggtttactcatgtagaatatttagatctatcggggaataatttcacaatccttcctgaattcttcaaagaattgcaatttttaagagcacttatggtgagtgattgcgagcatcttcaggaaattagagggcttccaccaaacttagagtttttcgatgcaagaaactgtgcatccttgacttcctcgagtaaaagcatgcttttaaatcagaaactgcatgaggctggaggaacaaactttatgattccaggaacaagaataccagagtggttggatcagcaaagcagtggacattcaagttctttctggtttcgtaataaattccctgccaaacttctttgtcttgttattgcacctgtgtctactgggattggtgtcaaagcaaaggtgttcatcaatggaaaaattctaaaacttccattcttttatggaagtaagaagatacaaagtatgttggaattggaccatacatatatctttgatctccaaccgtttgctttcaaaaataatattaatcggtttgaagaagcggcttgggaaaaggaatggaaccatgtggagattagatatcaaattgtgttaaaccatataaaagaaaaaagagaacaaggttcagtcattaaagcaactggaatctatatattcaaagaagaaagcagtatggagcaagatattcgatttgatgatccatatctcagcagttctgcatcagaaaacccctggttgccacaaaccatagctttggggacacgcaattgtcaaaaatggacttaa

SEQ ID NO: 62995 - DNA, 435 bp, Glycine max
  Peptide Sequence Number=SeqID_154680
atggcaatgaatccatgctcgacaattgacatcaaaccaaaaagaaagaaaaaagagagagagagagggagagagagagagagagagaaactaacatgtaaagcggatcggcgtcgccgtgggtggcggcgagggggtggaggaggaagaatacggtggcgaagagcaagagagaacgaaagggactcatcggaatcgcaagaaagcaaaagtcaaagcccgaagggaaaggaagagtgggagaaggttccggcgagaattgacgacgagttttgcattgaaggaaaagggtggcggggttgcggtgacggcggagagcggtggtggtggcggttgatctcggaagggaaaggattgagtcaactcggagcgagttggggagcggtggtggtgtgtgggtggcctaaagagaaccagaatctcgtgggaagatga

SEQ ID NO: 62996 - DNA, 742 bp, Glycine max
  Peptide Sequence Number=SeqID_154681
atgggatcaagtcaaatgccttcacttaaaaggaggttctgtcaggtcaaggtcaagagcctagggaccaccagtctaaaagagttagggcagttaatgggtcatctccagcggcaagcttttcgcaaagcttacagtaaaatttgggacttagccataatagaagtctccacaaaggccattgcctcccttgcccagtattatgatcagtcattgaggtgcttcacctttggggacttccagctatcacctatggaggcaaaagcaagaatcttggcaggtaaaggcgaatgggccccgttcatagatattctcgcactgttgatcttcggaggagtcctctttccgaatgtggatgggttggtggacctagcagcgatcgacgcttttcttgcctatcataaccacaaggaaagcccggctctttatgtatggttagtttcgcacctttttctccaagaggaaggaagaaccggagttcttatttcatgcggaggatttccaaatgttcccttgatggggatgaggggttgcatcagctacaatctcgtttttgctataagacaacttggctaccctatgagaagggcgccactagaggatgagctcacgcctgtcatttcacgaggcttcaataagaccaacttggagacacttaagaaggttcgcaaggcatgggaggtgttgcaaaagaaggacaaggaactcaggggcagtaacaatgggcccatcggtggctatc

SEQ ID NO: 62997 - DNA, 321 bp, Glycine max
  Peptide Sequence Number=SeqID_154682
atggcacccgaagatacgaacaacctttactatctaagcgaagtttaccgtgtgaaggttgaattaccaactgctggaaacccaggaccaaatgttgtgctgaaagggatagagatagatcccgagaaagtgaaggccattcttgaaatgccggagccacgcacggagaagcagggaagcgccttcgagaattatttggcccagcaacccctccaagattatcggccgatgcaccctgaggtcccagatgaagatatcatggccctgttccaagagaagtggacgcacgaggacatagaccaatggattggttgcttttga

SEQ ID NO: 62998 - DNA, 123 bp, Glycine max
  Peptide Sequence Number=SeqID_154683
gatccaattgcaaggtatgagacttgactcccacattggaagtatgggattccaatatgggatttataaggccttgggctctcgaactacaatagctagcttttgtggtgtggttctcccaag

SEQ ID NO: 62999 - DNA, 441 bp, Glycine max
  Peptide Sequence Number=SeqID_154684
atgaaaagagaaaaacatgtctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgggaaggacaatgtagaggctaatttagattgggaaataagggtagagcaacaacttaaaaggaagtctacttcaaaatcttatggctctcactcttatccaaagaaagaccaaggtcaaggaatcttaggggtgagaccttctaagcccaaagatgataagggggttcccatgaaccctaagagaataaaggtcattcctgagtggcccgctccaccaagtgtgttgagggaaaaagcccagagtttcaagaacctcgggatttga

SEQ ID NO: 63000 - DNA, 1017 bp, Glycine max
  Peptide Sequence Number=SeqID_154685
atggcgaatcaagaggagtgggtcctgtttgcggatgtattagattttctaatctttggggttgtcctctttccaaatgtggacattttggtggacctagctgcgattgatgctttccttgcatatcaccatagcaaggagtggccggtggtagctatcttggcggatttatttgatacatttgaccgaaggtgcgagaagaacagcgcacggattatctgctgcttacccgctctttgtgtatggttggtttcacacctattccaacaagacataaggcacccatgtccgctccaaagtcattgctcgtgtgtcaaaaagagaagagtagattgggaccaatacttggctgggataggaggcagaacaatcaactggtttcctcgatggaaggaaggaaaggagggagttctcttctcatgtagggactacccaaacgttccgttgatagggacgaggggttgtattaactacaatcccgcacttgctataagacagttagggtaccccataaggggggcaccgacggaagagagcctctcgcctttccttgtgagagatttcggcgcgcaaagtttcaagattgtacaaagagtccacaaggcgtgggaaagcccgttaaggaaagataaagaacttcggggcatccgtaatggcatcatcggtggttatcatgaatggctaagagttcatacacgagggttagattggctctccaagttgaaaattatcaacgaggagaacttcgaagctccggaagaggatgaagaagtccaagcactaaaaacagagctaggaaaggcaagactagccaaagaaaaattcaagttagtcgctacagacatccggaaagagtgtgcaaagttacgagaggaaaatgcggctaccgcaagagccctcgaacaagaaaccaagagggctcgcaaggaaaaacatggccgagataaattccgaggagctttgcggggcagcaccaatgagctcaagctccggagagaggaaagagaccagtcacga
